United States Patent 8,101,349 (GENE PRODUCTS DIFFERENTIALLY EXPRESSED IN CANCEROUS CELLS AND THEIR METHODS OF USE II) - sequence listing, part 4

SEQ ID NO: 10793 - DNA, 400 bp, Homo sapiens
ggcacgaggagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatg

SEQ ID NO: 10794 - DNA, 390 bp, Homo sapiens
cgttgctgtcgggggaggtgtgggaggttttttctcctgcctacctctctcagaccattctcctggaggcaccatacaatccctcttccccaaagcggggcacagaaaccagaactcctccccaaagccagccacagaacctaaaaatacgactctaactttccctccgcctttctgtgtagaaattggttataaagaaattcttggccgggtgcggcagctcgagcctgtgatcccagcactttgggaggctgaggtaggcggatcacctgaggtcagaagtttgagaccagcctaacgtggagaagcctctctactaaagatacaagattggccacgcgtggtggcgcatgcctgtagtccgggttacttgggaggctgaggcaggag

SEQ ID NO: 10795 - DNA, 385 bp, Homo sapiens
  misc_feature 274, 340, 341: n = A,T,C or G
tacggctgcgagaagacgacagaagggagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggnacctttatcttcccatcccactaatgttagtggtttttaatggagcttttattctgagaatatgtnngttgctgtttggttgttttttgagacagagtctcactttgtcac

SEQ ID NO: 10796 - DNA, 370 bp, Homo sapiens
cccatcgattcgaattcggcacgagagagaactagtctaagacatagaggggatagggacactgtaatcaggtcacctgtgaaagaaactggcattaaaaaggtaagaatttttagacatgcaggcatgagtcagccatcagtgattaatgactatgactgtaggctccattctttgtgtttcttctgtgtattagtttttcccatgaaatatttaatgcagggtgtttttttttttccacaaagctattttacattatttgaaaatacagcccgagcgggggggctcacgcctgtaatcccaacactttgggaggccgagggggatggatcacctgaggccaggaattcaagaccagcctggccaacag

SEQ ID NO: 10797 - DNA, 398 bp, Homo sapiens
  misc_feature 398: n = A,T,C or G
ggcacgaggtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttatn

SEQ ID NO: 10798 - DNA, 394 bp, Homo sapiens
ggcacgaggtcgctgctgagcctctttctgtcagcattctggctggggcttctgtacctggtctctcctttggagaatgaacctaaggagatgctgactctaaggtgaaagagggcacctagggtgggaaattggggggctcaaagttgcttctttgagaaccttgaaggcgtgggggcctttgggaggtgtccagggggacagggagccaaccccacggcgcccacctcccacctccagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtg

SEQ ID NO: 10799 - DNA, 388 bp, Homo sapiens
  misc_feature 307: n = A,T,C or G
ggcacgaggaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggntttctttttttattggttttttttttttctgaaacaaagtctaactttgtcacccaggctggagggcaggggcgcgatctc

SEQ ID NO: 10800 - DNA, 381 bp, Homo sapiens
tacggctgcgagaagacgacagaagggatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggag

SEQ ID NO: 10801 - DNA, 387 bp, Homo sapiens
  misc_feature 9, 12, 139: n = A,T,C or G
cgtgctggnggnttgccccgggagtgcagctgggctcctcccgctcctcctaggcaatgctcctggggagtctgtggggaagatgccatccagggtgctgtgcgctcttcctcatcctcgccctcctgctggacgcggncggcctggtccttttgctgctggggatcttggcccccctgagttcctgggacttcttcatctacacaggtgccctgatcctggctctcagcctactgctctggatcatctggtattccctcaacattgaggtgtctcctgaaaaactggacctgtaatttggccatgggaagaggagaagagacgcaggtgctgtatgcagacatgtctgtgaacctggggctcttgggcagcaacacgttgcagctt

SEQ ID NO: 10802 - DNA, 370 bp, Homo sapiens
tacggctgcgagaagacgacagaagggctgccaagccctattaagtagtaatgtggggaaacccactgtgtcagtgcaggaagccctagacaaatgttttcaaataaatttcactgcccagcctgcagagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtca

SEQ ID NO: 10803 - DNA, 383 bp, Homo sapiens
ggcacgagggtatagtctgcctccccacccacggctggtggaacctgagggcccccggcgccaccagagcttcgtggcttaatgggggaggcgaggagccactgcggacctgctcgggacagtgaagggcgccagtctcagccctcatctgaaacctgctccgtgaccctggactagttcctgctcctctctgggccaaatcctggccctgctcctttctggctgagtaactttggagctgtgccctgaaaccctctgccctgctgaagaatggagaggactcccccaccagcacctccacctaggacacatgggaactgtgggacttggagcaaagttttcaagtctctgtgccttagtttcctcacctgtaagttgggggg

SEQ ID NO: 10804 - DNA, 372 bp, Homo sapiens
tacggctgcgagaagacgacagaagggataggtctgagccacagtgcccaggccaaactttatcttataaacatatttgcatgtctgtgaattaatgatgtactgcagcatcactaaattagaaagagacaggaaacaatttaagcattcatcaataaaggactgattaatatatggagggacatctacacaacgaaatactatgcatctgtaaaatagaaccaggaaacatatttttgtttgcatatggagaatctttttctggaaagacatccacgacactgggaacaatgggctggtttcttgagacaacagcctttttttcttgtgtaaaggaggcccagaaaacttttttgctggaggataggaaat

SEQ ID NO: 10805 - DNA, 404 bp, Homo sapiens
ggcacgagccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggacca

SEQ ID NO: 10806 - DNA, 402 bp, Homo sapiens
attcgaattcggcacgaggagcacccccacaaccctagtcaacggccctatcctgtggggcctctgccacatctcagcggccccaggtgaatggctggctgctcagcagctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggggggtgcaccaaccatttcctgggctcgtaaatctagcaggatgggatggg

SEQ ID NO: 10807 - DNA, 370 bp, Homo sapiens
tacggctgcgagaagacgacagaagggataattctgacactgaacacatagtcaaagaagcaccaaataaatacccattaaaaacatggtttgacagtgaaaagaaaatgaaatatttatctttatttgacgttgatcctgaaaagcctccctgggtaaaatctggaaaaagtgaacctaaacctgtagatgacattaatgataagatcattcgtacaatttttaaaagactgaagcatttatttgtccaaattggcatatggcttcaaatcttcattacaaatctcacttaagaaagtacacagctaaaataagaaaacaatggtttaatgtgctatccagaatgactgggaacttaccatgaaaaact

SEQ ID NO: 10808 - DNA, 413 bp, Homo sapiens
ggcacgagggaacctcctgtatccagaagggttgttcatgcttttgactggttatgaatgaaaaaagatttctgcctttgaggggttttaaaagatggaaataaggatgtttgtgatggtgctcttgctttgcttgggacataaaagatgattcaatttcacttcagcacctgacacgtcatcaccaacatgcttgcttacaaggtcctttcaattttagaataataattaaaaacaaatatatagctactacttcaattctaaaatatcccaaagggtgagtattaaaaagcaatccaagaattttatcttaatttaagttttgctttcctttctcctaaccaaaatacataaggtaaaaatttattccaaactggacctttttaaaacttcgggaggatggctaacaagag

SEQ ID NO: 10809 - DNA, 377 bp, Homo sapiens
  misc_feature 377: n = A,T,C or G
ggcacgagggaggcagctcccaggagtcgaaggcccccaggggcaggtccaacccagtctctgctcagcttggccttaacggcggcacccccagatctccatccagttcctggtgtacaggcgcagcaccgccgcctcggagcttgagcccctcctccccagctgaccagaaccaggctgagcgcaggaggacaggcaccaccggatgccacaccaggcaggaggaggtgtggacagtgatggtacggcggccctgcatcagcctgcgggtggcctctggatcctacgtggaccgaaccgtccccccaggaacacaccttcatgtagaccccgaagcctcaaggccggggctggagcggagaccccagggcctctcn

SEQ ID NO: 10810 - DNA, 371 bp, Homo sapiens
  misc_feature 371: n = A,T,C or G
tacggctgcgagaagacgacagaagggctcttttgaaaaatgattttagtctgctcgtgtttaggtaggtaacttctcttgatcccaattttatactttaaatgatcccagatattgcattttaaatgagatgagtatataaaaaataggaagcagaaagcataattaaaaattgtggttacattatcgtgagaccaaatgaccagtcagactcctctgaccaatttcatagaaaataaggaggtatcatttgaacaagttgtaacatatgggaactgttttaaacaccatcattaatatcaagaaactattaggaaatgcaagtttgtgtatcgtgtgtgtgtgtatgctgattttacacacacaggcan

SEQ ID NO: 10811 - DNA, 394 bp, Homo sapiens
  misc_feature 373: n = A,T,C or G
tacggctgcgagaagacgacagaagggctccttcccctttgcagctttggcgcctcggccactttctgcccaaactcacccctggatgaagggtctaagcttgctgctgtctccagcagtgatgggctctactaggaggcattgccaggtctggtgggctccttcgggttggcctggctcttctctttgacctctgtaataactctgagtgccctgcagtggggagcactttgaggagggcctgtgaatgaagccttaacaagtctgtccagaagctccctcgtggccgcctgcatgctgctgatagtttgaatgtcttcacaagaatggatcaaaaccctctgtatataacatggtctttggttctgcaganggcgattcttgaagccacagg

SEQ ID NO: 10812 - DNA, 397 bp, Homo sapiens
  misc_feature 206: n = A,T,C or G
tacggctgcgagaagacgacagaagggcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtanatatgatgaggatctgggacgagtagcccggttcacctgtgatgtagagaccctaaagagagcattgattcatttggacaggtgctcatccaaggacagctattcgacaggatccgatgtactcagtaccattgggccttgagaacccagggatgctcttgtggttctcttcactggggctttcttccagc

SEQ ID NO: 10813 - DNA, 391 bp, Homo sapiens
ggcaccaggcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaa

SEQ ID NO: 10814 - DNA, 397 bp, Homo sapiens
tcgattcgaattcggcacgaggccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccg

SEQ ID NO: 10815 - DNA, 384 bp, Homo sapiens
ggcacgaggccttgtacagcagtaatcttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccg

SEQ ID NO: 10816 - DNA, 385 bp, Homo sapiens
  misc_feature 385: n = A,T,C or G
ggcacgaggagacgtgctggtcagcatgtacaggtcagaggaagggacgctggcgccccaggaacagctctttggagggggtggggagcagggccggaaccttgctggcgcttgagccgattcagatctgattgagtcatgttggcaagagctgggtctaggaccctggggtggggactggagggttgagcaggtcggggcctcagcctccctccggttccccagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccan

SEQ ID NO: 10817 - DNA, 386 bp, Homo sapiens
tacggctgcgagatgacgacagaaggggcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtgggtacagaaaatgaacaaaactgcaacaaaatggcagcagacacctgcacctacagatactcgagctgtgaagactcaagttgagcagaataagttgtttgaggcagaactgaagcagaatgtaacaaagtacag

SEQ ID NO: 10818 - DNA, 374 bp, Homo sapiens
  misc_feature 21, 22, 23, 24: n = A,T,C or G
tacggttgcgagaagacgacnnnnaggagcaagacctgggcctggagctcagggtcccttttaggtgggataaaaaaagagggacagagagagggaggaaaagagagggcacggaggcccagaaagagagggggacagagacccagagagagagggggacagagacccagagacccaaagagagaaggacagggaccaagacagggggacagattcggagagaaagggacagaggcccagagaacaagggtcccagagacttcgggacacgcttggatgcagggagggcttttgaaagcagggccgtgttgtcccctctgaaccctgaccctccctccaggacgggcggctgagcaaagcggaaatcctgggta

SEQ ID NO: 10819 - DNA, 394 bp, Homo sapiens
  misc_feature 394: n = A,T,C or G
aattcggcacgagaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagn

SEQ ID NO: 10820 - DNA, 395 bp, Homo sapiens
  misc_feature 395: n = A,T,C or G
cgttgctgtcgattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagacn

SEQ ID NO: 10821 - DNA, 381 bp, Homo sapiens
ggcacgaggcgttccagccctgtaagatgttgcgcggggtgagctggaacatgaatgggattcggagactcctgcaagggggggcaaatgaggaacccaccaactgtgccgccgaggccgtggggcgcattttggacgagctggatgcggatatcgtctgtctccaggaaaccaaagtgaccagggatgcactgacagagcccctggctatcgttgagggttataactcctatttcagcttcagccgcaaccggagcggctattctggtgtacccaccttctgtaaggacaatgctaccccagtggctgctgaataaggcctgagtggcctgtttgccacccataatgtggatgttgggtgctatggaaacatggatgagt

SEQ ID NO: 10822 - DNA, 371 bp, Homo sapiens
ggcacgagctcctttggctccctgcatggggccttccagcccaagagcacgaaccctgagctgccaccacgactggggccggtgccgagcgggctctcccagaaggggacacagaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagcttccggggcccacggacccttccttgagcc

SEQ ID NO: 10823 - DNA, 390 bp, Homo sapiens
tcgaattcggcacgagcctaaatccagtttggttcaaacagtactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcag

SEQ ID NO: 10824 - DNA, 359 bp, Homo sapiens
tacggctgcgagaagacgacagaagggagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggctg

SEQ ID NO: 10825 - DNA, 365 bp, Homo sapiens
tacggctgcgagaagacgacagaagggggggtctgttgagctgtcctgggctgggtgccttgctctttgactgagactggagacagacggcaacagccacaggcagactgaggtggcaataggaaatctgccgagatgttcagtcaggtgcccaggaccccagcctcaggctgctactacctaaattccatgacacctgagggccaggagatgtacttgcgatttgatcagactacaagacgctctccttacaggatgagccggattctagcacgccatcagctagtgactaaaattcaacaaggtgagtggccggcagtggaaggctgttgctcattctgatttctgttggctctatttcatgc

SEQ ID NO: 10826 - DNA, 348 bp, Homo sapiens
tactgctgcgagaagacgacagaagggacatatggccaaacatgcatattaaccagtttggttttttcacttaccaatatgatttgaagatcattccgtattcagcacatacgtctgtttctcgttaagtatttatttacacctcacaacaactctgtactcccctgttactcccccattttacagaggagactgtaggtctggagatattaaatgacttgctgtgggtcacacaattgataagaggtagagttcaaatttgacttcagagttctttagagctcttgaccaatagactcttccacatggtacatgtggtcttcatcttacaaacagtgatgtaatgag

SEQ ID NO: 10827 - DNA, 362 bp, Homo sapiens
  misc_feature 127, 173, 238, 328: n = A,T,C or G
tacggctgcgagaagacgacagaagggatttcccccttgggccaccggcttcagggtgccccaaaacccccactctgccccacagggctgccaaagccagcctccttgacaacatctggctgacggngaggggagggcagtaagagccgccacagaaaacaggaattcatggngggagtggggttgaggattaacgttgagtttcaagacatccctcgctccagccactctgtgagcntgctgtggggtcgctacacacagctcctcaccctgaagctgctgggtcccttgataacacgctcaccttcccagggaaccagccacaganttagaacagatccggagctggtcagcctaagagg

SEQ ID NO: 10828 - DNA, 360 bp, Homo sapiens
  misc_feature 319: n = A,T,C or G
tacggctgcgagaagacgacagaagggcccttgagacaggaagcccctggaggtttcacaccaattcacaagctcttatccaaggttagaacaacaaaacccattgacctgaaagtacccataaagacacattcttgttgagggaaagataaaaggataaaaccctcacacaagaagattttttcgccgggtgtggtggctcacgcctgtaatcccagcactttgggaggccgaggcgggcagatcacaaggtcaagagattgagaccatcctggccaacatggtgaaaccctgtctctactaaaaatacaaaaattanccgggcgtggtggcgggcgcctgtagtcccagctattggag

SEQ ID NO: 10829 - DNA, 351 bp, Homo sapiens
tacggctccgagaagacgacagaagggatagcgtttattcccctctttcttacttgaatggaatccatttttaagctttttgattttttttgtcataaaaaaaagcacataacattcttcataatagtattgttattcaactttttgtcatggttgaaatattaatgcaatactgaagtgtctataaaccagatttatttattaccacactgacaaaaagtacaactaacagttggcaggtagataacatcagaaaaatccatgctatgaaaaggaattttagtatgaactcatcaaagtaactagtaatttttaacagactctagtgacatatatgcctctctctctaac

SEQ ID NO: 10830 - DNA, 350 bp, Homo sapiens
  misc_feature 3, 4: n = A,T,C or G
tanntctgcgagaagacgacagaagggggcttaggactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcggctcgttgcagcctccacctcctgggttcaagtgattctgcctcagccccttgatcagctgggattacatgcatgtaccaccacacccggctaattcttgtatttttagtagagatggaga

SEQ ID NO: 10831 - DNA, 354 bp, Homo sapiens
tacggctgcgagaagacgacagaagggatgaaatctacaaccttaattttataggtgagggaattttacctttggtagggtcacggtgttaggtcattatgataactttcaaggtgcctgggaataaaagttttataactttaatctgtctcctgcttttgagccttcgtgatctctccaggagctgctgtaatggcttcccaccctgcgtgggaacaagtggggtgctggtgggacaagtcgggggctggcgatgtactctatgtgtttgtaggtcagagctggaaaccacagagaacagcccaggtggtttcattagtctaggtgtgaggtcactgcggggcggcagtagga

SEQ ID NO: 10832 - DNA, 351 bp, Homo sapiens
tacggctgcgataagacgacagaaggggtaaatacatttttcttttttatgtaattaattaaatcagggatatagatttgatctgtaatttgggtataattctaatctttgctgaaatcacatctcaagtataatgaggcaactttatgcaaatgtacttgttgtgacaacaataacattttccttttttttttttttttaaaaacgatttttttttttcccccaggggggggggctggggggaaattttgtttaatggaaacttttccctccgggtttaaacaattttaacggcctaactttcctgagaggggggataacccccccccccccagttattttttttttttt

SEQ ID NO: 10833 - DNA, 351 bp, Homo sapiens
  misc_feature 292: n = A,T,C or G
tacggctgccagaagacgacagaagggcgtcaacatctttctggatgctttctcatctctcaaataagccaacaggactagatctgatgttcttgaacacctcagtcttggcaatctattttaagcagactctcctaggacctcccatgttacccatcatctgagagcaacgtttatcaaacattttttttacattacccccctacagagctatttaacatttttttgtgactgcaaccctcctctttttgtgatcttcaggttcccctggggtagtttcttacataacagnaagattctttactattatgtgactgacatgttttataggaatattgacactagaaaaag

SEQ ID NO: 10834 - DNA, 361 bp, Homo sapiens
tacggctgcgagaagacgacagaaaggctttccatggtagtattcctggattcctaacctttcacacgtgcagccatcactgtgggaacactgaggacttcaggaatggctcttgacaggagcccagcagtgccaacacactcttactactgtaaatgttaaataacaagaaaacaattcggtttctgagatgcactcagtgggtgtttattctttgcaatcattattggcatctgaagtcctgggttgaggaattagaatcaacagttctttttccatttcaatttttgcaacatggtgggaataatttctttttcggtttgctttgaattataggcaaaagctcccaagtgcgtggttg

SEQ ID NO: 10835 - DNA, 350 bp, Homo sapiens
tacggctgcgagaagacgacagaagggataggtctgagccacagtgcccaggccaaactttatcttataaacatatttgcatgtctgtgaattaatgatgtactgcagcatcactaaattagaaagagacaggaaacaatttaagcattcatcaataaaggactgattaataatatggagtacatctacacaacgaatactatgcatctgtaaataagaccagggaacatatttttgttgcatatggataattttttctgaaaggaatggtagaactggaacaagggctggtgcggggcttacgctgtatccagcactttagagccaggcaagtgtcactggagccagag

SEQ ID NO: 10836 - DNA, 367 bp, Homo sapiens
  misc_feature 174, 355: n = A,T,C or G
tacggctgcgagaagacgacagaagggaggatggtgagtgcacagcaatggacagaatgagggatggctggtcccacagagttagctgtggctaaaaaaaactgtctctagagagaggagagattggtgggcagtttttgtgactcggacacattaaaacacatacatactctncaaatgaagtgcattcaggcaaatgccaagaaatacagaattcatatttataaaaacccaaaagaaaaaggggaaaccatgccttgtgtgagaataataaacatcaaatctattattatattttttttaagatgggtgctccccctggtgcacagcctgcagtgagtggacacgacaatgntcaatggctttg

SEQ ID NO: 10837 - DNA, 353 bp, Homo sapiens
tacggctgcgagaagacgacagaagggatgttttctccccaaatatctgatctcttttggaattcctttctattatgatagcgccattctgatctgacatattcttttacaaccttccttcactttcaattaatattcaagtcatatctctgtttcagagctgttttctcaaatcaattcccacaaactaatatccacagccctcagctttgcctgtgctcaggctctcatcttgtctcaattgtgtctaatagtacctgttccctttctctaatattaccatataattgtttatattgttcattggccaggtttctcagctatagagaaatccactctagctagttaaataa

SEQ ID NO: 10838 - DNA, 352 bp, Homo sapiens
  misc_feature 22, 23: n = A,T,C or G
tacggctgcgataagactacannaaggggagggagcagggggctcattggacaaagacttgacctgagttccaaaaaatcaaatttcagggctattggcgcattatcgtagccacaaaacgttgggggtcatgttacctcttttgtccagggggttgtgtgttcccttctcactgaattggatttgacattcaatttgaattgacagtgaacttcggggtaattcctttcagaaacctgaatcattttaggatctgggaagcattactctgtggcaggggctcttaaccaaaaagcccatcgctagaattctagggtctctgaatttggatgggaggagaaacacaacaaaa

SEQ ID NO: 10839 - DNA, 349 bp, Homo sapiens
tacggctgcgagaagacgacagaagggataatacttttagcctcaaatgtgcttgccatagaggtgagacttagagcaaaaattacaactaaaaagaaccaaatctgacttattcatgccaatagaagaagacttcaaggcaatgtgtgaaagcattcagcatgcaagcagaaatgccgcattttcacatctggctccagccctgtggattttgagaggcaatgtggctttaaactctttcatagctgatttaagcctcacctcttctgtgaagtgcttccgatctctgcagcccataaaggtttctagttccatgaaaggaaggaaagaaaagaagagcgacagcagg

SEQ ID NO: 10840 - DNA, 351 bp, Homo sapiens
  misc_feature 1, 2: n = A,T,C or G
nntttggctgcgagaagacgacagaaggggtctgtgggtcagatacagtattttgatgatttcaatcaataactctgcaagccttggtgttattactggtgtctttttctgtctgctttcccccacccccgtccccacattttatttgctttctcaaaagcatctgcacacagatacacgggtggacatcctcagaggcagggtgactcagccgaacagaaccctgcaacatgcactggcaaaagtgccccacccagcgtcgaacacccgaccttgtcatttacccacgggtgctagcacaatcagtgtgctatgattgaggggcggctcttccccctgccaactaaaccc

SEQ ID NO: 10841 - DNA, 352 bp, Homo sapiens
  misc_feature 4: n = A,T,C or G
tacntttgcgagaagacgacagaagggctaaaaagctcatctaaaagccaggctctagtgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaagtgaaa

SEQ ID NO: 10842 - DNA, 351 bp, Homo sapiens
tacgtctgcgagaagacgacagaagggcgagtgggtgttgagaagacatgagaggctgctgagaggctgggaatttcttgccctggggcatgatatggggaccccaggcatgggctagaggcagagtctcatgctgggaggaggtgagctgggaggggaatgtttgctgtgactgtggctgagtcttagcctggatgatggaggctcatgggtagcagcagtcgctctaccctgaatattgttcaagggttgtgcaaatgttggtgtggggctggtgggacagcagctctgctgctggtgtggactgcacgggaaatccagaacagcagtcatgaggttggagggcctgct

SEQ ID NO: 10843 - DNA, 349 bp, Homo sapiens
tacggctgcgataagacgacagaagggacatgtgtgttaactttctcatttaacataattgcatttcactgagaccttctggaaccaacaagaaaaccttaatatggaactgcaatgatgggaatttggggcattgaaagaagttgggttggcaacattgcttgggtgatttccttgctaacattgtactgtaaggtgtgagggcctttgcattaaactctgactgggctctgtaaacctgagcctcattcttagaacctcttgagccccttgatgttgcccagtcaagtccatagtgactgtaggggctgaacttcaagggccacttttgcttatagccatcacctga

SEQ ID NO: 10844 - DNA, 363 bp, Homo sapiens
tacggttgcgagaagacgacagaaggggcattcctgttagaatagatagagcacgtccaagggcttggagatgtggagcagttggaaacactgtggttggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtca

SEQ ID NO: 10845 - DNA, 354 bp, Homo sapiens
  misc_feature 4, 5: n = A,T,C or G
tacnnctgcgagaagacgacagaaggggcattcctgttagaatagatagagcacgtccaagggcttggagatgtggagcagttggaaacactgtggttggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcac

SEQ ID NO: 10846 - DNA, 356 bp, Homo sapiens
  misc_feature 9, 339: n = A,T,C or G
tacggctgnaagaagacgacagaaggggccagttaggaaacagttaaagttgacccaggattaaatcaaatttggaaatagggggaaatgttctccacatggacagcaagtcacccatttgtgcatgcttttgccccagctagacacatctcccacatctctactgctaccacctggtctaagctaccatcatcttttccctgggccactgtaatatgctcccaagctataaaatataaaagctctgcaggccattatctgcttactcccctcattcactacactccagccatattgacctttctttttgtttgtttgttttgttttgcttgagacggngcctcactctgtcatcc

SEQ ID NO: 10847 - DNA, 351 bp, Homo sapiens
  misc_feature 215: n = A,T,C or G
tactgctgcgagaagacgacagaagggtttacatagtacaactgctttatcctttcaaaagcagatacgtcaatcaaaacttgacatttatttatctatatttatgctgagttcccttaaaatgttttgtctttttccatataaccaatcatattatttcctaaaaataaacttaggtattgtcacagggataagaacttctgctttccatactngtgtgtggggattttgggtttgttccgtttttttgagatgaggctcactctgtcgctggctggagaacaggggcgctatctggctgggattacggtgggagcaacgcgcccagcctgttttttttaaaggggatcc

SEQ ID NO: 10848 - DNA, 363 bp, Homo sapiens
tacggctgcgagaagacgacagaagggctgtcctgtccatttacacggtctgtgcagtagctagtcattgaataaagcagaatcagggattgtgggttatcttcttatagggcacatgagtagtttgtgagaagacagcattgttacaacagggcagaacctcacattctgccaaaaaaaaaaaaaaagccctttatttttggccaaaaatttggaaatatcgggattgggaaactttcgggttggaaaggggccaaaaaaccccttgcaaaaccccattttggccttgaaagggattttcttaccgggggttttttttatataaatcgggccttaaaaaaaagaaaaaggattgcttccccg

SEQ ID NO: 10849 - DNA, 363 bp, Homo sapiens
tacggctgcgaaaagacgacagaaagggtcactggacactggctcttttgaactggtgcaaaccagctttggcacaccttggatgttaaagccactggtgattgagagccagcatcaaattttgtacagttcaaattcattcttctctccctcaaaaacccagcttttggctaggtgcagtggctcacgcctgtaatcccattactttgggaggccgaggcgggtggatcacttgaggtcaggagttcgagaccagcctggccaacatggcgaaaccctgtctctactaaaaatacaaaaattagccaggcatggtggcgcacaactgtagtaccagctactcgggaggttgaagcaggagaa

SEQ ID NO: 10850 - DNA, 347 bp, Homo sapiens
  misc_feature 3: n = A,T,C or G
tancgctgcgagaagacgacagaagggactcttggacacggtttccaatttgtcagtttgtcttcacctctccacaaccacactttgtttccagaaaaacaaatatacactacgcctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagcca

SEQ ID NO: 10851 - DNA, 356 bp, Homo sapiens
  misc_feature 356: n = A,T,C or G
tacggctgcgagaagacgacagaagggctccttcccctttgcagctttggcgcctcggccactttctgcccaaactcacccctggatgaagggtctaagcttgctgctgtctccagcagtgatgggctctactaggaggcattgccaggtctggtgggctccttcgggttggcctggctcttctctttgacctctgtaataactctgagtgccctgcagtggggagcactttgaggggggcctgtgaatgaagccttagcaagtctgtccagagctcccctggtgccgcctggcatgctgctgatagtttgcaatgtcttcacaagaaatggtatcagaaacctcctgtcatatcn

SEQ ID NO: 10852 - DNA, 350 bp, Homo sapiens
  misc_feature 1, 2, 4, 5: n = A,T,C or G
nntnncgttgcgagaagacgacagaaggggcatatgccaggctcgtctgaccctggggggaggatgtaggaagcaggcagagctccggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatggtggtaac

SEQ ID NO: 10853 - DNA, 355 bp, Homo sapiens
cgattcgaattcggcacgaggccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggaaccatctggccctccgacttcttcaccaaaccaggctagagcctgacctgcagtgtctttgatgcttgcccggcagcatctgctctgagcagaagggaatgccacagggaagacagcagtggagggg

SEQ ID NO: 10854 - DNA, 337 bp, Homo sapiens
tacggctgcgagaagacgacagaagggcttcaggtcatttacatggtgctgagctagaaattcaaatccttaagctcattattttattccccactttgtccagggatgttagaagcagccagtcagtcttattatactcattagtttgacagaaatgtttgaaagtatcatatacatggtcactcagatctttgcttctcttatgtatttgattaggaggatctaatggcaatgttttgaataactctattgccagaccatgccatgtactataagtgttctctttactactggaaatagagcattagtagtatctttaaaacttatcagattaggc

SEQ ID NO: 10855 - DNA, 361 bp, Homo sapiens
cgttgctgtcggccggcttatggaagtttccagagccaaaggcacagctgcagccccctccatgctggaaaagcttaggctttccccctggggccatgtagatgtctgaccccaaatccacagcacccactttgccctgagatccccccaactcccagaaccacccgcaggcccacatttccagctgcccactacacctgtcccaggtcatacctcaggaccctccaaaaggatgtggtcagaactgcaccccaagaccccctgctcagtgcagctctcatgcaggcccccacccatgctgcctgcctccctgcagccaggtagcagccccagaacccacgccacggcctttccgcagtca

SEQ ID NO: 10856 - DNA, 619 bp, Homo sapiens
  misc_feature 420, 458: n = A,T,C or G
tacgtctgcgagaagacgacagaaggggagttgaatccaatgactactaaacacgtaactaacagattggattttttttaaactccaggtaggtgcccttcatgaaagatatatctaaaacaaaatgatgcagggaaaccatatacctgttgtctcagttatctactgcagtataacaaaccaccctcaaaacttaatgacttagtgccgggcacgtggctcatgcctataatcccagcactttgggaggccgaggcgggtggatctcttgaggtcaggcgttcgagaccagcctggccaacatggtgacatactgtctctactaaaaatacaaagttagccgggcatggagtcacgcgcctgtaatcccagttacttgggaggctgaggcagtagaaatatttgaaccacggaagtggncgtttgcagtgagccacaaattgtgcacttgactttantctgggcgacgagtgagactgtttctaaaacaacaccaaaccaaaccttaatgacttatgaatgtgggcttagtggccgacgaaatacacccttgatggcgggaacaagatgcaaactaagatctgggcatttgagagtttgagaccttgattcctattgc

SEQ ID NO: 10857 - DNA, 623 bp, Homo sapiens
  misc_feature 395, 412, 468, 511: n = A,T,C or G
tacggctgcgagaagacgacagaagggtgacttgggaagttgttaaatgcctgagtctccgtttcctcatctgtaaaacagggataataattatactttattaccaagattaaatgactttctatgtgtcaggcactattctaaatgctttacaaattcttgttaaataaataagaatttgccactgtgggccgggtgcgatggctcatgcctgtaatttcagcactttgggaggcagaggtgggcggatcacgaggtcaagaaatcgagaccatcctggccaacatggcgaagccccgtctctacaaaaaatagaaaaattagctgggcgtggtggcgggcacctgtaatcccagttacttgggaggctgaggcagaagaatcgcttgaactcnggaggtggagggtgcantgagccgagattgtgcactgtactccagcctgggtacagagtgagactccgtctcnaaaaaaaaaaaaaaaaaaaaaaggtgggggccctttttttcgnaaacccaaatttaataaaacccttggtgattgggaaacaccccatctaaaggcgggaaaaaacgctttttggaaattggaagtattgtttttggaacctataaaccgaaaaa

SEQ ID NO: 10858 - DNA, 632 bp, Homo sapiens
  misc_feature 586: n = A,T,C or G
tactgctgcgagaagacgacagaagggccgcctcctgggttcaggccattctgctgcctcagcctcccgagtagctgggactacaggcgcctgcaaccacgcacggctaattttttgtatttttagtagagacggggtttcaccatgttggtcaggatggtctcgatctcatgaccttgtgatctgcccgcctcggcctcccaaagtgctgggattacaggcgtgagccaccgcgcccacctaaaacatttcaaaataagatacgcaagctctatgtggaagcgaaagggggaggcgtgggagtgtcgatctacaaaaagagttttatgaagtgaaatgggtatatctcaaactgggttggatggatgcacaggctcatgcctgtcatctttgttatttggaagcgcgggccgggcggaaacttgtttttttttttttaaaacacaaaaaaatgtttttggaaccctttttttttgggaggggtgaggttttttggttcttttgccactcctttgggggagaaacctctaccccaccccccccctatttttttttccagccccgcggaacgcgcggatggtggttntttttattaaaaaaagaggggggggcgccgcgctgcctcaccccca

SEQ ID NO: 10859 - DNA, 626 bp, Homo sapiens
  misc_feature 392, 401, 422, 467, 528, 545, 553, 554: n = A,T,C or G
tacgtctgcgagaagacgacagaagggagaacaagtttaaagtttgtgggttttgaaaatactaccatggttggatgctttggttttgtgtcagcctgttcttaacctgtagtgtttaccatttaccttcccgtcaaatgtaaagggaaccttataaaacattatagacacgtatttggggtgtaccgtagagggagctgctactttggaaaggactaaatgtctttagttaaatcttataattagcttatagttttattaatttagaagtttagaattttataagttttagcataaacttgaatacagcaattttaatataaaagtattaatttgtaatttaagaacttggccgggcacggtggcttacacctgtaatcccagcactctgngaggctcangttggtggatcatgaagtcangagttcaagaacagcctggccaaattgtgaagcctatattactanaaatacaaaattggctggcgtgcccaccacgccggctcggttttgattttttgagagacgngtttcaccttgtgccangctgtctnncactctaggctaagcgatcaactgctcacctgttggatacagcatgagcactactccagcacaagctcattt

SEQ ID NO: 10860 - DNA, 682 bp, Homo sapiens
  misc_feature 467, 483, 488, 498, 502, 635, 682: n = A,T,C or G
cgccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccacctcagtgaaggcacaaccaacagctgctccccgggcatttccaagaccctccaggcccccagttctgaggactagggtggaggcagtgtttctccccagcatcaagtgaccagagaagtgaagtgaccccactgccgccacacaaagccacacagtgcgatgtctggagctcctgcctcctgcaaggtggagggtggtgcttggccatgagtgaccaaactacanagtgaggggtgtgcangtggnggtgaaaggntggngtgagaactgatccgagtcgaactcatcttctcttgcctgatgcaacgtgcaatttggggaagaactgtcctttctgggcttgttttcccattttcaaggactggtttgcctgccactcctctcatgaggaantctgggctgccttgcttgctccactcagggcggttcaccctgtcaan

SEQ ID NO: 10861 - DNA, 458 bp, Homo sapiens
  misc_feature 313, 324, 348, 406: n = A,T,C or G
ttttggccgaagcggcctacggctgcgagaagacgacagaagggcctgaaagtggcaagtggaagaagacattttaggcaaacatcaaccaaatgagagcagaagagatcaaaattgtattatacaaaatacatcgtaagtcaacaactctcttattttataaaatatactttatgtcaaaattcacaagagaaaaaaaggtcattaaacaataataaagatatcatttattgaaaatgtatgacaaatatgcgcatacatatatttatatgtttgtgtctgtacatatatttctcatattaggcttcctaanatacaaagcanaaattgacagaattaaagccacanatagaaagccatatattataataagatatgtaatacttcgattctgcaatgaccatanaccaaaccattttatcatggaaagagggccagtacgtgctcacgcttgtatc

SEQ ID NO: 10862 - DNA, 424 bp, Homo sapiens
tatcgattcgaattcggcacgaggagagagagagagagagagagagagagagagagagagagagagagagagagagagagagagagagagagagagagagagagagagagacagagagagagagagagagagagacagagagagagagagagagagagagagagagagagagagcgtgcgtctctctctctctctctctctctcacacacacacatgggggtggggcgcacccatctatatcttttacccctctctgttctgtgcgcccgcccccctctctctctgtctctatatatatagctggctgccccctctctctttctctcacccctcttgtgtccgtacccttcttgctctcgagcgctatctctctctttttttctttcccggggggcgcgcgctgatatatacactcacatatat

SEQ ID NO: 10863 - DNA, 423 bp, Homo sapiens
ttcgaattcggcacgaggtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaatgcacg

SEQ ID NO: 10864 - DNA, 357 bp, Homo sapiens
  misc_feature 357: n = A,T,C or G
tacggctgcgagaagacgacagaagggtgagtcatcgtaagccaaacattaaaattctataacttaaattgaactgtcatatagtttttgccatttgaggcttcaagagtcaaattaagcctgctttaaacactttgaaagacagtgctctggggaagaaaatgctagctaaatctgagcatctcacgttatgcagaaattattgcccttatcttcattcataatgaaagtgttggtgaaagaaggaatgaagcagaaaaatgatcactggattggaaacaaaactcctctgttttagcccttactctgcttctaactggacaggtgaccttgggagaaaaaatttaacttccatgn

SEQ ID NO: 10865 - DNA, 400 bp, Homo sapiens
ggcccgagagagagagagagagagagagagagagagagagagagtgagagagagagagagagagagagagagagagagagtgagagagagagagagagagagagagagagagcgagagagagagagagagagagcgtgctttttcggtgagagagagacagaaccccccctctctctctgtttgtttacgcgccccggtgggcgcccccccccccgagttgtgcccttacaggcggggggagctctctctctctctcgggggggggggaaaaatatctatctatatacacgcgccgctgtcttttttagagagatgtttttatctcagagagcgcggcgaggtacacatgcggtctcttcttagagaggggcgggaggggctctctctgtttttctctcc

SEQ ID NO: 10866 - DNA, 391 bp, Homo sapiens
tacggctgcgagaagacgacagaagggtttttccagaggagtcccccaccaacaattagcagaaccagtgccattttcaatacatcaagatcaacatcctacactgaacattcttagtgacccatagtctgggtgaaggtcattacactctcagggatttgaattagaacacaggtaaagctaaagaaagtgggagaagaacttggaattagaaaaagcccagttcaaagataatttgtattttactgacatgttcagcatagcatgaactctggctctgccgaacgtccagtctgcctcatgtacaaaagtttctgatccaggggccgggtgtggtggctcatgcctgtaatcccagcaatttgggaggccaagacaggcggattatgag

SEQ ID NO: 10867 - DNA, 378 bp, Homo sapiens
tacggctgcgagaagacgacagaaggggggggctattatttgaatttttggcctttgaaataattatgaaaacattcatcgttattatccaggagtttcactcatttgcagaataacttcattctgaaaatgatataacacctcccaagactaagtaatattaacagagctaatattttatctttttgcccttaatgcctcctatattgctggggacatgatagggcctgtgtgtgaatgtttgttgaaatgaatgaataatactttttaatatataggagaaaacctaagcacagcagtttgtgtgagacagtgatcagaaactttgccagttaatagattgacttcaatcagggagacagagcctaagtcaaaaaa

SEQ ID NO: 10868 - DNA, 357 bp, Homo sapiens
tacggctgcgagaagacgacagaagggtgttggacctttcccgaggtcttctcataaaggcttagtgctgagtgctggaagttagatcacatgcacactgatttctcttccaaactaaactgatttggaaatttattgctgtggcatttcaaaaatcatgtgtattcttcactccctattttaacgcggaaaagctaaaaatcgttcattaattgggaggaaaagattgtgaacattttatttattcaagaaaccaggccaggcgcagtggctcacacctatcatcccagcactttgggaggccaaggcagacagattgcctgaggtcaggagttcgagaccagccctgccaacatg

SEQ ID NO: 10869 - DNA, 359 bp, Homo sapiens
tacggctgcgagaagacgacagaagggaatgagaacatgatttttaaaaaaatattcactcattgttttattttggtcaaaatgctacaaatccttagaaaagtaaattctaaagtatagagtttatcttttttaactattaaaacctgatgaatattacaggatatgtcctaaaagtataacattgattaattagccttcagtgtaagcaacaggtcatctccgttccagataggacctcagtaaacctggatgaactagagaattgaagataaccttaaagctaatgctctttaggctgggcatggtggctcacacctcccaaagtgctgggattacaggcatgagccaccgtgcct

SEQ ID NO: 10870 - DNA, 361 bp, Homo sapiens
tatggctgcgagaagacgacagaaggggagcggcaccccaaatctggttctcctgtatctctgtacctaaagcctatttgggtcccggttatctacaggacccccatctagcccagtgatgctcaaacttttaaattacaaacttttttttttttttttttttgaaaaaaaatttggttttttccccccggctggagggcaaggggggaaatttggtttaaccaaattcccccttccgggggggccccttttttttgccttaacctcccaaaaaatggggaataacgggggggccccccccccccgggtaaattttggattttttttaaattgggggggaattccctttttcccccccggg

SEQ ID NO: 10871 - DNA, 381 bp, Homo sapiens
cgttgctgtcgatattaacctgttgtcatatttgctacaaacatttccatgatgaattatttgtcttttaatattgttcattgtttggacatgtagaaatgtgttatcttaggagtcaaaatctgtccaacttttgttttgtttttcctattctatacttggaagaacttattctccaagaagtttgataaataagtacattatatttaatgtttttaaaaaatggtttaataaactatttcccctgcaattgctatttagccatcttgtcattatttattaaccaattcttcctttccacagtgatgtagtatcttttcagttatattagttatagagtcagatatagctcttgttcagtgccatactgttttttttatt

SEQ ID NO: 10872 - DNA, 358 bp, Homo sapiens
tacggctgcgagaagacgacagaaaggtttgcatcatgcatgttgggcatgggtcttttctcgccaccattcttagggagacctccacctaagtcctcacttcacacacactgccttacacagtgcctgatacttagtaagtgctcagtgaagtgaatccagacaatgtaagagtgtctctgggcctcctgggtgttctcgggccagttatgaaggtgcatggaggtatattcccattttacagatgaaggaattgagggtcagggaggccaactagtttttctcatagccaaatagccagtaagaagtggagacaccagcctgggcaacatggtgaaaccttgtctccactaaaaaa

SEQ ID NO: 10873 - DNA, 364 bp, Homo sapiens
  misc_feature 364: n = A,T,C or G
tacggctgcgagaagacgacagaagggcatgagccacggtgcctggttctcactgcccccgcccccctttttgttaacttcccattgtctgcaagaaaaaataagtttgatcattcagggttcctgatacatctgtctctgcttccctctccagcagaatctttacttttcaacagaatttctgagttctggctatatgaaactattaaatactctcatattcagtacttttaatttcatatgaaatctgcctgggtttgttctgttggcagactttcagactgtgcatctttttttttttccttcacgtaggccatccctcaggaaactgtgcatctttttaaagatttaactggtgtaattn

SEQ ID NO: 10874 - DNA, 344 bp, Homo sapiens
tacggctgcgagaagacgacagaagggtcattcctgtgattattcttatttttctccatctacatagtcacactctgatctctcaactcttctgcatcttatccctttcttgacctgctccaaccacaccagccccctgctgtcatagcgacaccatgcataatatcaaggtgaagtaatccactctcctacctttccagcttatcccctctgttattttaatccaatgtgtccttgaccccaccagcatctataatttacttatccatgaccttttctctgccccttactctcctcatgaccctccttccttccttatggactttagtttccagtttcattat

SEQ ID NO: 10875 - DNA, 313 bp, Homo sapiens
  misc_feature 257: n = A,T,C or G
tacggctgcgagaagacgacagaagggaacctagaattatgttcccagtgaaataacttttaaacataaaggcaaataattcattttcagataaacacgaagtgggtatttaccgacagaagacatagactataagtattgttaaaggcacttcattaggcataaaattatgataccttataaaaaacaaaatttatgaaagtaaatgaagaacacaaaaatggtataactggtggaaaaatgaaataattggattngatttttaaattgtatctaaagagaatgagtaatagaataaaaactgtactataga

SEQ ID NO: 10876 - DNA, 320 bp, Homo sapiens
tacggctgcgagaagacgacagaagggcccggagcaggagaagcaggtacaagcaaatgtgtgggcatggccttcatacccccaagcccagtcctgctcctagaaataaggagacaaagaccttcatgcctcagaccccctggcccatcccattgactccacagcctcagcttcagctactgagctctccacaaatgtggctcccactatgtgagactattttgcatgatacatagattattggatatctaaagacctattagaaaaataatactaagcgccgggcgcggtggctcacgcctgtaatcccagaactttgg

SEQ ID NO: 10877 - DNA, 385 bp, Homo sapiens
  misc_feature 292, 358, 385: n = A,T,C or G
tacggctgcgagaagacgacagaagggcatgtggtataacaaccattggtagtcttcataagacactaagctgaggcagtgaggtagaagtggtggtggctggggagggggatcgtgattctgctgcaggataattgccaaggacagagggagggctgtgttctcctgcctgaagatggaagtaaaggaacattttaactgggcaaaacccttcaatcctagcccagctgagcagggagttggttttcgaaagcagagctatacggacagcccctgtgccggatatgacctnctatattaaagaaaaagtgaaaaaacagaactgaaggagtagagatctttctacagtgcaaggcangctttaaagcagctttagaaataatcn

SEQ ID NO: 10878 - DNA, 388 bp, Homo sapiens
  misc_feature 308, 344: n = A,T,C or G
ttcggcacgagcagtatcgttcttagtgctttggaaaaaaatatttaacacactgttaataaatttgttatcagaagtttacaagacgaagggcttctctcgtctgaatttctagatttaagtcatgaagtgtaaaactgtttcacccagaagtgtaactaagcagaactaggagttttctctggcttcacctttttcagagccagcagtgctgttttctcaagcacagcgtttgctcttagactctgatctgcttgtgcctaagcattgcacaggtttccgaagacgggcagcttcagagaagaggnattattcggagaatgctggtgggcccatagactctntggcatagactctttcgcaggcgagcactctgagtgggccaagt

SEQ ID NO: 10879 - DNA, 405 bp, Homo sapiens
tacggctgcgagaagacgacagaagggaatgagaacatgatttttaaaaaaatattcactcattgttttattttggtcaaaatgctacaaatccttagaaaagtaaattctaaagtatagagtttatcttttttaactattaaaacctgatgaatattacaggatatgtcctaaaagtataacattgattaattagccttcagtgtaagcaacaggtcatctccgttccagataggacctcagtaaacctggatgaactagagaattgaagataaccttaaagctaatgctctttaggctgggcatggtggctcacacctcccaaagtgctgggattacaggcatgagccaccgtgcccagtctttttttttttttttaaaacggagccttgctcctttgccacg

SEQ ID NO: 10880 - DNA, 392 bp, Homo sapiens
cgttgctgtcggctgcaagtacttatgtgcatgattttgaatgaacttaagttttccaaagtgactgtacacttttgatttccactagctatggagagttctggttgttcctcatcttcgacagcatttggtgcgttcaccgttttgtgctgtacccattctgataggtttacagtgatatctcgttgttataatgcgcaattccctcacaacaaatgattttgagcatccttctcatatgcttatttgccatctgtatatcttattaatgaggtgttcagatctttcaccttttttttctttttatgcttcggggaggcgacgaacctaccaggcctgtacattactggccgacaacatctaaccatgattttgctttaaatttgccccca

SEQ ID NO: 10881 - DNA, 361 bp, Homo sapiens
  misc_feature 190: n = A,T,C or G
tacggctgcgagaaagacgacagaagggggattttttttcttcttttttagagagagagattagaaaacgacattaggaatttcactttaaaatgcgcattacaaacttcttaggtgttccaggaattatcaagtgactttaaaatgacttttccaacctgctttggttttaaaaaatatattccagttntaatcattgtacaaaaagcacctggagtttcaaaacatgtgaatactaccaagtttctgtccccaaagacaggcatcactgctaatcttttgggacagatgggacagacgtccactgtaatggtatacttgaagattcactggctctttgcatgtggaaaaagaggctgag

SEQ ID NO: 10882 - DNA, 389 bp, Homo sapiens
  misc_feature 347, 352: n = A,T,C or G
ctgaggaagttacacttaagctgagacaggtagaaattatctagttaacaaagggctgtcctaattactctagttggataaccgctcccaaaacttagtggcataaaacaattattttattatgctcatggattctgaaagtcagaagtttggaacagggctcatatggggacaatttttgtctcctccatgatgtctggggattcacctggaaaagactcaaaggtgacttgatagacttgatggctgtggagtagaatcctccagaacttcttccgtggtcttctcccagtctgactgggactattgactaatgcctatacatagctccatttggcctgggcttnctcanagcatgtctgcttcagcatagtcacacttcgcatatt

SEQ ID NO: 10883 - DNA, 366 bp, Homo sapiens
tacggctgcgagaagacgacagaagggcccggagcaggagaagcaggtacaagcaaatgtgtgggcatggccttcatacccccaagcccagtcctgctcctagaaataaggagacaaagaccttcatgcctcagaccccctggcccatcccattgactccacagcctcagcttcagctactgagctctccacaaatgtggctcccactatgtgagactattttgcatgatacatagattattggatatctaaagacctattagaaaaatataactagcggccgggcgcggtggctcacgcctgtaatcccagcactttgggaggccgaggcgggcggatcacgaggtcaggagatcgagaccatcc

SEQ ID NO: 10884 - DNA, 374 bp, Homo sapiens
tacggctgcgagaagacgacagaaggggttgagaagctgggaatggtggtggaacctaaaagacttccaactctgaggaaattgtggtagaaatggaagcagtataacctatgattgaacttaaccgatgtaggtgattgagattgtatttgcagagacaatgcttaaagaaataaaagaaacccagacataaaaactgaagctttaatggagatacataaatacataggaccttggaaaacaaatgaagtaatataactgcatataatttgtttacatatataaaacataggaaaatggaaatacagtgtattcttaagtgtacatttctctgtgtgaaatttattgtgtgcttttactttacataatctgtg

SEQ ID NO: 10885 - DNA, 372 bp, Homo sapiens
  misc_feature 372: n = A,T,C or G
tacggctgcgagaagacgacagaagggacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggatggagtgatgttttaatgagactgttcagctttgtggaaagtttgagctaaggtcattttttttttttctcactgaaagggtgtgaaggtctaaaagctttccttatgttaaattgttn

SEQ ID NO: 10886 - DNA, 365 bp, Homo sapiens
tacggctgcgagaagacgacagaagggagagagccactgggatagacgagagatgatcgtaagacgataggctgagtctcatccatgctaataagaagctatctgactgcaagcgaagaatgtcggactggatagactataatactcgactatattctgcctacaaagatgaactttgaatataaagacgtgcagtactctgaaggaaagaggggcataactatgtgcatgctagtcatatgagagctctagtgggcctggcacggaagctcacacctgtaatgccagcactttgggaggccgatgtgggcggatcacgaggtcaagagatcgagagcatcctggctaacatggtgaaaccccgt

SEQ ID NO: 10887 - DNA, 359 bp, Homo sapiens
tacggctgcgagaagacgacagaagggtgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggaag

SEQ ID NO: 10888 - DNA, 382 bp, Homo sapiens
tctacggctgcgacaagacgacagaagggggtatgagcactgatgaatagtagaggatactatggaacatctcacaggagattctactctggttcgatggtcatggttttgctgggggatgggcatggtccaagaacgtttctttgaggagggactctctgagctgagatcatagtgagtcaaccaaggagattgattattgcaggcaaccagaattacctatcgacaggaccctgctctgaacagtcgccgtgattcatactgtagggacatgacctattatgtgtatgaaaccaagttggtgagttgcgcccatcattcttaaaaatgaggcggcatggaatttttaacatctcgcatacatgccacggagccttacccg

SEQ ID NO: 10889 - DNA, 361 bp, Homo sapiens
  misc_feature 361: n = A,T,C or G
tacggctgcgagaagacgacagaagggtttgtatttcttaatgcaactgtatttttattcactttttatagtaacagctacatgactgcaaagctagcaaattttgaacattactacagggccatttcataacttctggcactttgaaatatttttacaaaattcaccatttcaaatattagactataacaatttttcaaattgcctatgtaatattttgaggagttcctatgtgccagatacttttctcagcgccttatatatatatatgtatccatttatttaatctagagcaaacaaatgaccattttaaatatgaataaaataaggcaaaagagtttcagcaagttgcccaagatcn

SEQ ID NO: 10890 - DNA, 408 bp, Homo sapiens
  misc_feature 365: n = A,T,C or G
tacggctgcgagaagacgacagaagggtgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattggttacaagagggtatgcaccgtggaagatcctggagacacanacatgaataaagccaagccagtccttgccccgtggagcttgaa

SEQ ID NO: 10891 - DNA, 392 bp, Homo sapiens
  misc_feature 392: n = A,T,C or G
tacggctgcgagaagacgacagaagggaagtggtgctgtcatatttggtttctgatacttagggtctggttttctgggctagggagaagacccactgccttctactgctaggactagtgctcagtggcagaaaggcagaacagtgaagtgctcatatgctgacatcaggctgcctggacttgaatctcagctctgccacttgctgaccgtgtggccttggggagaagacttgtcctctctgagccctggtttctagaactgtaaaatggtgacaatagtctctgccactcaaaattgaatggtaccaggattgagagagaaaatctgtaaatcactgcgttgtacattcaaggcagggagaggcaggcagggcaagggtacctatccatgtn

SEQ ID NO: 10892 - DNA, 359 bp, Homo sapiens
  misc_feature 359: n = A,T,C or G
tacggctgcgagaagacgacagaaggggtccttccttttcctctccccatagctgctttgaggcagggctaaagccaaggtgatctgcaccactgcctcttccaaaaagcccctccctcttttccttaaagacttttggccgggcgtgttggctcacacctgtaatcccagcactttgggaggccgagatgggtggatcacctgaggtcagaagttcaagaccagcctggaaaccctgtcactaccaaaaacacaaaaattagccaggcgtggtggcaggtgcctgtaatcccagctattcagtaggctgaggcaggagaatcacttgaacccgggaggcagaggttgcagtgagccan

SEQ ID NO: 10893 - DNA, 364 bp, Homo sapiens
tacggctgcgagaagacgacagaagggtgagtcatcggaagccaaacattaaaattctataacttaaattgaactgtcatatagtttttgccatttgaggcttcaagagtcaaattaagcctgctttaaacactttgaaagacagtgctctggggaagaaaatgctagctaaatctgagcatctcacgttatgcagaaattattgcccttatcttcattcataatgaaagtgttggtgaaagaaggaatgaagcacaaaaatgatcactggattggaaacaaaactcctctgttttagcccttactctgcttctaactggacaggtgaccttgggagaaaaatttaacttccatggggcttatt

SEQ ID NO: 10894 - DNA, 380 bp, Homo sapiens
cgttgctgtcgggacagattacatttttacacctgtgtttaactcttgactctcaggtgctggggagcaaaatctgagtcagacagcctgtagaattctctctaatgggatatttaaactggccagctcacaaaacggcacatcttttactttgatttttaattttattttattacaacttagatagatagatagatatagtcttttccctcttttaaacctgttctcttattgttctgccatccttctctttcctcaagcctgggcattgagaaagctgaaggacgtgacaatatattacactctccggacaacatcctagacttattttttttattaataaagctttgagatagagtatcactctgtctctcatgctg

SEQ ID NO: 10895 - DNA, 366 bp, Homo sapiens
tacggctgcgagaagacgacagaagggagggacttctggggacaggctggctgggccactgtcctgtaccacgtcagggtgctaattccagctgcattggctcaaatgcccaaggtgatctggctctgaaaggtataaggcccagaccttataggtgatcatgtggtgataattatataggcttacagaaatgaagaactgtggagtcttggcagcctccacaaatttcaaaggatttcttcaaaagcctggtagtctagagacttgtgataagggcagatctactgaagagagccctctatagagggataccaaacacaaatgtggaactggaactgctgcaaagagttcaccaggggccgggcc

SEQ ID NO: 10896 - DNA, 408 bp, Homo sapiens
  misc_feature 37: n = A,T,C or G
ggcacgaggagagagagaactagtctcgagagcaganattttttttttttttttttacttaaaaccagccttggggggaaactttttttaacttgttcaaaccacacctttaaagcggtgaaaaaactgctcggttcccgaaattagcgctgctacccctttatttggacccccctaatctgcccataggggttttttaaatcggggcgaattctttttatgggaatggttccggaagaggtgtgccacccaaaatagggaaaaaaggtttttaacaatttcctttgaccttattttcagggcccggggggagggaaattttttaaaaagtcccattttgcccaaagaaatggccacaaaacaccaaaagtttccttccttctgggaaaaaccaggggccctttgact

SEQ ID NO: 10897 - DNA, 361 bp, Homo sapiens
  misc_feature 267, 311, 315: n = A,T,C or G
tacggctgcgagaagacgacagaagggcagactcctaagtaataatgaccttactttagctgaaaaagcacatagcattaatgaactaaagacacaaaataataaatacaattgtattttcccagaatgtaaagatactgtcgacatatgtcatgcagagcatctaagcagggtcacactcagcagtggcaggtcctcatttctcagctgcgtccttagtagagggctggtaattgcacagagactgactcttccctgttctctgtnctccaggggcctgggtttctgctcaatctgcttctttcagtggntcanggtgaggaacaagatgtgaaggagagtgctgaaaagaagaagtgga

SEQ ID NO: 10898 - DNA, 390 bp, Homo sapiens
ggcacgaggagagaactagtctcgagacttgttctcttctagtctcgagagcagtttttttttttttttttttaacaataaacttgccgtgttttttaattaacctttcccttaaataaaaaaaggggcataaaaaaaaaacatgtttaaaaaccccttttttttacaactttggcccctttttacttttacattcagcctttcgaaaagagctttcaccattattattttttgaactataaaaggattttccttcatccctgccccagggagttaaccctgtgggactttaaacccttttccctttttttttttccttttttccttaacccaaaacttgggaaaaacacagggaaaaaaaacaaacttttttttctagaaaaaagtggc

SEQ ID NO: 10899 - DNA, 394 bp, Homo sapiens
cgttgctgtcgccccatcttgctagagatgatagatttagtacatatcagaaaatgtccaccagtatttttctttgtaagcactgtcagtgcagtgactctccttttcatttaactcatgaggatatttttgtgtgttttaaagaatctgaccagtcattatatttgtgctgagctctttgaagcagactagattttccttcaaaagaatatttatggccaggtgcggtggctcacgcctgtaatcccagcactttgggaggccaaggcaggtggatcacgaggtcaggagatcaagaccatcctggctaacctggtgaaaccccgtctctactataaatacaaaacaaaattagctgggcgtggtggcctgtagtcgcagctacttgggaggg

SEQ ID NO: 10900 - DNA, 348 bp, Homo sapiens
tacggctgcgagaagacgacagaagggtcattcatccaactgttatttagtgagcatgccaggcacaggcctgggttctggtgacacaaagatgaaaaagaaaagtagatgtagtacctattctcttggagttaatagtctgatcacagtcgggcacggtggctcttacctgtaataccaagcactttgggaggctaagtcaggtggatcaccagaggtcgggagtttgtgaccagcctggccaacatggtgaaatcctgtctctactaaaaatacaaaaattatccgggtgtggtggtgggcgcctgtaatcccagctactctggaggctgaggcaggagaacggct

SEQ ID NO: 10901 - DNA, 395 bp, Homo sapiens
  misc_feature 371: n = A,T,C or G
tacggctgcgagaagacgacagaaggggccccattgaggtgccagtctggtcaccttatctcactgtggatgtctagaagtgaattctgaatctcaacccactgccttgttctgaggttgcctgaaccccatggcacccctccagatccctgagcggatcaccaggcctgtcagtgacagacgtcatcacctgggaacagggcaggatgtggctgagtagctgacatgtaatgagggcgtgttcacacctggccctgtgctccatggactttatatttaaatcctcacatgccaactgtcattttataaatggagaggtgaggcttgggaaggttcagttatttcaccagtgttagaaaaaggtcagtggngttgggcgccgtggcttacacctg

SEQ ID NO: 10902 - DNA, 410 bp, Homo sapiens
  misc_feature 410: n = A,T,C or G
tacggctgcgagaagacgacagaaggggcggaaacagggatcagaaaggaaatcaaataacaggaattccatcctggacactggggcctgacaaagagctcttggaccagtgctggatgcaatttgggcggtttggtttgaatgggggaaatatgagtttccagaacagggtatttgaaatcatggctactcagaaaattgaggcagtggtcactctggctgtaaatgcggcactctgtgattgtcaagacctttgtaattgagggtgccttggctgggtccaggatatacttcatcataagccatatctggagccagcatgaattacaggggacaggaattcccattcattcgtcactttccacaatgggctagggatttcgtgtgacactcatttcatcttctcacgn

SEQ ID NO: 10903 - DNA, 371 bp, Homo sapiens
  misc_feature 18, 19, 21, 22, 24, 25, 26: n = A,T,C or G
tacggctgcgagaagacnncnnannnccagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagataatcactttaaatttgactgttaatatctgtattacataaaaagtcttcccaaatcaataaggaaaacattaaaacttcaaatagcaaaaagggcagacagttcacaaaaatttctcacagtaaatacgaatgactaataaatatggggagagggtgaattttggtgatttttagctttacagatagtaaaaaatgct

SEQ ID NO: 10904 - DNA, 373 bp, Homo sapiens
tacggctgcgagaagacgacagaagggccaggaccagactgttctaagcattcacatatataaactagtttctcaaacaacactgtgagatagatactactggatttcatagattataagatgtacattttaacatctctgagggctatgtcttatgatatggcaccatacagttataattgccagcagtttttcttagagtccataaaataagattgagaactagtgatgtcttaaatttgactttttttaaaaaagtgacatccaaatttataaatgaagaaacagaaatgcagggaggttaagtggcttgccccaggttgtgcagtcaggaatagcatagagttaaaatgcaggaggtctgcctttgtat

SEQ ID NO: 10905 - DNA, 373 bp, Homo sapiens
tacggctgcgagaagacgacagaaggggcggaaacagggatcagaaaggaaatcaaataacaggaattccatcctggacactggggcctgacaaagagctcttggaccagtgctggatgcaatttgggcggtttggtttgaatgggggaaatatgagtttccagaacagggtatttgaaatcatggctactcagaaaattgaggcagtggtcactctggctgtaaatgcggcactctgtgattgtcaagacctttgtaattgagggtgccttggctgggtccaggatatacttcatcataagccatatctggagccagcatgaattacaggggacaggaattcccattcatcggtcacttcccacatggggct

SEQ ID NO: 10906 - DNA, 357 bp, Homo sapiens
  misc_feature 357: n = A,T,C or G
tacggctgcgagaagacgacagaagggtttacatagtacaactgctttatcctttcaaaagcagatacgtcaatcaaaacttgacatttatttatctatatttatgctgagttcccttaaaatgttttgtctttttccatataaccaatcatattatttcctaaaaataaacttaggtattgtcacagggatagtaacttctgctttccatactgtgtgtgtgtgtattttgttttgtttcgttttttttgagatggagtctcactctgtcgctaggctggagtacagtggcgctatcttggctgggattacaggtgtgagccacggcgcccagcctggtttttttttaaatggggn

SEQ ID NO: 10907 - DNA, 385 bp, Homo sapiens
tacggctgcgagaagacgacagaagggcagactcctaagtaataatgaccttactttagctgaaaaagcacatagcattaatgaactaaagacacaaaataataaatacaattgtattttcccagaatgtaaagatactgtcgacatatgtcatgcagagcatctaagcagggtcacactcagcagtggcaggtcctcatttctcagctgcgtccttagtagagggctggtaattgcacagagactgactcttccctgttctctgtcctccagtggcctgggtttctgctcattctgctccttccagtggttcagggtgagtagcaagatgtgaagggagagtgctgagaaggaggagggtggaggaagttgagaaagacagcag

SEQ ID NO: 10908 - DNA, 380 bp, Homo sapiens
  misc_feature 380: n = A,T,C or G
tacggctgcgagaagacgacagaagggtctttagtttttatttgtttgtttcccataactttctagcaaccgtacttgcctccttcgaacttggcatagttcagtaatacaaattcctagcccagtttggaaggagattgttcttttgtcgctgttcaaggttatccacccgagctgatttcatgcttggctgcatctggaggctcacgtgtctgcttcttaaagtaacgctctcctctaccaggattctgaaaccacagagtagcacgcaggtcttcagcgtgacagacgcctgctcctgctcagatggcagtgcgggacctcaggaggacagtcgtgtgggctcctcactcaacatctcataacctgctcattctaan

SEQ ID NO: 10909 - DNA, 356 bp, Homo sapiens
  misc_feature 109: n = A,T,C or G
tacggctgcgagaagacgacagaagggtagtcccagctactagggaagctgagatgggaagatccattgagcctgggaggcggaggaggctgcagtaagctgagatggngcctttgcactccagcctgggcaacagaggaagactgtgtctcaaaaaaattttagaaagctatagataggactaccatgggacccaacaatcctactcctaacgatataccctgaaagatttgaaagtggactcggacaagaaacttgattctgaaaatataaaatttaagctttggacaaccattaccatagcccgaaggcggaacaacccaagggccatgacagaagaatggaaacaaaatgga

SEQ ID NO: 10910 - DNA, 353 bp, Homo sapiens
tacggctgcgagaagacgacagaagggcagagcatcctttgtaaactcagccttctctcaggaaagtctttcttattataactgatattccttgggctgaaactcacacctgttcctccacttctgatgtagagacaaagaggattcttgaccccaaaggacctcctagatcattgcttcaacctttccattttacagatgaaaaaactgaggactaagtaaaatgtggggagaaatgggaccaaaacccacttcccctacttgctaaatcagggcgtttctggtgctctaggagaaccttctttctcacatacaacaatccccgaggcggtctacaccaggcctttcacccg

SEQ ID NO: 10911 - DNA, 397 bp, Homo sapiens
ggcacgagagagagagagagaactagtctcgagagcagttttttttttttttttttggcatggattgaaacctttataaaaaaaatttccttttttttaaaaaataacaaacccggttttttgccgggaacccacccattttggccccgggattattcggggacccttcggaaaacctaaaatccccctttaatggtgggattggaaacctccccaaataaacctttaaagaaaaccatttaaaggttttaggggattttggccccttcccaccctttttatattttgggccccatgcccacccttttgtggcgattaaccccccaccaaagggcccaattggaaaaaatccatgaatgggtttttgggccttggggcagcccttacaaaaaaaaat

SEQ ID NO: 10912 - DNA, 392 bp, Homo sapiens
tacggctgcgagaagacgacagaaggggtgatttctgtcacatggtaaaggctgaccttttttaaggccaagagttggacttgcttatctctttaaacctctaccaactctgattcttataagtgcttgagagggatgccatcagccaagagccaatcataagggaacttggacaactcttcctaaatgggtcctaactgaagctaaaaagatgatgtcttatttttacacaccaagatcgtgctgcctaaattgtaggagattgtagtaccctgggggctaaactgtctgcagttcccagagaaaaagttaatctgcaaaaaatgcaaagcacaagctaaagaattaacttctttttgctatagaaaaaaaagttgtggcattgagattaa

SEQ ID NO: 10913 - DNA, 335 bp, Homo sapiens
  misc_feature 335: n = A,T,C or G
tacggctgcgagaagacgacagaagggaaatcatcttgcagcacaccgagaaaaaggttagatttgtaaaataatttcaaagtcatgaaaagagcaaatatgctccacaaagagcctagcaaccctcaatgacaaatgccccttttatatagtttggtatctgaattagaatcccagaatctacaaatttctctgcgtgtgggtgctgcattttgaggattttataacactgccatcaccaagctctcttttgatattcactttaaggaggtaatttacgggcaaccagagagcataaaccaaagtagatatctatctagatagctagatacatn

SEQ ID NO: 10914 - DNA, 388 bp, Homo sapiens
tacggctgcgagaagacgacagaagggttacgttagaataatgtattattttagcccttcatacagcatttctgtgaaaattcattctaagtaactttccactttttattgtacttccttggtttgcattattgcatttattcttgtctaaatgtatcttccacactaatttgcttatatttattatgtctcccttcactagaatgtaaactcaagagagcaggaccttgcatgtcttaatgacatatctaaaatagtatgtggcatgtagtaggtatgtaataaataattttggataaatatataataaaagtgcttaatataagtgtcatatgttccattaagaaacagagcgaaggccgggcacggtggctcatgcctgtaatcc

SEQ ID NO: 10915 - DNA, 378 bp, Homo sapiens
tacggctgcgagaagacgacagaagggcaagatcaagatttttttcctaaagagccatttgtcttattttagcttcaagccaagccagggcatctgagaaataccaagcctccgttgtgatgtgtcgccatgaaaatgttggctgccctctggatgcaagtctgcttgtgctgtgctgtggctcagagttaaatttagataaaaatcagttaggagctaaaaatattcccagctttcctgacaggttgtatccatcatcatgggaggaaaaacaaggaactggctgcctggcgacagggagcgggccaggctgagtgtgaggtcaggcctcggctggaatctcacggactttgaaggacagagacgttttctgagatg

SEQ ID NO: 10916 - DNA, 379 bp, Homo sapiens
ggcacgagcagtatcgttcttagtgctttggaaaaaaatatttaacacactgttaataaatttgttatcagaagtttacaagacgaagggcttctctcgtctgaatttctagatttaagtcatgaagtgtaaaactgtttcacccagaagtgtaactaagcagaactaggagttttctctggcttcacctttttcagagccagcagtgctgttttctcaagcacagcgtttgctcttagactctgatctgcttgtgcctaagcattgcacaggtttccgaagacgggcagcttcagagaagaggattattcgggagattgctggtgtggcccatagactctttggcatagactctttcgcaggcagccactctgagtgt

SEQ ID NO: 10917 - DNA, 366 bp, Homo sapiens
tacggctgcgagaagacgacagaaggggttgatttttggaattaaaatctacttatcattttccaaggtgctctaaaaggtagacaagaagtgaacatgtaatatgccagtgacgagggacagacagttagtgttttttgaccccaggcattgctgtgacgtcagccagagtgggttggcctgtctgcttaatctgtgcgggccgcaggagcccagggctgcagatcgtttgcttgtttttgcctcccctccccacccagatgactctgtgttcttaaaccaagctctaagttacagtaaagagttctgaaaatgtttagtgattcagaggttgacattgataagggtgtagatggttcactggga

SEQ ID NO: 10918 - DNA, 358 bp, Homo sapiens
tacggctgcgagaagacgacagaagggaatgtaccatttttggaacaggactgatacagccttggagagcagtttgggtttttgacaaaataaagaggcagtatgcaaaacctcaaattaaaaagggctaaataatagtcactattataaatcactttgtatttaaactacgactttatttcaagtggtggctcaactattacactaaatcattaacttgacttaaaattttaattaacatttagggaaggtaagtttcacacctgaggtgctttttaatgaagtctgttggcaaatctagcaaaatattcagaagtcaggatttaaaatgcagtaaatacctgtattaattacaaag

SEQ ID NO: 10919 - DNA, 385 bp, Homo sapiens
tacggctgcgagaagacgacagaagggataatattacattgtaaacaaatttaaaatatttatggatatttgtgaaaagctgcattatgttaaataatattacatgtaaagctatttaaaagaggttttttttgtattttgtttaacaaaaattgctcaggagcatgctaagcctgaggccaagttgtttcttagtatgactttttaaaaaaacatctgctgagtagctacagggccaaagacttggagagcttgtttctgttgcatttgcatatcttctcaggaaattaaagtgtgtcatacatatatgtgtgtgtgtgtgtgtgtgtgtgtgtgtgtgtgtatgtgtgtgtgtatatatatgtatacttataaaatcttggcg

SEQ ID NO: 10920 - DNA, 377 bp, Homo sapiens
  misc_feature 220: n = A,T,C or G
tacggctgcgagaagacgacagaagggattacgaaatgcttccagctgcgatttcagaggaatcccccctgaacccctggacgtggttctcctatttcagtcacacttctagctatgactctgcttagacaagatgaagttgatggatccattagaaagtttccactgaacttgtctggtccaatttctctttcctcaagggcatggacacagctttggntctccttcctgcacttagcttgctgctgctcccattcttcccattagggcatagaagattacctagcaggtgaaggcaccctacactctttggtttttaataggagaaacccttcagtcagagagtaatcttactttgagtctaggtagctataagt

SEQ ID NO: 10921 - DNA, 385 bp, Homo sapiens
  misc_feature 325, 352: n = A,T,C or G
tacggctgcgagaagacgacagaagggcaggggctggagttccacccacatccagtgatcacagagggcctgaaaggaggtcgggttttctctcagagcaatagggaggcatggagggtcttgagcaggggagagatgtaattggactccatttttagcagatgactctgagtgctgtgaggagaaagaactgttgggggagagcgtggtggcagggaggcccgtggggagtcaggagggagatgatggcctctgggactgtacgggtaggggctgatgaggggacacagggaaatggttgggcccaggcatggaggtgtgcggngggaccaccagcagtaccagctctcanggctgctgtgggcacagagcccggaatggagga

SEQ ID NO: 10922 - DNA, 383 bp, Homo sapiens
cgttgctgtcggaatggcatatatctaatggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgctattgggctatatgaagaggccagtaaaaaatggggcacaccaatacaagagttgcggaat

SEQ ID NO: 10923 - DNA, 379 bp, Homo sapiens
tcgattcgaattcggcacgagcagattcgcacaaacccggaagcgggtcgcgtggagtgacggtcccaccgcggggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagagaaaaggaatgtcacgaagcacccatgacaaaatcaaagagtgactgtagtacagaccgacatgatcaaggcatgctgaacaagctattaagatcagctgatcagcttcatcgaactgctgactcacatattag

SEQ ID NO: 10924 - DNA, 374 bp, Homo sapiens
tacggctgcgagatgacgacagaagggacccaccatgaggtcttatcttaatggagaaaacacattgctttgttagtcctccagacagaaacttcattgtttggggaatgatttcagtagaggatgaaaggatgaataagcaaaatacaccgattttttttgtcaactgccacccctcccaccccgatgttcccaccaatcattagaataagaaacatgagtctttgtcctctgccaaatctaagccatgccaacaagtaaacctgtataggaaaatgacacaattagggaaatttgcacgtgctattatgccagcagtagttttttccatgaagtaatctgatgattcatacactggagatcaggagacacaa

SEQ ID NO: 10925 - DNA, 378 bp, Homo sapiens
ggcacgaggagagagagagagagagagagagagagagagagagagagagagagagagagagagagagagagagagagagagagagagagagagagagagagagagagagagagagagagagagagagagagagagagagagagagagagagagagagagagagagagagagagagagacgcccccccctctcttttttgtgtgcgcccccgcgcgcgcgcaaaaaaaaaaagtgtgtctctctctctctcccacacactctctctctgtctctcacataaaaaaaaaagtgtgtgcacgctctctctctctctttttttttcacacagagagtatcctctctccccccctctctctctcacactgagtgagagcgctc

SEQ ID NO: 10926 - DNA, 385 bp, Homo sapiens
tacggctgcgagaagacgacagaaggggtccttccattttctaactgaaaagacttccttgagtcctcaggtttgggagttcccctcctagagggagtctctctggctcccaggctcaggcataacttcattctttccactcgtttccacgcatctcctaattgggctaccagcacccctccttgatgcaggcagggagaagtggacagggcagaaagggctgggtaaattcatgagcagtaaatgactccatcaacagtggccatcaagggaaacaggccatgttccagccatggaagctgggaagggacactaatcctctccagagatcagtatccctcagccacttaggcttgtggcagaggcactgtggccctgtccccag

SEQ ID NO: 10927 - DNA, 349 bp, Homo sapiens
  misc_feature 3, 4: n = A,T,C or G
tanncctgcgagaagacgacagaaggggacaatctatctttgaagacaaagataaattcgagtccccattttcaagaggcagcgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccactttctagctgtgcatcttggacaactgagtgaaacatgcgcctcatttttctcgggaaatgaaacgataccctgacccattgtgcaatggagatataacggcattgatgcaggtaa

SEQ ID NO: 10928 - DNA, 393 bp, Homo sapiens
  misc_feature 385: n = A,T,C or G
gcctacggctgcgagaagacgacagaagggagtgaagtagatctccacatgctttcagggtttttgttgcccctggtactggagcagagaactattatcaggagtaaattttatgacttcaatctaggttgtgaatttgggtcagccattttaccatttaaagtctccacttcttgttcttaaacaaaacaaaacaaaacaaaaaaacagaataagtcaaagaggagatgagaggtagaggaacttgaaagtgctcacttttaaagctagcttctggacttttcttatttcatcacttgatggttttgtctactttccatgaattctaaattttatggtgggtttggaagaaacatgtcttctatatatgggcagatccaggttntgtggagc

SEQ ID NO: 10929 - DNA, 365 bp, Homo sapiens
tacggctgcgagaagacgacagaagggagagcagagtggtgtccccagatgacttcagaccccatagctgggcaagatgcgcttgttttggactctgcgctgagcagaaccagctcccccaactccagcagagcttgacctccgccctgtgccctttccctgctgctggctctctgctgcatccctgcccgtcttctgggagtgccgtctcacccaggcctgctcccacgagggggtcgttttgtagatcaactctcagcagatagttgcatcatctttgtcacctccacccccataaaacaccccccttggtgtcttccacactggctgggactgaactgggtctgccacgtctgccctgttgg

SEQ ID NO: 10930 - DNA, 363 bp, Homo sapiens
tacggctgcgaaaagacgacagaaaggccggcctctttttttcttttctttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaatatttttttttttttttttttgtaaaaaacggggttcccccttgtgaaaaaaatgtgtcttaaactccgggcctaagggaatcggccccctcaccttctaaaagctcgggaattttattgggtgaacccacgtgcccggcccaaaaagggtttttttaa

SEQ ID NO: 10931 - DNA, 398 bp, Homo sapiens
ggcacgagcagattcgcacaaacccggaagcgggtcgcgtggagtgacggtcccaccgcggggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaa

SEQ ID NO: 10932 - DNA, 402 bp, Homo sapiens
gattcgaattcggcacgagcaccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccacctcagtgaaggcacaaccaacagctgctccccgggcatttccaagaccctccaggcccccagttctgaggactagggtggaggcagtgtttctccccagcatcaagtgaccagagaagtgaagtgaccccactgccgccac

SEQ ID NO: 10933 - DNA, 356 bp, Homo sapiens
tacggctgcgagaagacgacagaagggataatattacattgtaaacaaatttaaaatatttatggatatttgtgaaaagctgcattatgttaaataatattacatgtaaagctatttaaaagaggttttttttgtattttgtttaacaaaaattgctcaggagcatgctaagcctgaggccaagttgtttcttagtatgactttttaaaaaaacatctgctgagtagctacagggccaaagacttggagagcttggttcttgtgcatttgcatatcttctcaggaaattaaagtgcgcatacataatattgtgtgtgagatgaaacagcgtgtggagaatatccgagggatataaa

SEQ ID NO: 10934 - DNA, 353 bp, Homo sapiens
tacggctgcgagaagacgacagaagggcttccacttggaattaaagaggaaaaaattgattatttgagaaatattgcataggtttctaaacttcaacccgtgcctaccctgcaacctcagcaatctagttttacctccctaaactaatctagttttacctccctaaattatacatttaatttcattcccttgctccagaacattctctttctcttatttcctataggatataagtctatacatggtagatttgctcttatgcattagggattttatttgaaagccttaagaaaaaaatgaaaaatactcaaattatttttgaaaatcctttagaaagaaggcatgttaaagac

SEQ ID NO: 10935 - DNA, 367 bp, Homo sapiens
  misc_feature 20, 21: n = A,T,C or G
tacggctgcgagaagacgannaaagggggctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaagggagaagg

SEQ ID NO: 10936 - DNA, 386 bp, Homo sapiens
  misc_feature 36, 37, 38: n = A,T,C or G
ggcacgaggagagagagaactagtctcgagagcagnnntttttttttttttttttttttttctttgcccccccccttttttgggggcttttttccccacccctttaggggaaaaaaaggaggggggggggaaaccctttcccttggttttcccggccctaaaacccgaaaacccaaaactccttttttcccttggggcccctaattaaaaccggggccggggctttcttttgggcccccagggccaaagaaagggggccccccgggtcccagggccccggccgggggcctcccagaaaaacccaaattttagggcgggcctaaaaaccccaggccccaggggccggggttctcttaacccccagaaagcagggccccccccggggg

SEQ ID NO: 10937 - DNA, 357 bp, Homo sapiens
  misc_feature 357: n = A,T,C or G
tacggctgcgagaagacgacagaagggaacctagaattatgttcccagtgaaataacttttaaacataaaggcaaataattcattttcagataaacacgaagtgggtatttaccgacagaagacatagactataagtattgttaaaggcacttcattaggcataaaattatgataccttataaaaaacaaaatttatgaaagtaaatgaagaacacaaaaatgttataactgtgggaaaatgtaaataattgtattggatttttaaattgtatctaaagagaattgagtaaatagaataaaaaactgatactaatagacaatatctaaaacaaaattggcaggagagtgaccgcagn

SEQ ID NO: 10938 - DNA, 350 bp, Homo sapiens
tacggctgcgagaagacgacagaagggaacctagaattatgttcccagtgaaataacttttaaacataaaggcaaataattcattttcagataaacacgaagtgggtatttaccgacagaagacatagactataagtattgttaaaggcacttcattaggcataaaattatgataccttataaaaaacaaaatttatgaaagtaaatgaagaacacaaaaatgttataactgtgggaaaatgtaaataattgtattggatttttaaattgtatctaaagagaattgagtaaatagaataaaaaactgatactaatagacaatatctaaaacaaaattggcaggagagtga

SEQ ID NO: 10939 - DNA, 385 bp, Homo sapiens
  misc_feature 342, 363: n = A,T,C or G
tacggctgcgagaagacgacagaaggagcgagacttggaagcgctggtcaaaaggtttaaaacagacctccacaactgcgtagcctatattcaggaaccgcggctgctgaaggagaaggttcgaggtctctttgagaagtacgtgcagcgagcagacatggtggagatcgcagggctgaacacagacctgcagcaggagtacacccggcagcgggagcacctggagaggaacctggccactctcaagaagaaggtgggcaaggagggcgagctgcaccgcacagactacgtccgcatcatgcaggaaaatgtctctctgatcaaggaaattaatgagctccngagggagctgaagttcactcngtccccagctatgagcttgagc

SEQ ID NO: 10940 - DNA, 402 bp, Homo sapiens
  misc_feature 402: n = A,T,C or G
gaattcggcacgagctcagagtggaccctggcccgctgtgaccacgccttttgctggggcctgcgtggaggagttggtcaccgtggcccactatgacagccccgaggccctgagccacctctgctgccgcctggtcagtaggggaagcaaggttcagcgatacccaggccacgtgcccaacttcctgagccagacccagggctacctgcggagtccacaggaccccctgcgccgggcagccaccgtgcttataggcttccttgtccaccacgccagccccggctgtgtcaaccaggacctgctggactccctgttccaggacctagggcggctgcagagcgaccccaaagccggctggggccgcgcagcgcacgtgtccgctcagcagggctgaatgaggan

SEQ ID NO: 10941 - DNA, 367 bp, Homo sapiens
tacggctgcgagaagacgacagaagggcaagaaggattgtcggagaatagtgcctgtctctggaccgatgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaattaacgatacagacagtcttacagaaggaagaggagaggagtcagccaactaaaaccccttcat

SEQ ID NO: 10942 - DNA, 358 bp, Homo sapiens
tacggctgcgagaagacgacagaagggcagaacttggctcctctcacccaccccgcccagtttccactctaaaggacggagctaaaataaacagttatttaaaggttggggcatacagggttccaaagcagatttttagttctatcctcagaagacttgccccatatagaaaatattgtctggagacttctcaatcttatcttaagaaataagaatcaatcctaccccatgtgacagcagttaatcttatagtttaaagtcagataatcatgcaacttcatggtacatttgtttggagctattagaagcatggagctcaattaagaataacggatttttttaaagactaacgagaggg

SEQ ID NO: 10943 - DNA, 379 bp, Homo sapiens
  misc_feature 379: n = A,T,C or G
tacggctgcgagaagacgacagaagggcacctttgttctgtcagtgtgcctgtgtgcgtgcaccttcctctgccactgccgcagtggggttgcactctgctctttcttcccctgccagaccaccattgcagtcagagtgttggtggacccatggaaaatcagccccactcccactagcaccacatccttgcaccaacactgccacagaagtgaaactaggcacagagaacagcagaccctcccctaccctgagaaaccaccccttcatgcagttcacagagaatgcatacagacctgtacccaccagcaccctgcccatatgcatccccaagacagcacaatcatgtgtaataatcaccagcaggggtccccaacctcn

SEQ ID NO: 10944 - DNA, 370 bp, Homo sapiens
  misc_feature 349: n = A,T,C or G
tacggctgcgagaagacgacagaagggtctggggaataaaaagcactaatggacaggagatgggttttgcaaaccatgaaaggccatgtgcagctgagctggtattatcactggagcctggcacttcgccttcatctgtggtttcctctgtgtcagtgaaaccacagccactagacggggagcaactcaaggtggggcccggggtgaggagctggagcctgagcccccagtggagaagtgagtgggggtctccagctaggaaggaaagggtgggaggtggagagcagccccagggggcagtcactaagccccatgcagggcagaatgccaggaacacaggctccacggngcccagacaccatccctcgcc

SEQ ID NO: 10945 - DNA, 352 bp, Homo sapiens
  misc_feature 6, 8: n = A,T,C or G
taaggntncgagaagacgacagaagggctgtcacagaaaaagaacaaaaaaccgcgccacggagaagtggggcctgggtcccccacggacgaaagtgccttcccatcagcccctgcactgggccccatggaccctggccaccctggttcgagccccaggtgcgcctcgggcccgctaggggtaccccaaggcagacagaaggcccatgagggaaaggtgagacacctggggcagagaaaaaaatgaaaaactgcgcagcccagaagtggggcctgggtcccccacggacgaaagtaccttcccatcagcccctgcactgggcctcatggaccctggccaccctggttcgagc

SEQ ID NO: 10946 - DNA, 393 bp, Homo sapiens
  misc_feature 37, 38, 39, 53, 54, 55, 56, 57, 58, 59: n = A,T,C or G
ggcacgaggagagagagaactagtctcgagagcagtnnntttttttttttttnnnnnnnttgggggggcaaacccttttttggccccacccctccttctttgggggaaaagggcttttggccgtaaaaaatttcccccccggggtgaaccccttggggaattgggcccaacacgtaaattgggggtcccttgttaacccctgttttttgggccggaaattttttaaaagggcccttaggggcaagggccttccgggaaaggaaggggccccgggattcttaattcccctgcccgcccccgttgtggggggttgcctcccctaaggggggcgggggggccaattcccaaaaaaggttttggggccccgtgcccaccccaacccgtttggttggg

SEQ ID NO: 10947 - DNA, 351 bp, Homo sapiens
tacggctccgagaagacgacagaagggggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagactta

SEQ ID NO: 10948 - DNA, 393 bp, Homo sapiens
  misc_feature 393: n = A,T,C or G
cggcacgaggtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgatcaccccacaagaagccagcccccagaagcgn

SEQ ID NO: 10949 - DNA, 379 bp, Homo sapiens
  misc_feature 379: n = A,T,C or G
tacggctgcgagaagacgacagaagggaagctagataataattttgaggtcaattttgataaagatccaatggaaatgcgcctccctattcgtagccctattaaacgagactttttatcaggaattcagattgaatttaagcagtcttctcaccagagaagtttaagggccaggttgtactggcttcaggttgataatcagttaccaggtgcaatgttccctgttgtatttcatcctgttgcccctccaaaatctattgctttagattcagagcccaagcctttcattgatgtgagtgtcatcacaagatttaatgagtacagtaaagtcttacagttcaagtattttatggtcctcattcaggaaatggccttaaaan

SEQ ID NO: 10950 - DNA, 385 bp, Homo sapiens
ggcacgaggcacatctcatattagaatgggtaacggaatttgggctgcacccgcgtcctgtcctcgatctcgtagatccgcagctgcatgggcacgttaaagctgtgcaggatgtttccgccgaacaccaaagagtctacaggggtgtagacggcatggatccaaccagctaacgtcacagagtcagcagcaaggccaagagccttccagtcatcctttgaatccagggccaatccagcaacaccggaagggatgaaaaatgtgtagccctgcttcagctcaattctttggcatcgttccacacggtctcccagaaagatgtcactctgttttgctggacagcaccacttcttgtccggcgccaaattgtgcagcggtggaggat

SEQ ID NO: 10951 - DNA, 397 bp, Homo sapiens
ggcacgaggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaagccctgtacctttgatgtaagtggtggagttgggggatttgcctcatgcttgcggatacccagtggattgatcaatgcagaattcagttcttccatgtttgaaa

SEQ ID NO: 10952 - DNA, 368 bp, Homo sapiens
tacggctgcgagaagactacagaaggggatgaaagtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcacaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatg

SEQ ID NO: 10953 - DNA, 624 bp, Homo sapiens
  misc_feature 551, 552, 554, 572, 574: n = A,T,C or G
tacggctgcgagaagacgacagaagggaataaggctgggtgcggtggctcacgcctgtaatcccagcactttgggaggccgagatgggtggatcatgaggtcaggagatcgagaccatcctggctaacacggtgaaaccccgtctctactaaaaaacacaaaaaattagccaggcgtggtggcaggcgcctgtactcccagctactcgggaggctgaggcaggagaatggcatgaacctaggaggcggagcttgcagtgagccgagatcacgccactgcactccagcctgggcgacagagcgagactctgtttcaaaaaaaaaaaaaaaaaaaaaaaaaaaagggggccttttttccctgaaccccccccgtgaaaaaaaccttggggggtgggggcaacccccccctcagacggggggaaaaaaaggtttttttttgagaatttgggggcgctttgtttttttttgcccctttaaagggggaaaaaaaagtaaacccccaaatgggttttttttttttttttaggtgcgggggggggggggggggggttnncncaacccccccccacaaantntgttccctccaaccaccttcttatataacacccccacccccaccccgccc

SEQ ID NO: 10954 - DNA, 471 bp, Homo sapiens
  misc_feature 446, 457: n = A,T,C or G
tttggccgaagcggcctacggctgcgagaagacgacagaagggctggcttatttctaatttttggccagtctgaataaggctgctataaacattcttgtacaggattttgtgaattatgtttatatttctcttggattaatacttaggagaattgctactaggataggtgtctgtttaactttcaagaaactgtgcaacagctttacactgtgaaatagtgattgtcctgactacaaacctccatggtgctgagaccaggttttgttcaacgtgattttcctggtgtccagcccagggcagggcacatgctagacattcagtgtttattgaagaaatgaatgaatagaagttcaaatcagttttcattctgacatctctactactaactgagaaaaaatgaatgctctgtccattcaggagatggaaatttattgggctaatgtgngctgattatangcaggcaaaaacaa

SEQ ID NO: 10955 - DNA, 472 bp, Homo sapiens
  misc_feature 298, 346, 392, 408, 419, 420, 427, 428, 472: n = A,T,C or G
tttggccgaagcggcctacggctgcgagaagacgacagaagggaacattctgatttttaggtacattcttatcagttttaatgctcctgaagggccatttttcctggaggctggaggacctgaaatttttccttccatcacaaactttactgagctcatccaacaggaaagaccaatcaacagctggcatgagatggagggcagccttcttgaaaagctccaaagataattagtcaaccgttagtgtttttctgcaattatcaaactttcatggtccctgattctagatggtacattntaaaggtagattcctgtaaagattagcttaactgaaaaggaagataanaatgatcatactctaaacccattagtctttcagtctctcactttanacatcagtctcttggnttctttgcagnnggtactnntgttctaagtttttatgtttaaccctggctgggaatttaaattn

SEQ ID NO: 10956 - DNA, 602 bp, Homo sapiens
  misc_feature 201, 443, 444, 445, 446, 447, 449, 450, 452, 456, 457, 464,545: n = A,T,C or G
tacggctgcgagaagacgacagaagggaccccatctctacaaaaaatacaaaattagccagatgtggtggtgcaggtgcttggaggctgcttgggaggctgaggtgggaggatgacctgggcctgagaggtggagtttgcagtgagtcgagattgcaccactgcactccagcctgggtgacagagtgaggccctgtcgcanaaaaaaaaaaaaaaaaaaaaaaaccggggggggggcctttttttcggaaaccccaacttgtaaaaaacctttggggggttgggcccaccccccctttaaagggggggaaaaaagggttttttttggaaaattgggggggttttttttttttttgaacccttttaaggcgggaaaaaaaaagtaaaccccccactttggtttttttttttttttcgggtccgggggggggggggggggttttnnnnncnncnccannaataatntatttcctaacactttttttttataataactcttttcacccccctcccttttttttatggggccccgtgttgtgttttgcnaaaccacgaggggaaacaccccccggcgcggtgtgggtttgtggtaatgtccccccc

SEQ ID NO: 10957 - DNA, 451 bp, Homo sapiens
  misc_feature 415: n = A,T,C or G
tacggctgcgagaagacgacagaaggggggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatntgggaatggagaccaacaggagaacctagatactct

SEQ ID NO: 10958 - DNA, 432 bp, Homo sapiens
  misc_feature 432: n = A,T,C or G
tacggctgcgagaagacgacagaagggaattaagtcttctttgaccataaggagtcaatgattatcaaaaactgatagaaaaaaaaaaggaatcattatagaagcattgtatttggaaatatagtaaaaagtacgagaaaaaaatagcaaaaagagttaaaacactgtatatgaaaccaaactaggggtgaaggttgctacgtgagaggaaagaaacagaaggggaatattcttttctttataagccttacagtatttaaaaattaaggccaggcgtggtggctcacacctgtaatcccagcactttgagaggccgaggcgggtggatcacctgaagtcaggagttcgagaccagcctgccaacatggtgaaaccccatcttactaaaaacacaaaataatctgacatggtgcacacacttaattccagtan

SEQ ID NO: 10959 - DNA, 430 bp, Homo sapiens
gtcttttggccgaagcggcctacggctgcgagaagacgacagaagggcatgagccacggtgcctggttctcactgcccccgcccccctttttgttaacttcccattgtctgcaagaaaaaataagtttgatcattcagggttcctgatacatctgtctctgcttccctctccagcagaatctttacttttcaacagaatttctgagttctggctatatgaaactattaaatactctcatattcagtacttttaatttcatatgaaatctgcctgggtttgttctgttggcagactttcagactgtgcatctttttttttttccttcacgtaggccatccctcaggagactgcgcatctttttaaagatttaacggggggaattcctcagggagttttccttacctcagggcacatgtattcaaacacctg

SEQ ID NO: 10960 - DNA, 428 bp, Homo sapiens
  misc_feature 336, 428: n = A,T,C or G
atcgattcgaattcggcacgagacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttgnggcctaaacaactaaaattagtcaccgcataactagttgaaaatggcataggcataaaatgttaataaagaatggcagtatatttatgctcn

SEQ ID NO: 10961 - DNA, 445 bp, Homo sapiens
  misc_feature 445: n = A,T,C or G
tacggctgcgagaagacgacagaaggggcaatttacaaagtaataagtgaaatgctccccatagttgactataacatttcctcatttttctctgaatttgctttttaaaaaactcttccccttgccattcccttccccattccagattgtaactgcttctttccagctgcatcagaagaaggggactttccatgtaggtgttattctcagaaaaggccagaaaagaccaggtcatggtggggatgatttgctccaagcataaaagagaattgtgatggttcaggaagactggaaaataacgagactggaaagaaatgagaagggcttcagaggaatggcacattgaaataaaaggaagtggaagaacaggaaaacaagtggaatgaaaggagcacacagtgggcagggatgaatggatagactgtggaataaagataaattggan

SEQ ID NO: 10962 - DNA, 436 bp, Homo sapiens
  misc_feature 371, 373, 403, 415, 416, 436: n = A,T,C or G
tacggctgcgagaagacgacagaaggggttttgtcttcaggtaacactacatttctttcagtcttctgagacatttcatggtttcacttatccaggtgttgctaatcttacatagcagtttatatgccttgtctattcttcttaactaagataacctgttgaagtattattaaattcaactatattataaaattattaaactgtaggcgggatgtgttttcttcctttctcacgtagcttcccttccactctggaaatggaaggtttgacatcccatcatttgataggtctgatgactttccagtattttaagcagtaatattgagactatggcttcttggtccttctatccttaagttttgcataatgantngcataatatactagctaactttattcattntactctttgcanngacatgctagatgtgaaccn

SEQ ID NO: 10963 - DNA, 426 bp, Homo sapiens
  misc_feature 426: n = A,T,C or G
tacggctgcgagaagacgacagaagggtatctgctgtaatatttttatctgaggtagggataaaaacatcccatttctggactttacttggagaaccagctagaggtgaatatacgacccttcatgacctggactgaaaacattttcaagttctctatttcggtcaatacagcccctttaataattccccaaagcatctcccctttccacctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgaggtcaggagttcaagaccagcctggccaacatggtgaaaacccgtctctactan

SEQ ID NO: 10964 - DNA, 447 bp, Homo sapiens
  misc_feature 347, 422: n = A,T,C or G
tacggctgcgagaagacgacagaagggccagaccatggctgcctagacggctgtgaactcctgagaagcctttccagcatcaccttctcctcttccaagaagccttcttttccgtgccacacaaaagagactatggtggtcgggcgtggtgtctcatgcctgtaatcccagcactgtgggaggccaaggcaggcagatcacctgaggtcaggagttcgagaccagcctggccaatatggtgaaaccctatctctactaaaaatacacagaattaaccaggcttggtggcccgtgcctgtaatcccagctactcaggattctgaggcaggagaattgcttgaacccangaggcagaggttgcagtgagccaagatggcaccactgcacttcagcccgggcgacagaatgagactctatctcanaaatacatacatacatacatacatc

SEQ ID NO: 10965 - DNA, 444 bp, Homo sapiens
tacggctgcgagaagacgacagaagggcatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatctcaaaaaaaaagtgagtgcccgatgatgccagattcttcatcacctgaagtgaacccacacaacaggggctgggccatgggcatcataaaccccattttgcaagctcaggaggagctttaaggaaatcagaagaactgcccagtctctaccaagtggtgatttagaagccgcatggcttcgtccaaatctacactctgcccacattccatggaacctccattcctgaggg

SEQ ID NO: 10966 - DNA, 447 bp, Homo sapiens
tacggctgcgagaagacgacagaagggacagtaccaggcaaaaaccatttgtaaaaattaccaaagtcaaaatacagaaaccgttagactattatgccaataaatatcagggaacctgccccgatagtcaggtaggttcttttctattttccctaagtgtcagctggtttgagaaataaagggtgaaagtacaaaagagagaaattttaaagctgggcatccaggggagacatcacaggtcagtaggttccatgatgcccccccaagccgcaagaccagcaagtttttattaggggctttcaaaagaggagggagtgtacgaataggctgggggtcataaagatcacgtacttcacaaggtaatagaatatcacaaggcaaatggaggcagggcaagatcacaggaccacaggacccagggcaaattaaaaatgcgtaatgaggttt

SEQ ID NO: 10967 - DNA, 430 bp, Homo sapiens
  misc_feature 317, 375, 403: n = A,T,C or G
tacggctgcgagaagacgacagaagggacagatggggtgaacttctataacatcttaactaaaagcactcccacgtctacaatggagtcgagtctagaattcacacagagccacctagtttgtctttgtcagcgccacgtgagacgcctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcggngatcaacgtgacggtgtataatggacagctggatctcatcgtagataccatgggtcangagggctgggtgccggaactgaagtggncagaactggcctaaatcagtcagctga

SEQ ID NO: 10968 - DNA, 387 bp, Homo sapiens
  misc_feature 207, 387: n = A,T,C or G
tacggctgcgagaagacgacagaaggggtgtggatctcggtgtgtgtgtaactgtgtgagtctggtgtgtgtctgtatgtaggtgtgtgagtctgagtgtgtatgtgtggtgtgcccgtgtgtatgtgttaactgtgtgaatttctggctagcgaatgtgtatctgtgtgtggggtgtgtgtatatgtggtgtccttgtatgtgtangtgtgtggtgtgtgtgtgtgtgtgtgtgtgtgtgtgaaagagagtgagtgagagaatgggaatggcacccacttctgtgagcccaagtatccttgtttcgttccttgagtgcggccaccttgtctctttgggtggagtttctggggtgctggtttagctccaattgggtggctttgggcn

SEQ ID NO: 10969 - DNA, 384 bp, Homo sapiens
tacggctgcgagaagacgacagaagggcttattaaaataaatttacttttttggtgtagatagggaaaagtattaaaaaagtatgataaacttcaaacctctctctctgtttctcccccttttccccacccccaattatttttttaccctctaaagggaagtttttcaacttgagaaattttgtgatacattatttgaataatttcttcactcaaatacctttgaaatacttatcatttctttcatttgacaataatcatttcttgctttaaaaacaaaaataaatggctaagattaaattgtgaagatctcttagaaacagaatttctctgtatgaaacagaattacatattcagcatataataaagaaatataaaacaaaag

SEQ ID NO: 10970 - DNA, 381 bp, Homo sapiens
  misc_feature 366: n = A,T,C or G
tacggctgcgagaagacgacagaaggggagggaggttgaaatttggtgtgcgttaaaggaaatataaaaatcctgcttaatgatcctgttaggtttgtatacagattaactgttattacacaagaaatggtatgtccgtttggaatttctcatcctctgaatagtcagctttagcactataaactgggaagaattctgttgtatctctgaatatataatattgcattactgcgagccccgcggcccttttcccaaacaacatatgcctgcatgtgcctcagttttatgtgagtcaaaccaatcttaggcctagcatatgggagtttattagtatgtgtatgttcctatgttgtttaagagagattntagggtctggagaac

SEQ ID NO: 10971 - DNA, 384 bp, Homo sapiens
tacggctgcgagaagacgacagaagggggaatttaggtagaatcaaggctcataacctttatgaaaataccctaagcagggaaccttcaatttattttgaagtgtttgagttttactaaaagcccatcattgccagtgtggttttttaaaatggacagccatagtggctaaggagaccagtaagacctggagttggcagcagagtgagccttctgaggaaaaaaggaagaggaatattggtgtgggaaagaggtgcagctgtgccactggatccctgtcccttcattattctttactggccctggcagctgtcaaagtttgcttaatatagctgtgggctggagattgtttcttaatccctgtataggagtaccaagctccagc

SEQ ID NO: 10972 - DNA, 380 bp, Homo sapiens
tacggctgcgagaagacgacagaaggggtaaatacatttttcttttttatgtaattaattaaatcagggatatagatttgatctgtaatttgggtataattctaatctttgctgaaatcacatctcaagtataatgaggcaactttatgcaaatgtacttgttgtgacaacaataacattttccttttttttttttttttaaaaaaagtttttttttgccccccaggggggggggcgggggggaaatttggttaaattaaacccttgccctccgggttaaaagaaattaaacgccctaactttctggagggggggtttaaccccccctcccccactaatttttgtttttttaagaaaacccgggtctccccttatgggcg

SEQ ID NO: 10973 - DNA, 395 bp, Homo sapiens
tacggctgcgagaagacgacagaagggcattatatgcccacgtataaagtctcttgttttaagtctgatggtactatgttaaatcatgacaatttgacgtgtttgggaatgggcggcctcggatagctggcccttttagcataaatctttctgcatttgtatgtttatgtcacacattttgtgtaacagtcattctacagtgtggtaggtacatgctgccctaactcatttttttaaattgtgataaaattcacataacacagaattaaccatattaaagtgtacaattaagtggcattcaatatgttcatgatgttgcacaatcatcacctgtatctagttccaaaacatattcatcacccccaaaggaaaccctctatccattagccagacat

SEQ ID NO: 10974 - DNA, 384 bp, Homo sapiens
tacggctgcgagaagacgacagaagggtatattaatctaatctatcttagaacaagttaaatagtatatgtacttgtaataacttgtgcctagatatgttagttttgtctattaatttttctgttaaaaagaatatgcattgaaatgagatggaaaacaaaatgaaaagtgtttaaaaaattaaatattttagaaggatcaatatcctaagggttgtgggtaattttttcctactttctaaaacttcagattcctttcactcacttaaggttgtactaccattaatgcaatgttttctgggagtgcaagatttgcaaatgaattaataacagctagaagcctcactatttgcacttttataacattctttgctgttatcattac

SEQ ID NO: 10975 - DNA, 412 bp, Homo sapiens
  misc_feature 412: n = A,T,C or G
tacggctgcgagaagacgacagaagggcatctggccttgtaggtgccgggaacgggcaagacatgttttgaaatgtaagatcacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctacggggatgagtctattggactcaaagggtacattttggttttccatttaatttaataatcaacacaacgacaan

SEQ ID NO: 10976 - DNA, 395 bp, Homo sapiens
  misc_feature 252, 255, 258, 259, 260, 262, 268, 270, 271, 272, 280, 292,298, 299, 329: n = A,T,C or G
tacggctgcgagaagacgacagaagggggtggcgcaatctcggctcgctgcaagctccgcctcccgggttcacgccattctcctgcttcagcctcccgagtagctgggactacaggcgcccgccactatgcctggctaattcttttgtatttttaatagagacagggtttcaccgtgttagccaggatggtctcgatctcctgacctcctgatccgcccgcctcggcctcccaaagtggctggaataacagncgngannnancactcncnnncaggcttntgtatatttttntatatnnccaaaatttttaattatactacaaactganaacaaacacaaccattcatctctaattaatatactggttatatcccaaaactacacgccccggccg

SEQ ID NO: 10977 - DNA, 406 bp, Homo sapiens
cgattcgaattcggcacgagacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcgtaggcataaaatgttaataaagag

SEQ ID NO: 10978 - DNA, 382 bp, Homo sapiens
  misc_feature 167, 173, 174, 175, 176, 177, 178, 179, 180, 181, 182, 183,184, 185, 186, 187, 188, 189, 190, 191, 192, 193, 194, 195,196, 197, 198, 199, 200, 201, 202, 203, 204, 205, 206, 207,208, 209, 210, 211, 212, 213, 214, 215, 216, 217, 218: n = A,T,C or G
  misc_feature 219, 220, 221, 222, 223, 224, 225, 226, 227, 228, 229, 230,231, 232, 233, 234, 235, 236, 238, 239, 240, 241, 242, 243,244, 245, 246, 247, 248, 249, 250, 251, 252, 253, 254, 255,256, 257, 258, 259, 260, 261, 262, 263, 264, 265, 266: n = A,T,C or G
  misc_feature 267, 268, 269, 270, 271, 272, 273, 274, 275, 276, 277, 278,279, 280, 281, 282, 283, 284, 285, 286, 287, 288, 289, 290,291, 292, 293, 294, 295, 296, 297, 298, 299, 300, 301, 302,303, 304, 305, 306, 307, 308, 309, 310, 311, 312, 313: n = A,T,C or G
  misc_feature 314, 315, 316, 317, 318, 319, 320, 321, 322, 323, 324, 325,326, 327, 328, 329, 330, 331, 332, 333, 334, 335, 336, 337,338, 339, 340, 341, 342, 343, 344, 345, 346, 347, 348, 349,350, 352, 353, 354, 355, 356, 357, 358, 359, 360, 361: n = A,T,C or G
  misc_feature 362, 363, 364, 365, 366, 367, 368, 371, 372, 373, 374, 375,376, 377, 378: n = A,T,C or G
tacggctgcgagaagacgacagaagggtgacattttggtatctttcatctgaccatccatatccaatgttctcatttaaacattacccagcatcattgtttataatcagaaactctggtccttctgtctggtggcacttagagtcttttgtgccataatggccaggnatggannnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnttnnnnnnnntttt

SEQ ID NO: 10979 - DNA, 380 bp, Homo sapiens
  misc_feature 380: n = A,T,C or G
tacggctgcgagaagacgacagaagggatagagactttgatttaataaaagatgaatcaacagtaacatgaagcaaagttgtctggcttagatgtatagcttctttcatgggtctccaataaaaaggttggttcccaacaaatcttttatttagttggcaagtcatgtgcccatttccagtcttctaggaggaagaacctcatggtgtcagtcaaccatgtagtcattagggtggcttcctcagagtcactggttctctaaaacttgttcctatgtgtgtcattccccaactttactattggtagttgtcaaattaagagagtattaggtacgaatacttgtgtttgtgtgtaagagacagggtcttgctctaacacctn

SEQ ID NO: 10980 - DNA, 383 bp, Homo sapiens
  misc_feature 350: n = A,T,C or G
tacggctgcgagaagacgacagaagggggagggagcagcgtgctcagtggccagagacttcacctgagttccagaaaatcagatttcagggctattggcgcattatcgtagccacaaaacgttggggttcatgttacctcttttgtccagtggtttgtgtgttcccttctcactgaattggatttgacattcaatttgaattgacagtgaacttcggggtaattcctttcagaaacctgaatcattttaggatctgggaagcattactctgtggcaggggctcttaaccaaaaagcccatcgctagaattctagggtctctgaatttggatgggaggaaaaacaaaacanaacaaaacaaaaccctttattttcactgtgccc

SEQ ID NO: 10981 - DNA, 380 bp, Homo sapiens
  misc_feature 380: n = A,T,C or G
tacggctgcgagaagacgacagaaggggggattattatctctttgcctaatgtccagtgtctgaaaaattgtttactgtattttgtgtgttttgatgctagttattttagctatgaagaaaaatcatacctgttgctctcccttggctagaggcagactacactagagtttcagcacatgccacagactggctaaaatgctttccttccctgtttgctcaactgcttccttttcattcttcattcctcagtgtagctatacgttcctcgggggaattttccatgagcctagtatagatctaattcttagcaatctgttttcttacagtatctatctgaatttataactgtcacttttctggggcttcgtcttttagtacn

SEQ ID NO: 10982 - DNA, 399 bp, Homo sapiens
  misc_feature 355, 399: n = A,T,C or G
tacggctgcgagaagacgacagaagggggtcttgttactaaagtaaatcactcctacaagttatatagtttattgtttcatggaaacacaaagaaccattccaaaatatgatttagcaacctcaatattaggacaattacaggggataaatagtcacataaggtgactggactcaatggtaaccacgggtccctggttcttgagggtcaccactcaaaggcaaaattacaaacctacacagtgccatcccagaattttattaacatatattttcatgaaagcaagctctcgtttttaggcatcttagcaatggtagcacactagtgtcttacacctgatcatgataaacgcaagnttaattttccctactttatatctggaaatccaattcccttaaan

SEQ ID NO: 10983 - DNA, 396 bp, Homo sapiens
atcccatcgattcgaattcggcacgaggctgcctgggagaggcagggtaccacagaggagctggcatcccgagaaaggatgccaccaccagctggtcccttccagagctctgtctgaactccaccagccttgcttctggcctcatcctgcagacccaggggacacctccacttgcaagttcagtccatgggcactgcacactctctcggccccaagttgaaccccttttcctcacccaacatcctccatttcaacaaatggcagcgttgtgggtaaaataacacctccttcagagacattgacatcctcatccctgacttcggctgcagctcagtggtgcaatctcagctcattgcaacttccacctcccaggatgaagcaatcctcccacctcag

SEQ ID NO: 10984 - DNA, 405 bp, Homo sapiens
ggcacgaggagagagagagagagagagagagagagagagagagagagagagagagagagagagagagagagagagagagagagagagagagagagagagagagagagagagagagagagagagagagagagagagagagagagagagagagagagagagcgcgggggcgtgtctctgtgtttgtgtgtctctcgcgcgctatttgtgttttctctctctcactctctcttttgcgcgcgcgcccccccccccttctctctctctttctctctctgggtgcgcgcgagagggggcgcgcttttgatatccaccttttttttatatagacacactctcttttatacactctctctcacacacaagagcgctctcttttttttctctctctgtgagtgtctcacactt

SEQ ID NO: 10985 - DNA, 402 bp, Homo sapiens
atcccatcgattcgaattcggcacgaggttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaaggtgcatatttttttaaaaagaagtggttgagtaaaaaaattgaagggacttttttaagggaaaaaatttatatgccaacagttacataagactttcaagattcacaacgactcttggaatataagggttcttttaattggggcaaaagcgcaggatagcattcttttctcttaagttcctgtggttggcatagcgggctttaaataattttaatg

SEQ ID NO: 10986 - DNA, 395 bp, Homo sapiens
cggcctacggctgcgagaagacgacagaaggggcccctccacttaggagtttttcagaagatttatctcaaaatacagtgaaacgatgacatattattcaccaccttggggattccaagacacacgatgaggtatcggcattgcaaaggaaggatttgcctgggtttctggtggtccaaatctgaggtttgtttcagacattctcatcttccaggcctctcatctcaccatgttttggtgctgtcactaatgaggaggtcactttgggcaagacagctttccctgtgcctcactgacttccctgatcagatgaagataaggattgttgtcctacacagaactgtgtgaggatgacataaggtcacatagatggagcactctgaagacttacaact

SEQ ID NO: 10987 - DNA, 404 bp, Homo sapiens
  misc_feature 248, 366, 404: n = A,T,C or G
tacggctgcgagaagacgacagaagggaaggactgaggtgacaatcagggaaggcgtcctgatgatggtaagaagggtgagggtgatgacgacagacaccgccacttactataaggcgtgtcatgtagcagacagtgggggtggctatgatgactatccctgctttccagacaaggagaatgaggcacagagtggctcagtgacttactccaggtcatagagtgagtagatagaggagcccggttcanacctggcagagtctgcaaaactctttgttctgcttccttgtgatggcaaagagtgcgagacagagggagaacccttcttaagacttgtgaaatgggggctggcctcatgtacatgggngtcctggtaaaagctggggctgggctgaaagcccttcn

SEQ ID NO: 10988 - DNA, 386 bp, Homo sapiens
gcctacggctgcgagaagacgacagaagggactaaacacaaagataaagacttttgttctcccccacaaatgataaattagtgtttttacaaatggaggcaatgatgtttagccatttacttggatacataaattgtactatgtccacattgagttttttccctgtcactattctattttacaaattgatggagacatatcttgggttaagaaatttctttcacacacacacaatggtttctttagctacaaatctgttttttgccaatcatctgagaaggccttttgttcacatatggggaaggtaatctcatgtttgtggagtatcttcatgggtattaccaccactatttacatgaagtcttcaagtggccttaagaagccgc

SEQ ID NO: 10989 - DNA, 384 bp, Homo sapiens
ggcacgagggcacatgcctgtaatttagtcactccggaggctgaggcaggagaatcgcttgaacccaggaggcggaggttgtggtgagccaagatcctgccattgcactctagcctgggcaacaagggtgaaactctctcaaaaaaaaaaaaggaaaaggaaaaggtcaaaccctgttaaaaaacaaacctctttctttcaattaaaaaaatgggccaaacgggggcccttccaattttttggatccctatataaaagttaattcccataaaaaaattccatttaagctttttaaaaaccttattttattttagagatttttttatttcaatccttataatttaaattaaccatgggcaaaaagttaaaatccatttaaaaatg

SEQ ID NO: 10990 - DNA, 381 bp, Homo sapiens
  misc_feature 381: n = A,T,C or G
ggcacgagagaggccgagtcaagagggtgccatctcccaagttcccatgattcctggggagcgtctgtgtagctgcccacctggaccgaggtggtccccacactgaggccaattggttgggagtccggggttgacctgggcaggggacacatcaaaactgctcgaggccaagcgcggtggctcacgcctataatcccagcactttgggaggccaaggcaggtggatcacctgaggtcagaagtttgagaccagcctggccaacttggggaacccttgtctctaccaaaaatacaaaaatggttgggcgtggtggctcacacctgtaatcccagcaccttgggaggccaaggcaggtggatcacgaggtcaggagttcaagn

SEQ ID NO: 10991 - DNA, 386 bp, Homo sapiens
tacggctgcgagaagacgacagaagggagcatcctaccctgaaacaggcctcatctctggacagtagctatgagatgacacattttctcattgtacaagcaatttgatgtggaaatctttgttacttgaaacaggcattttaacatataaaatgtgattcccactgaccactggcatccccagattctttggtttacctaaaagtatatataagaaaagtgtatgcctgatatctcgttgactccattacaaagaaacattaaaaaaaaaaaagaccttgatatgtggactcaattatgggccaaaatgctggtaataacaaatgcacttttattaaaagaacaataaaccgggcgcgggggctcacacctgtaatcccagcactt

SEQ ID NO: 10992 - DNA, 383 bp, Homo sapiens
tacggctgcgagaagacgacagaagggagcggggaggcttatcattttaggccatgaagttctgacatggtttgttatgcaggaatagacaactaatctacaccacatacaaattataatgttccttttttttttggttctattatggggttttataatatcacaatatgtcctggaattcttaattccacatttttaaaaaacaatatgataatacactttgaggaggtaccatagttcatttaaacaatcccttgtcaatgaacaattggattatttccaataatttggtcctggattttgaggatccagatcccaatctacttgactgtcctggatttgccaggccttagggaagttcaaagatgaaggtagggagggaa

SEQ ID NO: 10993 - DNA, 381 bp, Homo sapiens
tacggctgcgagaagacgacagaagggacatgtgtgttaactttctcatttaacataattacatttcactgagaccttctggaaccaacaagaaaaccttaatatggaactgcaatgatgggaatttggggcattgaaagaagttgggttggcaacattgcttgggtgatttccttgctaacattgtactgtaaggtgtgagggcctttgcattagactctgactgggctctgtaaacctgagcctcattcttagaacctcttgagccccttgatgttgcccagtcaagtccatagtgactgtaggggctgaacttcaagggccacttttgcttatagccatcacctgagagcacctccagaatcaaatgggcttgggaag

SEQ ID NO: 10994 - DNA, 380 bp, Homo sapiens
  misc_feature 380: n = A,T,C or G
tacggctgctagaagacgacagaagggatggcttggtgaccgacagtttctgaccatgtttcactgctacaaagagggttatgctgcattaatctgtcctcatgggtgacggacaggatttcaccccaccacaacctattgaagccccacttctctgacttcagagctgtccagggcccaggctatgaggcagctgtcgagaggtcccacgtacaggttgggagcaccttttctcaagaaacttacaggacagctcctggaactgaggcctacatgacaatggagaattcaggctttgtttcacttcttaaaaaagaagtccagttagatttatgagtatgtccatgaacatgcagaaatataactaatttctgaaagtn

SEQ ID NO: 10995 - DNA, 407 bp, Homo sapiens
  misc_feature 379: n = A,T,C or G
tacggctgcgagaagacgacagaagggggaaatgcattgtctaggttcctctagacctctaggttcccttctattctcagaagaaacttaagttatgcttgagtataacttgagtaggggccaggtaggggcagcattgtgggattcagccacaatggtgtgattcaatctgccctctggtctttggttccatttaacgtgcatttattgagcagctaacttgagtcagcactgtactaggtgctatataccagggatgtacaaaacagatttgatgttgctgattaagaaagtatctgtacaagttacaaactcacctcccagagcacttgcccttgagccctggagcttgccccagtcttcctcctttctaagatcnaccacttacccactgggaagagatttgg

SEQ ID NO: 10996 - DNA, 386 bp, Homo sapiens
tacggctgcgagaagacgacagaaggggcattcctgttagaatagatagagcacgtccaagggcttggagatgtggagcagttggaaacactgtggttggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccc

SEQ ID NO: 10997 - DNA, 392 bp, Homo sapiens
tacggctgcgagaagacgacagaagggacaagatttggtgaattggtataggaggtcaagaggaaggaagaatccgggacaggaatcatagcattggtgtcaccaaaaataacattgtgctaccaaatgaaataaaattcagaatgaggagtccatgtcagggaaacatgatgatgccaggtttggacatttgggatatgcaaatgggaatgcagaggaggcagctggatatagggcatagagcccagaggaggtggtctgcgctggagattcagatttttagacagccgcatggaaagcttggtgcactgggaataacgcctggtgcggtgtagtgtgagggccaccctgaccctctgtcagttggaaggtagtgtgtgttggttgtaaaa

SEQ ID NO: 10998 - DNA, 410 bp, Homo sapiens
gattcgaattcggcacgagggtgaacatgacgctgctatttctgggtcagcgtcaagaccgtgaagacgcggaacggggcgctgggagtggcggtgggcggggcggtcgatggcaaccgggacgagatgatccgtcggagcccccggcccaagggcgacttctccagccgggcccgcgaagtgatttctcacattggcttgctgagagattatattctggaacgcaggaaagattatattaatgcttatagccataccatgtctgaatatgggagggtgagagacacagaacgagaccagatagaccaggatgcccagatattcatgaggacctgttcagaagcaattcagctactacgaacagaagctcacaaggagatacattcccagcaagtgaaggagcacaggac

SEQ ID NO: 10999 - DNA, 382 bp, Homo sapiens
tacggctgcgagaagacgacagaagggaactagttggggcatcttttttttgaatgaagccttcagccttctttaggggaatcttgcttcctgacagagggaccggtggaaagtttgtgtcttaagcaagaaagatttaagtacattctgcaactttggccttgtaagctgtgatcatttttaaggttgacgagcatagttcactatgaaatgaagcaagtaacttggcatttatacattgtgagtcaattttgacatcagcctggaattggaattgacctgaagggtttggtggtggactgtggctacacttcaagggctccggccaaaagcatgcatgagcatactttccttttggccttaaccttaatttgggaataga

SEQ ID NO: 11000 - DNA, 380 bp, Homo sapiens
tacggctgcgagaagacgacagaagggcatttgcatcaagtcttagaagtacaggaattcctagtctatcaattaaactttaataaaaccaaactcaaagaacatttcattgtgcatttatataaaattttgtcaagtgttactggatttagatcaccccccagtttagaagatcatcagttaatacacagaattgtgtttccacggtgtttattagcctgccatggtttaaaatgcgtttacaccataacatgccgatgaaggctaatgatgggcttactacagaccagaaactgttctgggcacataggttctgtctcattttagctcaccgtctcacaaatagccacaggcagatgcagtaggctaggggatgccgg

SEQ ID NO: 11001 - DNA, 407 bp, Homo sapiens
ggcacgaggggaactgaaagcgatgaaaagcgttccacacgccacgagcccgcgggatcctcggagagtatggaacccttcccctccgctctcagccggaggccagctgcgtccagccgggcgcggtcttctgaacaccgatttcaaatcaggtccccggggcccagcgtcacttatggaagtggtggcattttgtggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttg

SEQ ID NO: 11002 - DNA, 401 bp, Homo sapiens
  misc_feature 401: n = A,T,C or G
ggcacgaggggaactgaaagcgatgaaaagcgttccacacgccacgagcccgcgggatcctcggagagtatggaacccttcccctccgctctcagccggaggccagctgcgtccagccgggcgcggtcttctgaacaccgatttcaaatcaggtccccggggcccagcgtcacttagggaagtggtggcattttgtggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgan

SEQ ID NO: 11003 - DNA, 404 bp, Homo sapiens
  misc_feature 339, 394, 404: n = A,T,C or G
tacggctgcgagaagacgacagaagggatagaataaaaatgtaaaaaccaacaaattaatagactgtgtgtaaaagacataagaacattatctagtatgattgtgggcattaaagccaaacacatttcatcggcccagaatggccatttcacctctagcttctgagtaggagagtcgtgaatgctttgtccattgtgcatgtaaacaaaagtcatataatctcacttttaacagggtcagaagaacctatttcttcttaactattacaaatgcattttcctgcatcgattggaaatccaggacatcactaaagatttttccattttggcatgtctttangaggaagaaatcgtggactggtggagtaaatttatggcttctccagggacatganaatgccgacn

SEQ ID NO: 11004 - DNA, 402 bp, Homo sapiens
ccatcgattcgaattcggcacgagcctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctgg

SEQ ID NO: 11005 - DNA, 382 bp, Homo sapiens
ggcacgagcctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacct

SEQ ID NO: 11006 - DNA, 381 bp, Homo sapiens
tacggctgcgagaagacgacagaaggggcttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctga

SEQ ID NO: 11007 - DNA, 383 bp, Homo sapiens
tacggctgcgagaagacgacagaagggctcagaggggctttgagaacaggtgtggaagctttgacttcctcaggaccctcttccctaatgcagtctctttccatctcccagtgtccaactttcctttctagatggtccttgggagcaggcatccatttgcccagggaaactggcaggcagccatatcctaggagcagggccactgatgctggagcttcaagacctgggttggaactagctgtgagcctttggctcctaatcttctcccagcctcagtttacttccccgtgaagggtgaaagaatgatgcttccctgccttgcattcctctgagctctaactcaccctccctacaatttggatcctattccctggggccacctc

SEQ ID NO: 11008 - DNA, 392 bp, Homo sapiens
  misc_feature 289: n = A,T,C or G
attcgaattcggcacgagggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatcccgtatacccacattctcaatcggggactccctccagacatncgtatattggccctggcccctgtagaacaagcgtcagggctagttcaagtggcttgagcggcctacacgtaatttttcctcggccgattagagaatgaacatg

SEQ ID NO: 11009 - DNA, 403 bp, Homo sapiens
  misc_feature 403: n = A,T,C or G
ctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtccttgctgaaatggn

SEQ ID NO: 11010 - DNA, 356 bp, Homo sapiens
  misc_feature 326, 356: n = A,T,C or G
tacggctgcgagaagacgacagaagggggagatttgagcccaggcatcaaaattatttaaaattccacagatgaatccagctggtagttactctagattatccttcgagcaaggcttctgggtggcagatgtaaataggcccatttgactgctaagaaactgaggctcagacaggagaatgacctatctaaggtcacaaggttgacttatccaagggcacaggggtgcagggtcaatgtgaagacgtagcagaggctctgtccatgtgctgaacgggagggagcagctcacagatgctctgattctgatgaagctgggccacatgnctggctccaccggtagccaccttcgatatn

SEQ ID NO: 11011 - DNA, 367 bp, Homo sapiens
  misc_feature 367: n = A,T,C or G
tacggctgcgagaagacgacagaagggatagcgtttattcccctctttcttacttgaatggaatccatttttaagctttttgattttttttgtcataaaaaaaagcacataacattcttcataatagtattgttattcaactttttgtcatggttgaaatattaatgcaatactgaagtgtctataaaccagatttatttattaccacactgacaaaaagtacaactaacagttggcaggtagataacatcagaaaaatccatgctatgaaaaggaattttagtatgaactcatcaaagtaactagtaatttttaacagactctagtgacatatatgcctctctctctaactcaattataaaccctn

SEQ ID NO: 11012 - DNA, 362 bp, Homo sapiens
  misc_feature 270, 362: n = A,T,C or G
tacggctgcgagaagacgacagaaggggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccgactttctgagtaagggaggagcactttttttccaaaaaggaaagaacgtctctactggngtttttccttctgatattcagcattagagtagaaagaaactattgtttgccacattagccgtggtagcagtgctgcagctttgcactgtatn

SEQ ID NO: 11013 - DNA, 359 bp, Homo sapiens
tacggctgcgagaagacgacagaaggggtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcgctttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccg

SEQ ID NO: 11014 - DNA, 363 bp, Homo sapiens
tacggctgcgaaaagacgacagaagggagctgagtttaatataatccatagaaatacatattaatgtaaaactttaactcaaaagataaaaaagcctctgctttaaaaggtttaggcaatttcggtaagtatttttattacagaattatagaatatctagaaaggcatgtgttgaataaagaatgagaacaagtagttgcttcaaactatatattatattcaaattatgtagtgcacggcattagtttctatacattcgttaaaatttaaaaaattctatttcttattttgtttaaataaaccaaaatattctatttcagaaaataatttaatctttagtttttaaattcttagcatagcaag

SEQ ID NO: 11015 - DNA, 377 bp, Homo sapiens
tacggttgcgagaagacgacagaaggggccaacatcacatcattgactcttcctgagcttatgaacaaacaaaaccgcaggtctccttcacaagaagctgactgctaaatatggtctgccctggtctgtgatttttaaatgagaatctatagttctggcctgaatttctatatttctcatgagaagtttgtgattatcaaacacaccatagtatgaaatcatcagaatatttaatatgaagccctatgcaagtatgaaataccttatcatttaaatatatagactgtacactgacaggatggctctggccataaatgtcttttatgattatcggtacatgttttatatgtattgttacatggtttaacggggttctc

SEQ ID NO: 11016 - DNA, 370 bp, Homo sapiens
  misc_feature 370: n = A,T,C or G
tacggctgcgagaagacgacagaagggtagatatctgctcctttctgacaacattgccctaaaagtcggcacttttcaacaacatataatatctcataatttgtgtggaccagaatctggacacagttcagctggctacctctgccttcaggtcttttatgagactgggggctgtggtcttaactgaagctggactgggaaagcatgagcctttaagctgactcatgtgaaaattgacagggtttagtgtggacagagagcctgactttccttctctctactcgtctgagcaccgcctcaccctttgttatgtgggtctctacatggagcatctcatagcattggagcttgcttcctgtgtttgaggaan

SEQ ID NO: 11017 - DNA, 378 bp, Homo sapiens
  misc_feature 72: n = A,T,C or G
tacggctgcgagaagacgacagaaggggtcactttgaagatgcatggcctgaactcgactgcttgtgtttgnttacatatcaggcatacccaggcatctcctgcagccagaggttccattgctgtctttgctcagtcctcttttaaaatatgaattagtggacaggcacggtgcctcacacctgtaatcccagcgctttgggaggtcgaggcaggtggatcacgaggtcaggagatcaagaccatcctggctaccactgaaaccccatctctactacaaaaaaattagccgggcgtggtggcgggcacctgccagcccagctactcgggaagctgaggcaagagaattgtgggaacccgggaggcagagcttgcagtg

SEQ ID NO: 11018 - DNA, 359 bp, Homo sapiens
tacggctgcgagaagacgacagaagggacagtacatctccttttacttacccccatggctttagaggggaagcaccaggcttgtggttcccaaactgggaaagaaaagtggagaaagccagttcctccttcctaagatatagatcaggactgtggggcagttaacaaaactgagtgagtggctaggctggaagtgagagtggagtcactaacaacctgacaagctgtgtggaagggaaggtcttcaagtctttatctgttgaactaagtgtcgacactcctcccctgctgaaccccaaacacatctaacctgcttcctcctcctcctggaagcctttcctgaattcctatccaccaaga

SEQ ID NO: 11019 - DNA, 349 bp, Homo sapiens
  misc_feature 136: n = A,T,C or G
tacggctgcgagaagacgacagaagggaatcactgtcttaatctttctccttccaatccttcctgcctgtcctgcctgagtaacttttcaaaacttccagttaatcaataaaggcttctcattgcctttcttcagngtggctttcacattctgccccaggccactctcttgcccttgttttcttcaattcttccatgcctatattagtccatttgactgccataaagaaatacctgaggctggtaattataaggaaagagattatttgctcattggtcgcagctgtacagagcatgcattgcattgctctgtaaagactcaggaggtccatcatgcagaggtgaggggg

SEQ ID NO: 11020 - DNA, 376 bp, Homo sapiens
tacggctgcgagaagacgacagaagggcaccgaggactgcccagggtgctctgagcagggcaatgccaatggcgctaagggtttctagcccagggcttctcagactcagcactgtggacgtggctctgcggcgtgggctgtcctgtgcactgcaggctgtctggcagtatgcctgacctcgagtccctggatgccaggagcacccactcctcccagtgtgacagctaaaaccagacattgacaaaggtcccctaggaaagaaaattgctactggttgggaactgctgctagccattctttctggccactgcagcatggggtcagtgagccttgtcttgatagaatggcaaggtgttgcctggaccacaggctgcat

SEQ ID NO: 11021 - DNA, 372 bp, Homo sapiens
tacggctgcgagaagacgacagaagggcatctggccttgtaggtgccgggaacgggcaagacatgttttgaaatgtaagatcacagactgttttttgcaagaccacattatattactttattattttctgctttttcttttaacgacattagtgtttttgatcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacatt

SEQ ID NO: 11022 - DNA, 370 bp, Homo sapiens
tacggctgcgagaagacgacagaagggggaaatgcattgtctacgttcctctagacctctaggttcccttctattctcagaagaaacttaagttatgcttgagtataacttgagtaggggccaggtaggggcagcattgtgggattcagccacaatggtgtgattcaatctgccctctggtctttggttccatttaacgtgcatttattgagcagctaacttgagtcagcactgtactaggtgctatataccagggatgtacaaaacagatttgatgttgctgattaagaaagtatctgtacaagttacaaactcacctcccagagcacttgccctggagccctggagcttgccccagtcttcctccttt

SEQ ID NO: 11023 - DNA, 350 bp, Homo sapiens
tacggctgcgagaagacgacagaagggaatcactgtcttaatctttctccttccaatccttcctgcctgtcctgcctgagtaacttttcaaaacttccagttaatcaataaaggcttctcattgcctttcttcaggttggctttcacattctgccccaggccactctcttgcccttgttttcttcaatttcttccatgcctatattagaccatttgtactgccataaagaaatacctgaggctgggtaatttataaagaaaagagatttatttgtctcatggttccgcaggctgtacaagaagcatggcattggcatttgcttctggtaaagacctcaggaagtttccaa

SEQ ID NO: 11024 - DNA, 347 bp, Homo sapiens
  misc_feature 181, 329: n = A,T,C or G
tacggctgcgagaagacgacagaagggacatatggccaaacatgcatattaaccagtttggttttttcacttaccaatatgatttgaagatcattccgtattcagcacatacgtctgtttctcgttaagtatttatttacacctcacaacaactctgtactcccctgttactcccccattntacagaggagactgtaggtctggagatattaaatgacttgctgttggtcacacaattgataagagggagaggtcaaatttgcttcagagtctttagagctcttgaccatagactcttcacatggacatgtggcttcatctacaacagngagtatgagacccttaaa

SEQ ID NO: 11025 - DNA, 369 bp, Homo sapiens
tacggctgcgagaagacgacagaagggcatttgaatgtgtttccccttaaatataaactaaaatgtcatcgtctgcttcaaagaagaactatcgtttataagtaagtggtccgattcaggatgcaagctgatcattttcctgtcttttaaaaataaaccgctaagaagaaacaataaataaaaaataaaatatgcttcttttacaacaaagacagtagagtctggacatttctggaagatgggctaaaagaaacacaaaatcgaccgggcgcggtggctcacgcctgtaatcccagcattttgggagtccgaggcgggcggatcacgaggtcaggagatcgagaccatcctggctaacatggtgaaacc

SEQ ID NO: 11026 - DNA, 357 bp, Homo sapiens
tacggctgcgagaagacgacagaagggggtcttgttactaaagtaaatcactcctacaagttatatagtttattgtttcatggaaacacaaagaaccattccaaaatatgatttagcaacctcaatattaggacaattacaggggataaatagtcacataaggtgactggactcaatggtaaccacgggtccctgtttcttgagggtcaccactcaaaggcaaaattacaaacctacacagtgccatcccagaattttattaacatatatttccatgaaagccagccttcgctttttagccatctcagcaaatgtagcacaactagtggtcttacaactgtatcatgataaaacgca

SEQ ID NO: 11027 - DNA, 360 bp, Homo sapiens
tacggctgcgagaagacgacagaagggatagaataaaaatgtaaaaaccaacaaattaatagactgtgtgtaaaagacataagaacattatctagtatgattgtgggcattaaagccaaacacatttcatcggcccagaatggccatttcacctctagcttctgagtaggagagtcgtgaatgctttgtccattgtgcatgtaaacaaaagtcatataatctcacttttaacagggtcagaagaacctatttcttcttaactattacaaatgcattttcctgcatcgattggaaatccaggacatcactaaagatttttccattttggcatgtctttaggaggaagaaatcgtggactgg

SEQ ID NO: 11028 - DNA, 365 bp, Homo sapiens
  misc_feature 157, 214, 264, 285, 327: n = A,T,C or G
tacggctgcgagaagacgacagaagggcaggcacctgctaccatgcccagctaatttttgtatttttagtagagacatggtttcaccatgttgcccaggctggtctccaactcctgacctcaagtgagccacccccctcggcctcccaaagtgctgngattacaggtgtgagccaccacacccagccaaaaatcaccttttttacaaggatcanaacagtcattatgctggagatgacagacctcactgtcaccatgctctttntgatgtctactaagcacggtngctggtccacactcacagaaaccttagaactcgcacccaggngctcggctgtagcagaatcccaagaataaaacctgtgc

SEQ ID NO: 11029 - DNA, 378 bp, Homo sapiens
tatctttttgcgagaagacgacagaagggatgagtgactagctatttacaaaagagcgatttagactcgtgcctcacagaatccaccaaaataaattctacccgtattaaagggttaaggatataaaattaaaccacagaaaattagaagaaaatgaaagacatgttcaatctggatagcagaggattttctaaagctaaaaataacaaatgcgtcattctaattttccttaataggcgtatgttattcttaaaggcatttattattcctattattccttaaaggcatacattattcagaaaaaagcaacagaagatctaacaagggaaataattactgttttagttactttaaaatttaaatccttggccgggcgcc

SEQ ID NO: 11030 - DNA, 364 bp, Homo sapiens
cgttgctgtcgggaggttgcagtgagctgagaccacgccattgcactccaggctgctgggcaacaagagcaaaactccatctcaaaaaatagccgggcatggtggcgggcacctgtagtcccagctgctcaggagactgaggcaggagaatcgcttggaccggggactcggaggttgcagtgagctgagaccacgccattgcactccaggctgctgggcaacaagagcaaaactccatctcaaaaaagaaaaaaaaaaaattacaagtcaatctgtttcgttaatgtagttgcaaagatcttactaaaatattagcaatcagaaaccagttatgtatttaaaaactagattatgaccaagttga

SEQ ID NO: 11031 - DNA, 369 bp, Homo sapiens
tacggctgcgagaagacgacagaaggggctaccttttgcttatacgtcaattagccaccacacctgggtaatttttgtatttttggtagagacgggatttcaccgtgttggccatgctggtcttgaactgctgacctcgagtgaaactgtccacctcatcctcccaaagttctgtgattgcaggtgtgagcctgtacatttgttttaatatggaaattttcagtgtgatttaatgaactccccaactcagtgatactctgttgtaactgagtttggtttctctaatcaggctgcagacaactagtcagatcggctccagtaaagggacgttcattgtatagacacactgagcagttcaggacaagaatg

SEQ ID NO: 11032 - DNA, 359 bp, Homo sapiens
  misc_feature 359: n = A,T,C or G
tacggctgcgagaagacgacagaagggggaaaattcatttcatggacatcttgttgccaggaatcagtgtgattcacttttcatttcaggatgatgttgagtcctctgtgttattcccagtgtggacgtggagtagtgactgatgtctaattatttggaagggagagagcttctctaagaaggacatgcaatgtcagaagcttccgttgcgttgcaacacgtaactttacctatgtttcaccaagggcagttaaaaggctaaagatgccattcagccatagtggatacaagaagatctcgaagctggcccgcaaaatcgtttcacatagaataacactaaaaagggttggactaagggn

SEQ ID NO: 11033 - DNA, 353 bp, Homo sapiens
tacggctgcgagaagacgacagaagggagcggggaggcttatcattttaggccatgaagttctgacatggtttgttatgcaggaatagacaactaatctacaccacatacaaattataatgttccttttttttttggttctattattgggtttaataaaatcacaatatgtcctggaattcttaattccacaattttaaaaaacaatatgataatacactttgaggaggtaccatagttcatttaaacaatcccttgtcaatgaacaattggattatttccaataatttggtcctggattttgaggatccaaatcccaatctacttgactgtcctggatttgccaggccttaa

SEQ ID NO: 11034 - DNA, 356 bp, Homo sapiens
tacggctgcgagaagacgacagaagggggagatttgagcccaggcatcaaaattatttaaaattccacagatgaatccagctggtagttactctagattatccttcgagcaaggtttctgggtggcagatgtaaataggcccatttgactgctaagaaactgaggctcagacaggagaatgacctatctaaggtcacaaggttgacttatccaaggtcacaagggtggcagggtcaatgtgaagacgtagcacaggctctgtccaatgtgctgaaacgggagggaggcagctcagcagatgtctctgaattctgactggaagctggtgcacacatgtcctgactcccaccgtctca

SEQ ID NO: 11035 - DNA, 364 bp, Homo sapiens
tacggctgcgagaagacgacagaagggaatggcagaagaaggaagggggcgacaggatggtggtaatgttaataggctaaacttcaagtaccataacaaagtccgcagataatagcaaaaattgaaaaagcaagaaatggcactacaaacgtgtcttttagagccatgaaggtaatcaccatagaaacgaaaagcagaagtggctaacagtccttgcctctctctgcaggagaggaagaaggtgtgcaagggagtggctgtgctatctgactttctacccaggaccttgttttactttaagaataggcaaggaggccgggcgcggtggctcatgcctgtaatcccagcactttgggaggccgag

SEQ ID NO: 11036 - DNA, 359 bp, Homo sapiens
  misc_feature 320, 359: n = A,T,C or G
tacggctgcgaaaagacgacagaagggaaatatctaatatattttttctaattaagaacaaataaatgaaaaaaacaagtgaaacctttaatttgcatataaataagggaattaacaccagcatctaaggttatgtcaatctgtagaagattaattctttctcaccagaatttgtttccatgacatattcaagccatttatcaggcccagatattccactttccagtataagccttcaaagtacaaaaacatgaactgtaccaccccacttacgttgcatggatgttctcttgcttacttttattcaagtcccttcctanacttgttgagcagtatttccacatacttactgatcatan

SEQ ID NO: 11037 - DNA, 338 bp, Homo sapiens
tacggctgcgagaagacgacagaagggttctccatccctctttcagaagaaacaaaggcacaaagaacttcacagagtggagaaagaaacaccctccctggaggatgtgtaatcacagacggcttgtcatgccattgccaagtttacagaaatgtgtggccaaggaaacctctcgcggagaagccaatttaaagaaactccaggctggtagtgtcctaaggtgcctgatgaaaacaaatacatattctccagagggaacatttctcagcccaataacacaggatccccatagataaaagccaatttgaatatgtatttacatttttaaaaaagaaaat

SEQ ID NO: 11038 - DNA, 373 bp, Homo sapiens
tacggctgcgagaagacgacagaagggtatctgctgtaatatttttatctgaggtagggataaaaacatcccatttctggactttacttggagaaccagctagaggtgaatatacgacccttcatgacctggactgaaaacattttcaagttctctatttcggtcaatacagcccctttaataattccccaaagcatctcccctttccacctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgag

SEQ ID NO: 11039 - DNA, 370 bp, Homo sapiens
tacggctgcgagaagacgacagaagggcaaaggtacaaagaggttctagctggacctctaaaggcacataataagtaagtggtagagctggagttcacatccaggcagtaggctccaaggtctgtgctcttaaccacattctgggctgcatcttttatagacaaactatgattcagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgag

SEQ ID NO: 11040 - DNA, 366 bp, Homo sapiens
tacggctgcgagaagacgacagaagggcgctgggagcccctcggcatcatgctctggccagcaaagcccctgcggcagcggcagcagctgtggctgccatcatcctggacaccatgttgccttgagaggcaattgttccttcccccattccatgggcactttcccagttatgacacaggatgatctggtcccagtgctgtaatggggagtggggatcacaggtggggcaatggaggagctctgaaagtggctttggatatctcactacccaaaaggaaaggcattagccaccatggccccaacaaaactaaaataaaaaggaaagggggtcaggcacggtggctcacgcctgtaatcccagcactt

SEQ ID NO: 11041 - DNA, 361 bp, Homo sapiens
gctacggctgcgagaagacgacagaaagggttctagagatacgatggtatatgatattctccacccgatttttggttttgcattataccctgactttagcaatgtgatatttaaaagtggcaaaaatcacaaaattactttaagggagaaatgggatgaaatagcaccatttcagtggcaagacaagggatgcagagagctgacgtctttaaagaaactgttccataattaattcaggactgtcctgtccacttgggttaataggaaattagtgatctacctgcccaacagtgatgtttggatcaaggatggaataactctctcactctcttctcactgaacaactacctcacatctactg

SEQ ID NO: 11042 - DNA, 360 bp, Homo sapiens
tacggctgcgagaagacgacagaagggcatagcctcacaaatttctatttaattgcatgaacggcatgtaatagactaattctcaatatctggttcctggaaaaatatgccctgcccactgctctcagtgacagggggcccaggcggtcagcactctcctgtaggacgggctgcaccagcagatgtaactgtccggaagaaggatatctagccatgtttgatgcttcgcagagctcacaacacaggaggagagtcactcccagcccacattccttggtctatctccaaagccctatctcttcccctctccccatcttgctggcaggaggggcagcaaaggacagagagcatacatacctt

SEQ ID NO: 11043 - DNA, 361 bp, Homo sapiens
tacggctgcgagaagacgacagaagggcatagcctcacaaatttctatttaattgcatgaacggcatgtaatagactaattctcaatatctggttcctggaaaaatatgccctgcccactgctctcagtgacagggggcccaggcggtcagcactctcctgtaggacgggctgcaccagcagatgtaactgtccggaagaaggatatctagccatgtttgatgcttcgcagagctcacaacacaggaggagaatcactcccagcccacattccttgttctctctccaaagccctatctcttcccctctccccatcttgctggcaggagggtcagcaaaggacagagagcatagatacaagg

SEQ ID NO: 11044 - DNA, 359 bp, Homo sapiens
  misc_feature 336: n = A,T,C or G
tacggctgcgagaagacgacagaaggggagggttttcaggcagaggaacagttggccaaggaagtcagcttctcagagctcaagagatctgagtttaactcattaaagatggcatggaagagcagtgtcataatgcaaatgggaagatttcttctcttagtaattctatttctgccacgtgagatgacaagttctggtttaactgtgaatcgtaacactgagaactatatcctggatactacacctggctcccaagcatctctgatatgtgctgttccaaaccacaccagagaggaagactgctctggtaccgagaggagggagaggggatttganatctggaacaaattcatttccgg

SEQ ID NO: 11045 - DNA, 354 bp, Homo sapiens
tacggctgcgagaagacgacagaagggtcaccatcttagccaggatggtctcgacctcctgaccttgtgatctgcccacctcggcctcccaaagtgctgggattacaggtgtgagccaccacacccggcctcattcattctttgaacgtttcaaccctacctcctccaatgaagccttccctgatcagaatcgccctctcctcagtctactacctgtaccagtcacacaacacttgccaacttttaccttgcctgcttatgtctcttgctagaccgagtcccttctcagtagattcagttgactatttatttatgttaaactctaaattgggtactagcgttataagacagaag

SEQ ID NO: 11046 - DNA, 366 bp, Homo sapiens
tacggctgcgagaagacgacagaagggggaaaattcatttcatggacatcttgttgccaggaatcagtgtgattcacttttcatttcaggatgatgttgagtcctctgtgttattcccagtgtggacgtggagtagtgactgatgtctaattatttggaaagggagagagcttctctaagaaggacatgcaatgtcagaaagttccggtgcttggcaaccaacgaactttaccttatgttcaaccaaaggcagttaaaaggctaaaagaatgccattcaggcatagtagaatacaaggagatcttcgaagctggccccgcaaaaacgctttccacctagaattaacacctagaaaggggtggggag

SEQ ID NO: 11047 - DNA, 375 bp, Homo sapiens
  misc_feature 375: n = A,T,C or G
tacggctgcgagaagacgacagaagggagcattaacatagaaactagagattagtagtactggagccaagttttatccaaaatcgtgtggctctgttattttaaatcaaaagacaaataagaaaacaggacactttgtgtccctagctttgaatctgattattttgtatattccaaaaaacacctagacccctggatttttccacagcagctctacttaactatcagtgaaaaacgctgggacatcccaccaccaccaacagcaccccttatgagattatccattgttttaaaagcccagctttccttcttttgaaaggtactcccttgggggagctatcctggcctaacaaggtatttgtaatggatgcaaatn

SEQ ID NO: 11048 - DNA, 359 bp, Homo sapiens
  misc_feature 359: n = A,T,C or G
tacggctgcgagaagacgacagaaggggagggttttcaggcagaggaacagttggccaaggaagtcagcttctcagagctcaagagatctgagtttaactcattaaagatggcatggaagagcagtgtcataatgcaaatgggaagatttcttctcttagtaattttatttctgccacgtgagatgacaagttctgttttaactgtgaatcgtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattn

SEQ ID NO: 11049 - DNA, 358 bp, Homo sapiens
  misc_feature 358: n = A,T,C or G
tacggctgcgagaagacgacagaaggggggcggtggctcggtctcccggctgcgcgcggagcgggagggctctcctcacacaagcgcttccttgccgagaggctggagctgcggcaccgcaggcctgagccaccccttctctgctgtctccttctcttcctcagggctcccgtgtctgctcgccctccgacgctgctcagactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaactn

SEQ ID NO: 11050 - DNA, 364 bp, Homo sapiens
  misc_feature 312: n = A,T,C or G
tacggctgcgagaagacgacagaagggcatttgcatcaagtcttagaagtacaggaattcctagtctatcaattaaactttaataaaaccaaactcaaagaacatttcattgtgcatttatataaaattttgtcaagtgttactggatttagatcaccccccagtttagaagatcatcagttaatacacagaattgtgtttccacggtgtttattagcctgccatcggttaaaatgcgtttacaccataacatgcccgatgaggctaatgatgggcttactacagaccagaaacctgtcctggcacataagntctgtctcattttagctcaccgtctcaccaatagccacaggcagatgcagta

SEQ ID NO: 11051 - DNA, 352 bp, Homo sapiens
  misc_feature 246: n = A,T,C or G
tacggctgcgagaagacgacagaagggagcattaacatagaaactagagattagtagtactggagccaagttttatccaaaatcgtgtggctctgttattttaaatcaaaagacaaataagaaaacaggacactttgtgtccctagctttgaatctgattattttgtatattccaaaaaacacctagacccctggatttttccacagcagctctacttaactatcagtgaaaaacgctgggacatnccaccaccaccaacagcaccccttatgagattatccaattgtttaaaagcccagctttctttctttgaaagtactcacttggggagctatcctgcctaacaggtat

SEQ ID NO: 11052 - DNA, 362 bp, Homo sapiens
tacggctgcgagaagacgacagaaggggcatatgccaggctcgtctgaccctggaatgaggatgtaggaagcaggcagagctccggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatgggtggaaccccccgctatcagt

SEQ ID NO: 11053 - DNA, 377 bp, Homo sapiens
  misc_feature 377: n = A,T,C or G
ggcacgagtctctctctctctctctctctctctctctctctctctctctctctctggggctcgctctctgtctctgaggctctagtatattcaaccaaaaataccccttgaaactggtacacagacatagacagagagagagcgatagttacagtgagcgagagtgtggatgtctcagcctcttgaaaactgatatcaggccatgaaaaatcctaaagtagccccctttggagagagagaaatacctatacatagacttaggcaccccatccgaaacacatcttaaaaaatttattgtgggcatgtgtgcgcgtgaagaatttctcagcaaagatatcagttatcttatttcaaataagaaggaagcctaactttcn

SEQ ID NO: 11054 - DNA, 378 bp, Homo sapiens
  misc_feature 312: n = A,T,C or G
tacggctgcgagaagacgacagaaggggcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtgggtacagaaaatgaacaaaactgcaacaaaatggcagcagacacctgcacctacagatacntgagctgtgaagactcaagttgagcagaataaagtgtttgaggcagaactgaagcagaatgtaaaa

SEQ ID NO: 11055 - DNA, 373 bp, Homo sapiens
tacggctgcgagaagacgacagaagggagcaagacctgggcctggagctcagggtcccttttaggtgggataaaaaaagagggacagagagagggaggaaaagagagggcacggaggcccagaaagagagggggacagagacccagagagagagggggacagagacccagagacccaaagagagaaggacagggaccaagacagggggacagattcggagagaaagggacagaggcccagagaacaagggtcccagagacttcgggacacgcttggatgcagggagggcttttgaaagcagggccgtgttgtcccctctgaaccctgaccctccctccaggacgggcggctgagcaaagcggaaatcctgggt

SEQ ID NO: 11056 - DNA, 350 bp, Homo sapiens
ggcacgaggcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgaggctaccacaaggtgtccctgcaggtacacccggaccgggtgggtgagggcgacaaggaggacgccacccgccgcttccagatcctgggaaaagtctattccgttctcagtgacagagaacagagagcagtgtacgatgagcagggaacagtggacgaggactctcctgtgctcacccaagaccgagactgggaaggcgaattgcgg

SEQ ID NO: 11057 - DNA, 359 bp, Homo sapiens
tacggctgcgagaagacgacagaagggagatgtccatctcctatctactttgcaaacattggtttctttaggcggaaacttatcgatgctgttggctttagcccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaagatcagcctccacagcct

SEQ ID NO: 11058 - DNA, 322 bp, Homo sapiens
tacggctgcgagaagacgacagaagggagcatctagtacattctgatctatttatagaatgaagatttcaaattcagatcaaataattgagaaagcctttcacaaaaagggattgaaggccacaaacaggtcatatgctatgaacattctctcagttgtttactatatagtattcaatatatctttattggacttctattatgttctaaggtcttaacaaaatactagctaactgaatccaacacatatcaaaagataatccccataatcaggtgggttcacaccaggatgcaggatgggtaacatacgccagcaataaagg

SEQ ID NO: 11059 - DNA, 227 bp, Homo sapiens
ggcacgagatttctgccgagtcgagctggacacccggagatcagggaggcagcagggcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgt

SEQ ID NO: 11060 - DNA, 606 bp, Homo sapiens
tattttgctttttacgacagaagggaattattaagacttattggctggcatcatgtcattcccagctataactcttaattttcctaaaatgctttctgtaaatgagtgctgcatttatatctttcatgtgctttaagaatctctctcatttgattgggacacctacaaaatagcaatagtagtagtcttttataatactctagaattcttttttttcaagatggagtcttgctctgtcacccaggctggagtgcagtggtgcgatcccggctcactgcaagctccacctcccgggttcacaccattctcctgcctcaacctcccaagtagctgggactacaggcgcttgccaccacgccaggctttttgtatttttaatagagaccaggtttcaccatgttagccaagatggtctccatctcctgacctcgggatcccgcacccttggcctcccaagtgctgggactccggcgtgagcccttggcctgccatactctagattctattgccgcaaaaatcccaggaggccggcgtgtggtccaccatatccagcattcggaggcgagtgggtgaaacctgagcacgagttgaaccactgacatgtgg

SEQ ID NO: 11061 - DNA, 226 bp, Homo sapiens
ggcacgagctgacttgtcctcctttctttgaactgtctgcagggagggaggacaaggccagcctagatctggcctgcaggacagaggcctcagtggctcaggacctttccctgcccctccccaggaacaagcagaggcagctgaggtagtagcagcctcctgcaggtttagagacagacaggccagggttcaaatcctagctcttcctctcactagccatgggatt

SEQ ID NO: 11062 - DNA, 390 bp, Homo sapiens
ggcacgagctttcctggccagacacagtggtcagtcctgcaatcccaacactttggttggctaaggtgggaggatttcttgcggccaggggttcaaggctgcagtgagctgtgatccaccactgcattccaggctgggcatcagagtgaggcctctctctaaaaaaaaaaacccttcactccccaaaaaaagggatttgcaaataccagcctttcagcatgaggatcacatggaggaacattaagatacagatgctgggacccagccctattgattgtaattcaaaaactgagggggggcctgatttacctccatcattggaatccattccgatttgaaactctctgggttggacagttcaagagagatcctaaagaaagcaaaatcact

SEQ ID NO: 11063 - DNA, 458 bp, Homo sapiens
ggcacgaggagagagagagagagagagagagagagagagagagagagagagagagagagagagagagagagagagagagagagagagagagagagagagcgagagagagagagagagcgcgagagagagagatatatatatatctctcgcgctcgcgcgcgctctctctctctttttttctcttttgcgcgatttctctcgcgcccccccttctctctctctctctctctccctctctctttctctctctgtctctcactctctctctttctttttttttttatacactctctctctctctctctctctctccctctctctctttgtttctcccgcgagatctgtgtctcttctttttgggaagacaccctctctctccgccccctctttgcgcctttttgagatacccccccccctctctttcctcttttttttctcgggggcttctcccgtctttt

SEQ ID NO: 11064 - DNA, 391 bp, Homo sapiens
tacggctgcgagaagacgacagaagggacaataccgcattataaagattgtgagaggtagctgtttgttaatgtccaaatctcaaccaaagagtacaatacatacaaaatattacagtgacatggcctaagtaaaaaaaaaaaacttaaaactgtcggaaaacacccatgaaaataaagaggtccacattaattttaaaaatttaacctaaatgggaacacaggtacctatttaaattcggaaaaaaatagaatatcaggtaaaggatgaaaaatatattagaatttatggaggtggaaaatggaaatagaaataatccctgtggccaggtgcagtggctcatgtctgtagtcccagcactttgggagttgaggcggcagacacttgaacc

SEQ ID NO: 11065 - DNA, 391 bp, Homo sapiens
tacggctgcgagaagacgacagaagggggatagcactttatgacaaaataggactgatttttaaatttagcagaattatctatggattgtctagatctcagctgatattaaaatataactatattcaagtatttcattagattaaagagcagaggataaggctgaatttaaaaattttatatctcggcccggtgcagtggctcactcctgtaatcccagcactttgggaggccgaggcaggcggatcacttgaggtcaggagttcgagaccagcctggccaacgtggtgaaacaccatctgtactaaaaaaacttcactgggcgtcttggcgcacgcctgtaatcccagctactggggaggctgaggcatgagaatcacttgaacctgaga

SEQ ID NO: 11066 - DNA, 456 bp, Homo sapiens
tcttttggccgaagcggcctacggctgcgagaagacgacagaaggggtctgttggattcaaaattttgtaagccattttcacaagtacaaagatacattttaaccttgtcttctccaaaattactgagtaggaattttatttttatctttttgagacggggtatcactgtcacccacactggagtgcggtggtgggatcttggcttactgtgacctctgcctcccgggttcaaatggtcctccctcctcagtctcctgagtggctgggacggcaggcgcgtgccaccatgcccagctaatttgttctattttttctgtagagacggagttttgccatgttgcccgggctggtctcagactcctgagctcaggcgatcatttcgcctcggcctcccagagtgctgagattggaggtgtgggccacagcatctggcccagagtgaggagaatcatgag

SEQ ID NO: 11067 - DNA, 385 bp, Homo sapiens
  misc_feature 385: n = A,T,C or G
tacggctgcgagaagacgacagaagggcattcattatcaggaagttttagttatctgtcatttttttttttcacatcagtttgatcaggaaagtgtataacacatcttaaagcaagagttagtttggtattaaatcctcattagaacaaccacctgtttcactaataacttacccctgatgagtctatctaaacatatgcattttaagccttcaaattacattatcaacatgagagaaatcaccaccaaagaagatgttcaaaataatagtcccatatctgtaatcatatctacatgcaatgttagtaattctgaagttttttaaatttatggctatttttacacgatgatgaattttgacagtttgtgcattttctttatacan

SEQ ID NO: 11068 - DNA, 383 bp, Homo sapiens
tacggctgcgagaagacgacagaaggggggtaagggatgttcacttcagaagtcattggggagtttccagcgatgtcacatctgactaccccggcatggatatatagaatctcttggatcataccatcctggctctgttccagatttagtttgcttgtttgatcttgagtatttttgttttgttttgtttttgagacggagtcttgctcggtcacccaggctggagtgcagaggtgtgatctcggctcactacaacctccacctcccgggtttaagcgattctcccgttcagtctcccgggtagctgtgattacaggcacctgccatcatgctcaggtagtttttgtatttttgtaacgacggggtttcaccacgttggccag

SEQ ID NO: 11069 - DNA, 381 bp, Homo sapiens
tacggctgcgagaagacgacagaagggggaagagaggccactttttctgcatttctctgagccctccctggggcaagtgtcctctcacatcatacccatctctacccagcagaaggctctcactcaaggactgtcaaggataactaattcaagacccatcccacccactaggtgccaaaaagctagcaagtcagctacctaataggtgtcttttgagacattcaacacacatagatttaaaatatacaaaacaggaaactgtctttacatggtagtctttcaactaaaatgggtacaagatcttaaatttgttgccatcaaggtactatacaatgaaaactggtggtcccagggatgaccctgaaatactgtgaggtcctg

SEQ ID NO: 11070 - DNA, 386 bp, Homo sapiens
tacggctgcgagaagacgacagaaggggagaagatgagtgtaatacccttgagcacacagggtgggacaccacaaatgctcaaccaacagcagcgatgacagtataggcaactaccacaagaaagaatttgaacatgtcccaattcgaattttgattcctaatcaagatctagtgaatttaacctaagtagcagaaaagaagattaagagtccctttccacagctttattaagtttttatattcacctggatgttgtcaaaagtgacttgatcattcaagagataagggacatttggctttcggttgtgtgagagcttttcttttcccatcagcttcacagtcaatccccagatctatagatggagagcttgggaccaggtcacaa

SEQ ID NO: 11071 - DNA, 391 bp, Homo sapiens
  misc_feature 253, 321: n = A,T,C or G
tacggctgcgagaagacgacagaaggggcctaggctggtctcaaactcctggcctcaattaatcctcctcccttggcctcccaaagtgctgggattacagggatgagccactgtacctggcagccttgagcgatttctcacctcctcattggcccagtttccttatctgtaaatgagagtagctgtaaaatatggttaatgtgaggaccaaacgggtcaattagggaaaagcagtgtctctgccagctaattntattattattattattttttttttttattttgagaaggagcttacttgtctccaggctggagtgcagngcgaagactcgctcactgaagctccgctccaggtcacgcattctctgctcagctccgagagctggatacg

SEQ ID NO: 11072 - DNA, 380 bp, Homo sapiens
tacggctgcgagaagacgacagaagggaactgaggttctggaaatgtaatctacttttaagaatcaaccacacctgtgcctcctccagaaaatctttgtagtgcatgactcttaccaggcgtatatgtagaggaaaaggtcaaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagacggacagacaagttggcaggtgctccttgagtctcatggagagggggtcactttctc

SEQ ID NO: 11073 - DNA, 407 bp, Homo sapiens
ggcacgagcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaattttttttgtcccatcacaatttttcaaaacaagggcaacccttatgtttgggaaccctgttttgttaggcaaagttacaagggacctaaggggacctaaaaggggggggggcctttttgggggttggggggggggggggcactaaaaaccttaaacaccctaaaacccggggggggcatcccgcctttgccataagcaggcctaaggcataataaaaggacagggacacccttcttgacaaaccaccttgatttgggg

SEQ ID NO: 11074 - DNA, 441 bp, Homo sapiens
  misc_feature 431: n = A,T,C or G
tacggctgcgagaagacgacagaagggcagacaaatatatcacaaataacctatataaattcactatatgaaaagcaggccaacatttccaccccatccttcctctttcccccagctctggatataaaacacatatttttcagttagattttttcagttaagtgattactttcaattcccctgtttttggcatttaaaaatgttcacttcttattgcaagacagggacagtctttaaagatttttctgctcaccaccactaccaaaaactaataacaaattttgtcttcatggggaagaaaatcttactcattcttgagatttcacagccatgtctaaagatctaggctatataagaagagaggaatgccttagaaatgtaatgctgttttcctacggaatcaattctgtagaaatagaaccatggtgatncagagtacct

SEQ ID NO: 11075 - DNA, 390 bp, Homo sapiens
tacggctgcgagaagacgacagaaggggtagtcagattaagattgctagaggtgaggtcaagtaaactatgaggccatgatactgtattgcacttctacctaacattgaagtcacccagggtgatggcaggactaggggtggagaggaatactggggttagagtccttggtaaagggcagtgaggtaactggcaggatggtaggtagaagaaatgaggaaggacagagaatgacgtagcggaatagccaagacttttgcccaaggtctctgaaataaaagtctggaagcagcattggtgagcagagggtactgacctccccactcctcccttaggtgtgtagaatatgagagaacgatttagccttcatttagcaagttccacagggaaa

SEQ ID NO: 11076 - DNA, 457 bp, Homo sapiens
tcttttggccgaagcggcctacggctgcgagaagacgacagaaggggggcagggatgctacccacaatatatgcagaaccccagatggagcctgtgggagagagaggaaattaccgtcttcactgtaggcaaaggagaatggctgtgattagccatatatgcctataagaaggagcagagccatactgtccttgtgggttgggagaggggacacagaatccagggcaattgtctgaggtctcaaagtaagttaagccagagtcaaagccaaactccaagtcttggccaaggggatgagaaaagcaaggagctagtcttataggtcaaggaagatgaggtatagttaagagtcatcagtatcacagaacaggccagcagggctttattaggtatgtagaactattataaaccaggatctttggagatataatatctgctggcagacctaaaaaaaatg

SEQ ID NO: 11077 - DNA, 401 bp, Homo sapiens
  misc_feature 366: n = A,T,C or G
ggcacgaggagagagagagagagagagagagagagagagagagagagagagagagagagagagagagagagagagagagagagagagagagagagagagagagagagagagagagagagagagagagagagagagagagggggtgtgcgcgctctcattctctcgtgtgtgcacacactctctctatatatatgtgcacacactatttttttttgttctctctctccctctatatgtttttttttttatacacacacatatatacccccctgtgttttgtctctctctctctaaaaaacacactttttttttttttctcagcgcgcgagtttttttctcaagagaaaaaacactctcacacgtgtntgtgtggagggggtctcttttatatacactccccc

SEQ ID NO: 11078 - DNA, 383 bp, Homo sapiens
tacggctgcgagaagacgacagaagggggagcattagacagtaaccctcaaggagctagagaaccggatgggagacatgagcagtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattcccctcctttgactacacacacaaccacagtgtggttctaatcatggagatatcagtaatttttagtaactgaa

SEQ ID NO: 11079 - DNA, 398 bp, Homo sapiens
ggcacgaggaacagagtcagcaaaagtagagcatgtggaccacgctgcccgcttctggtgcctgaagcagacatcactaatcgatcgttcttctgaggattgtctgttcatcccaggtggtctagtctgcctggatcagatgtccttccctgctgctgttgggcaggcagctcagccttttggctccagccagtgagtctcaaccaggggcagttttgacccgcagttgtcaatgcctggaaacacagtgatcacagctggcttggggagagattgctctgggcatctggagggtaaaggcccagatgctctcaatgtcctacagcgcacgggatggcccctcactcctcccaacccacagcatccacagtgctgagattgagaaatctgtgctaggc

SEQ ID NO: 11080 - DNA, 384 bp, Homo sapiens
tacggctgcgagaagacgacagaaggggggagaagaggagcaagggtgaccttggggcaaagggcggccaggagagagactgtgccggcagagatgagtgtctcagtctcagggcttttcagagtacccggcggggcccctctttttctgattacttatacttcaagcacagagatgagagtttgaaagaattactggagaggaaaatggaaaaacaagcagtgcttttaggtatctaagtggacagttttaaaagtacatttggaaaatgagaacgaggcagttcaaatatagctttctgcatgaactgtcattttctggagactggcgaatagtaccaatctctacaaatggcttagactaaatgagcagggatgtaggtgg

SEQ ID NO: 11081 - DNA, 417 bp, Homo sapiens
  misc_feature 370: n = A,T,C or G
cgttgctgtcgcaaggaactgaaggacatctggcaatgtactgagtgaggaactgaggcccacagtccagcagtctccaaggaatcaaatcccacaacagccatgtgagtgagcatggaagtagatcttccccggtcaagcccccagaaggacccagccctgcggacaccttgaccgaaacctgtgagagctccggaaatagaggaaccagcattccctctggaatacatcagcactgttgcctttgaggctggcctgcttgaatgcacacctgagctccggattcacaggtaggtgtgtgacctttcttaacttctctgggcctcagcatactcctttttacagtgggaataacaatagcacctctcancacaagttctggagggagtcgaaaaattggcacaggcaagcactcca

SEQ ID NO: 11082 - DNA, 403 bp, Homo sapiens
ggcacgagctttcctggccagacacagtggtcagtcctgcaatcccaacactttggttggctaaggtgggaggatttcttgcggccaggggttcaaggctgcagtgagctgtgatccaccactgcattccaggctgggcatcagagtgaggcctctctctaaaaaaaaaaacccttcactccccaaaaaaagggatttgcaaataccagcctttcagcatgaggatcacatggaggaacattaagatacagatgctgggacccagccctattgattgaattcaaaaactgagggggggcctgatttagctccatcattggaatccattccgaattgaaactctctggggttgacaagttcaagaaagacctaaagaaagccaaacactggggacctgaatgac

SEQ ID NO: 11083 - DNA, 425 bp, Homo sapiens
  misc_feature 365: n = A,T,C or G
cgattcgaattcggcacgagaaataatcagctaatccaagaactgggtcctaaagcatacacatgcacaaacacatacgtgcacacatacatatgaacacgtatatttctattcacaaaccaaacttgcttcaaccgccacctccatattcatgccatcgggaagagctgctatcagcagcttcacctgtatgaatttcacaaggcttcactttcaccccagagaacatgtttctatactcatcctagcagaagaaatcagaacgtacagagaacccagatgtcactcttcagacttcaacgctcctgtctccatcacagtaaagtcccctggcattcttctctatagcctgtttggggtggggntaacagttccccaattctctcctcctgcattaccccacaccaccaaacaacccccacact

SEQ ID NO: 11084 - DNA, 397 bp, Homo sapiens
  misc_feature 397: n = A,T,C or G
ggcacgagaaataatcagctaatccaagaactgggtcctaaagcatacacatgcacaaacacatacgtgcacacatacatatgaacacgtatatttctattcacaaaccaaacttgcttcaaccgccacctccatattcatgccatcgggaagagctgctatcagcagcttcacctgtatgaatttcacaaggcttcactttcaccccagagaacatgtttctatactcatcctagcagaagaaatcagaacgtacagagaacccagatgtcactcttcagacttcaacgctcctgtctccatcacagtaaagtcccctggcattcttctctatagcctgtttgggtggggttaacagttccccaattctctcctcctgcattaccccacaccaccn

SEQ ID NO: 11085 - DNA, 384 bp, Homo sapiens
  misc_feature 303: n = A,T,C or G
ggcacgagggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcgggggctctggattcctggngcagcacatggtggagcagttgctggcaagaggatatgctgtcaatgatttgatatcagcaagggttgatatccccaagtg

SEQ ID NO: 11086 - DNA, 385 bp, Homo sapiens
ggcacgagatgacttgccctttgttcctagctctgtgcctggcctcagaggagagccttggtgcacgtttgactttttaatctttatttgaacctgttacacaccgtcacccccactgctctgcttgccacagacatggaaggttcactaaggccttaaggcactcatgcaagctcacaagagaaagaaatctgtaaggcatgtagaatttggactcaatcatgttggtctttaatgtgcctagagcaatggaatgggcactttgggggcggtggaattcaagacgctctggctgaagattcagaagtatctggtaactctcttttccttctgggcatcctctcctctgttctaatcctcccttacactcattcctggtccattg

SEQ ID NO: 11087 - DNA, 433 bp, Homo sapiens
  misc_feature 368, 397: n = A,T,C or G
cggcacgaggggcactggaggcacgcctagaggaggctcagcgggggcaggcccgcctggtgcaggagcagcagacactgaaccgggccctggaggaggaagggaagcagcggcaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgtgccagtgaggctgagaagacctcttgaggactgagccgacttcaggatgagatncagaggctgcggcaggccctgcaggcatnccaggctgagcaggacacagcccggctggacatata

SEQ ID NO: 11088 - DNA, 460 bp, Homo sapiens
  misc_feature 360: n = A,T,C or G
cttttggccgaagcggcctacggctgcgagaagacgacagaagggcaaccaagaagaaggggaatccgaggcggagggagaaactgaggcagaaagtgaatttgacccagaaatagaaatggaagcagagagagtggccaagaggaagtgtccggaccatgggcttgatttgagtacctattgccaggaagataggcagctcatctgtgtcctgtgtccagtcattggggctcaccagggccaccaactctccaccctagacgaagcctttgaagaattaaggagcaaagactcaggtggactgaaggccgctatgatcgaattggtggaaagggtgaagttcaagagctcagaccctanagtaactcgggaccaaatgaagatgtttatacagcaggaatttaagaatagtcagaaagtgattgctgatgaggagcacacggcccttcatctatggaca

SEQ ID NO: 11089 - DNA, 404 bp, Homo sapiens
  misc_feature 362: n = A,T,C or G
cccatcgattcgaattcggcacgaggagagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaanatagtaattgctaccaacattgcggagactagcattaccata

SEQ ID NO: 11090 - DNA, 352 bp, Homo sapiens
tacggctgcgagaagacgacagaagggcattcattatcaggaagttttagttatctgtcatttttttttttcacatcagtttgatcaggaaagtgtataacacatcttaaagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatg

SEQ ID NO: 11091 - DNA, 370 bp, Homo sapiens
tacggctgcgagaagacgacagaaggggcctaggctggtctcaaactcctggcctcaattaatcctcctcccttggcctcccaaagtgctgggattacagggatgagccactgtacctggcagccttgagcgatttctcacctcctcattggcccagtttccttatctgtaaatgagagtagctgtaaaatatggttaatgtgaggaccaaacgggtcaattagggaaaagcagtgtctctgccagctaattttattattattattattttttttttttattttgagatggagtcttactgtctcccaggctggagtgcaggggcgaaatctcggctcactgcaagctccgcctcccagggtcacgccat

SEQ ID NO: 11092 - DNA, 360 bp, Homo sapiens
tacggctgcgagaagacgacagaagggaactgaggttctggaaatgtaatctacttttaagaatcaaccacacctgtgcctcctccagaaaatctttgtagtgcatgactcttaccaggcgtatatgtagaggaaaaggtcaaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagacggacagacaggttggcaggtgctcctggagtctcat

SEQ ID NO: 11093 - DNA, 364 bp, Homo sapiens
tacggctgcgagaagacgacagaaggggagaagatgaatgtagtacccttgagcacacagcgtggtacaccacaaatgctcaaccaacagcagcgatgacagtataggcaactaccacaagaaagaatttgaacatgtcccaattcgaattttgattcctaatcaagatctagtgaatttaacctaagtagcagaaaagaagattaagagtccctttccacagctttattaagtttttatattcacctggatgttgtcaaaagtgacttgatcattcaagagataggggacatttggcttccggtttgtgtgagagcttttctttccccatcagctcaacagtcagtccccagatctagagatg

SEQ ID NO: 11094 - DNA, 379 bp, Homo sapiens
tacggctgcgagaagacgacagaaggggcttatcctagagaataactctgtatgaataaaattgcttaattgagtctcttactaaataagtaactagtgccatgcttttgtgagctcttggtatggcccatattaccttgttttttgtttttgttattgttggtttgtgatagacttgctctgtcgcccaggctgcagtacaatggcacaatctcagctcactgcaacctcttgctcctgggttcaagcaattctcctgtctcagcctcctgggtagctgggactacaggtgcatgccaccatgcctggctaacttttgtatttttaatagagacaggggtttcacacgtttgtcaggctgggctcggacttctaactg

SEQ ID NO: 11095 - DNA, 379 bp, Homo sapiens
  misc_feature 379: n = A,T,C or G
tacggctgcgagaagacgacagaagggccaggaccagactgttctaagcattcacatatataaactagtttctcaaacaacactgtgagatagatactactggatttcatagattataagatgtacattttaacatctctgagggctatgtcttatgatatggcaccatacagttataattgccagcagtttttcttagagtccatacaataagattgagaactagtgatgtcttaaatttgactttttttaaaaaagcgacatccaaatttataaatgaagaaacagaaatgcagggaggttaagtggcttgccccaggttgtgcagtcaggaatagcatagagttaaaatgcaggaggtctgcctttgtattctctn

SEQ ID NO: 11096 - DNA, 360 bp, Homo sapiens
  misc_feature 360: n = A,T,C or G
tacggctgcgagaagacgacagaaggggggaggattgcttggtgtgtgtggaaaacaccctgcacatctggtcacagaattattccatattgattgttgttgtgttgtgtgacagacaatagaggaaaagtttatttttttctacacatatgctatggcttcccttctattattccatatctttcaactcctgccatactatttctttctctccaagtttttgttcttcctcagagttcccataaatggaaaggatacgcacttcattgaaataagaatttcatgttagccaagttttcaggatagccatgagtttcacttaattatctgagaacttagagcttactgtcctctacttan

SEQ ID NO: 11097 - DNA, 363 bp, Homo sapiens
tacggctgcgagaagacgacagaagggtaggtctaagaacaggtcaatggtggtttaacccagtggtggttgggttaaaggagtggggcaggtaaggaggttgtggacaaaatgaggaacttgaaagtttaaaatcctgaaactaatcaaaaaggttggccatctcatagggagccaaaagtcacaaaatcaggtatgtgtggtggtgcatgcctgtaatcccggctacttgggaggctgaggcaggaggatcgcttgagcccaggagtttgaggctgcagtgagctatgaccactgtgaatagctactgcactccagcctgggcaacacagtgagaccccatttcgaaaacaaacaacaact

SEQ ID NO: 11098 - DNA, 353 bp, Homo sapiens
aaaaaggaaagaaaaaagaaaatgcctagcttattaatgaataagtgtatgatcctatttaaaaatacagtcttgagtgataaatttagaatggacaaaaacacaattatttgagtcaaattgaaggttctctatagctttgggcaagttgcttactctcccaacttcaattttgtcatctattaaatgaggacaatactaccttccttgcagggttattgagattaaatggggtaatattagtgaggtggtttgcaggtgcctagcctgttaagtaaaatctcacaaatagcctaaaccatttacttagaaaatttaaaacatccagtatatcttatttaaatagctgtggt

SEQ ID NO: 11099 - DNA, 376 bp, Homo sapiens
  misc_feature 224, 376: n = A,T,C or G
tacggctgcgagaagacgacagaagggctatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacattnttttctgccattttcttttgcaattgtagttttatgtaccggtaaagaattgtattgaattctttttagatcaaaagaaaaataggtcagcagagattcagtttcccaggcttaccagaaccgccactcatgcatgtcagaggatcattatn

SEQ ID NO: 11100 - DNA, 345 bp, Homo sapiens
tacggctgcgagaagacgacagaaggggccatactctattctttagaggtgagtctctaagaccagcccacagtcaaaaggagggtaattaagctctacctcctataggagggagtagctaccttatttggagttatattaaaattattatttatgataactatgaaataatatagtattgtactatacaataatcactagtaaggaagatttgatagaacatttttaatctaacagatttacaacagtccaatgtttgaaaacaaacagcaagactgtatggaaaacaggtacttccatattgctggtaggagttaaaaatggaataatccttatagaggagaa

SEQ ID NO: 11101 - DNA, 377 bp, Homo sapiens
tacggctgcgagaagacgacagaaggggctaatggagccttcttatttggccctttgtggagtagacatgggattattttgcagtttttggatagcggggttgtcaacatgtgttttcaaatatcacaacaaaagtttgggactttgaggtggcaggggaagaaacttagtaattgtttttcttatttaaaaaaaattttttttcttttttcttttttcttttttttttattctaagttctcggatacatgtgcagaatgtgcaggtttgttacataggtatacatgtgccatggtggttatttaaaagtttttggagacacagtcccactctttcgcccaggctggaatgcaggggcacaatcttgactcactgca

SEQ ID NO: 11102 - DNA, 375 bp, Homo sapiens
tacggctgcgagaagacgacagaaggggggcataaatttagactttctgatgccaactagctaacaatatgcttatagaaagatttaagtcctagctaagtattctccttatggaaaaaaagaatgtagttatgtaaaagacaaatgagttgagcctccaacttacagattgttgaatgttcctattgtccaggcgggttggggctgttggtcgatggtgccaagcctgaacaagcccaccactgtgctgggatggagagggaatctcatccacccaccatgaacgtgctggagaaaacagcctggagcgctgcattgtcctcctcaggggtcaaagagtcacaggaggaatctttctgttgattcatagatagg

SEQ ID NO: 11103 - DNA, 364 bp, Homo sapiens
  misc_feature 364: n = A,T,C or G
tacggctgcgagaagacgacagaagggcaacccagctggagattcctgtcgggaatgcttgggataggacagctgtgagggagcccctggggcataggaaaaccctcacagttccagaaaaaacagaaaacgcatgcacagtttttctcggttaatcaaagtcaaattccttttcccacaactgctggggtgccagctgactggcaggatggaagaaccaggatggcaccaatcaaaatccgaaaaaggcagggtccaaagtcattcctgggttttgttgtttaatgtcatcggaagtgggccgtgacagcaatctgcccaccacttgcccattcaggtcctcttgcctttcatactgagaatn

SEQ ID NO: 11104 - DNA, 364 bp, Homo sapiens
tacggctgcgagaagacgacagaagggatacagatgagggctttgctgatcattatctggaaacagtgatcactgtcccattcacagatggggaggctgaagcctgggagatcaattcatgccaccaagatcagctgcaggccgggccacccatgcctgaggggagaaggggcctctcttcttcacgaggctggtggctgcggcacctacaaagacaggttaacaagaggaccctctgcctatcacgagcctggtggctgccgtacctgtaatgaaagacaagttaacaagagggccgtgcaggcttatttacgagaagttccatgtgacacaggagccttgagaatggaacacccatcgaacc

SEQ ID NO: 11105 - DNA, 351 bp, Homo sapiens
tacggctgcgagaagacgacagaagggcattctctcatgaaaacatttgattctgatcaaagcactgattagggaaaaatgttaccttgaaacaatttctatcagtcttagttctgtcctttataggaggttaactgaaggattccataaaaatggaggcaaagaaatttaacagatttggtcatgatacataggagcaaaatctcacattttcaactgctgcatgtccgcataaacaagccctctaaagataccttttttttttcttttgagacaaggtcttggtctgtcgcccaaactgaagtacaggggtaaaatcacagctcgctgcaggcgcaccctcccaagcta

SEQ ID NO: 11106 - DNA, 338 bp, Homo sapiens
  misc_feature 338: n = A,T,C or G
tacggctgcgagaagacgacagaagggggaaggtctacacccttgtttccccactgaaacattaaataaaatatctgcagatatactaaaatgactttatatgagctctgaaaactagtcaaagatctgcagccaccaagtgaattcccactgaaaaaagccacagtcaaacggtgggaaattttgtggtgtttttactcaccccacctcaccccttccactgtggtgtagttgggagaaaatgtcctaattcctagtttcctccctggagctaggaggagaagagcacaacatactcgcaatgttctaacttgtctgtgggctttccacaggatggn

SEQ ID NO: 11107 - DNA, 367 bp, Homo sapiens
tacggctgcgagaagacgacagaaggggttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgat

SEQ ID NO: 11108 - DNA, 374 bp, Homo sapiens
  misc_feature 339, 374: n = A,T,C or G
tacggctgcgagaagacgacagaaggggccagttaggaaacagttaaagttgacccaggattaaatcaaatttggaaatagggggaaatgttctccacatggacagcaagtcacccatttgtgcatgcttttgccccagctagacacatctcccacatctctactgctaccacctggtctaagctaccatcatcttttccctgggccactgtaatatgctcccaagctataaaatataaaagctctgcaggccattatctgcttactcccctcattcactacactccagccatattgacctttctttttgtttggttggtttggtttgtttgagacggngcctcactctgtcatccaggctggagtacagtggn

SEQ ID NO: 11109 - DNA, 361 bp, Homo sapiens
  misc_feature 361: n = A,T,C or G
tacggctgcgagaagacgacagaagggactcttggacacggtttccaatttgtcagtttgtcttcacctctccacaaccacactttgtttccagaaaaacaaatatacactacgcctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaan

SEQ ID NO: 11110 - DNA, 363 bp, Homo sapiens
  misc_feature 353: n = A,T,C or G
tacggctgcgagaagacgacagaaggggtctgttggtcagatacagtattttgatgatttcaatcaataactctgcaagccttggtgttattactggtgtctttttctgtctgctttcccccacccccgtccccacattttatttgctttctcaaaagcatctgcacacagatacacgggtggacatcctcagaggcagggtgactcagccgaacagaaccctgcaacatgcactggcaaaagtgccccacccagcgtcgaacacccgaccttgtcatttacccacgggtgctagcacaatcagtgtgctatgattgaggggcggctcttccccctgccaactaaaccctggngaaaatgaac

SEQ ID NO: 11111 - DNA, 377 bp, Homo sapiens
tacggctgcgagaagacgacagaagggggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacgagtccattcaaatgacaaatcagacattttccacagtagaaaatctgaaaccaaacacgagttatgaattccaggtgaaacccaaaaaccg

SEQ ID NO: 11112 - DNA, 352 bp, Homo sapiens
tcgattcgaattcggcacgaggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagaaatccagcaggagggagcgaagcccaccgcgacttgcccttcactgatctgccagcctacttcggcg

SEQ ID NO: 11113 - DNA, 440 bp, Homo sapiens
  misc_feature 315, 390, 404, 422: n = A,T,C or G
tacggctgcgagaagacgacagaagggaagggctggagatactggctttccatgggtactggtgtgatgacactgatctgaaggcactgcaaagttttagattcttgagtgtacttgttaaataagacaaaacaaaagagagagaaaaaaattagaataaggcagtaagtttgtattgttataatgaaacattgtaacactctaggtattatctctgcactgacatagaataaaaataaactcataagatgaatcaaaaaatggaacaagagctgaagcaataatcatagtcttaaaagttgggaagagactttntgcccaacccataaatttcactgagcccctaaaaaagaggacataattattagaaatgactccagattatacatntgactcttgctctngtcttatatttttgtggngtttaagcaagtctgtac

SEQ ID NO: 11114 - DNA, 440 bp, Homo sapiens
  misc_feature 236, 440: n = A,T,C or G
tacggctgcgagaagacgacagaagggggactacattaataagacttcccatgcattgatgctgaaacatctgaacatgctatttgatgacatgaagaaatggttcatcctcttttttgcctgccagaacacttgacggtattaaaaccagcctggctgtccctttctcttgaaggaggatctcactcccttaggaggtgatcgtgccttccttctatatcatatgcatacatagntcttattcctttgctgtaattttagaagccctctactttaaacaactaagcttctgagaggctcttcttaagctcatttcctcacgagtttcaagtgactaagaggtctttaagcttgtagccctcgatgcagtcaaggaatgcaagttgttctttgaagcatataactgatatgccctgctgctgatgtctaggtatcttttn

SEQ ID NO: 11115 - DNA, 438 bp, Homo sapiens
  misc_feature 362, 438: n = A,T,C or G
tcgaattcggcacgagagatactacatttagaactttggggtccacgattctatttgggggtgaatagggcattagatttacagttaggagacctagattctagacagatttctcattaactacatgttacggaacaagttatttaacctttttgggtctcagtttctttatatatcaaatgagatttcagctccattataatactctttgatcctccttctcacatgatatatcaatttagctacctacttatttcaaattactgttgggcacttgcgcttagtgggattcttaatcctgatattcagaaaattgtgttggagtgtagcacatgtgtttgatttatgccaagcattaattntgtgtattgattacatttatgactttatttcttcatgtgggattgttttgaaactgctgcgaatatgttgactgtn

SEQ ID NO: 11116 - DNA, 625 bp, Homo sapiens
  misc_feature 350, 351, 511: n = A,T,C or G
tacgtctgcgagaagacgacagaagggcctccccagtcgctgggattacaggcgcccaccaccatgtccagctaatttttgttatttttagtagggatggggttttgccatgttggccggtctggtcttgaactcctggcctcaggtgatccacctgcctcaggctcccaaagtgctgggattacaggagtgagccactgcacccagccacgtccctcttttaaagacccttatgattagtgggcctacccaaatgatccaagataatatccctaactcatcagccttaattttttatcttttatttttttgagacagggtcttgctttgtcacccacgctggagtgcannggtgtgatcataactcactgcagctttgactttcttggctcaaatgaccgttcacctccagcctccaaggaacttggatactgatgggcatgaccacacctcgctttttgtttgttttgttttgagacagagtctcactctgttgcccagttgaaggcanggggccatctcaagcactgaacttccccttccagtcaagtgatctcctcctacccttctagaggtggtatccgcccagcctcgcccacttatttttttcttaaaaatgggttcg

SEQ ID NO: 11117 - DNA, 222 bp, Homo sapiens
ggcacgagggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgt

SEQ ID NO: 11118 - DNA, 461 bp, Homo sapiens
cttttggccgaagcggcctacggctgcgagaagacgacagaagggggacaaataggaaaatggtatagctttgtacctaaaaaactgacttcatccttttatgggaggaaaagatctatatgcttcagaaagccaaagatgtactgagaatcttcactaaggcatttcctacagtaaaattgatgatcgcatcccaagcttgatcagatgtcatggcttttgttttcttagacgttgtcacaatctaacatagtcatgtgactctagtgtactaagggctttcatgggtgttaactcatttattagacctagcacgcaccggacttcttaattattttacagctgtttcttggttttgattctaatttttaaagacactcacagtctgaaaaataataatagtattggtacatttctaaatggctagcggcatcttttagctgataagactgagtagctgg

SEQ ID NO: 11119 - DNA, 439 bp, Homo sapiens
  misc_feature 367, 373, 434: n = A,T,C or G
tacggctgcgagaagacgacagaagggaatcacagcatttcatggcatttgactgataacattcgaataggaggtaagtaactttgtatgttggaaagagaaagaatcatacagaaaaaaagtcagggccctgtgttctagttctggctctagagagtgttggctctaatcatttgagaattggcactcaccatgtgccactggagaaggcccttcttgtctgtggatgcagattctccatttgtaggcatcatctcacctgaatgtctaggctgctgctcaatgtgttggcccaaaatgctgcactatcacaaaactctccagttacattcagtgtgccacaaaatagaccgatcctctctacacnacccanatgtatgattgatactaagttgacagagtgttccataccaaacatggaatgaacattgganggttt

SEQ ID NO: 11120 - DNA, 432 bp, Homo sapiens
tacggctgcgagaagacgacagaagggtggtgaaactccacctctactaaaaatacaaaaattagcagggtgtggtggcatgcacctgtaatcccagctactcgggaggccagggcaggagaattgcttgaatccaggaggtgaagcttgcagtgagccaagattgcaccactgcactccagcctgggcgacagagggagactccatctcaaaaaaaaaaaggccttttctggttttttgggggggggataaaagggggaaatttggtaagggggctttccccggtttgcttttaaaaaagggctttgatgggccgggtgcgggaactaatgccttgaacccaaactttgggaagggccggggggccggctccgaggtcggaaaccaacacctcctgtttacccgggaaaaccccgttttacacaaaaaaaa

SEQ ID NO: 11121 - DNA, 427 bp, Homo sapiens
  misc_feature 198, 283: n = A,T,C or G
gtcggcacgagaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgngtaaaagatctgttcagagtacaagatggaccaatggatttgatatatttgaatataacagagtatgaaaaagttattgatatangttcagagtacacactgcaactaatctttaagaactattacttgtccacttttggggaaattcagagacaatgtcaccatattctgacagctattaaatactctctcttttccactacgggctgtcaaagcagatttttcatat

SEQ ID NO: 11122 - DNA, 415 bp, Homo sapiens
  misc_feature 217, 298, 380: n = A,T,C or G
tacggctgcgagaagacgacagaaggggacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgagacggngttttaccacgttagccgcgctgggcttgaactcctgacctcaggtgatccacccgcctcgatcgccattataacaatcanatggctgtcttcatggactggtacaaaacagaatatacaccatggacagacagaggctcagaacacacacactctacaccantgatcttgcaacctgacaaacagcatgagaaggac

SEQ ID NO: 11123 - DNA, 388 bp, Homo sapiens
tacggctgcgagaagacgacagaaggggaaaagtaatgggagatgaagctggaggtctaagttgacataagatataaagatgaagggcttatacttcagattgaaaataggattttatataaaccaataaaaaggaacaatccacaaggtttttaattagggtagtgacataaccaggtttatgtttggtaacaactcagcaaaagacagaatatggcccagagtacagaaaagtcagaggcagattaattagctaaggagattacttactaccattctctagtcaaggaatgaactaaactagcagcaatgtgcataacacaaagatagaactgagcggacttaggaattaggaaggaaaacaattctataggatttggtgataggg

SEQ ID NO: 11124 - DNA, 408 bp, Homo sapiens
  misc_feature 339: n = A,T,C or G
atcccatcgattcgaattcggcacgagcaaggctgcttccccctgcagctgcccagctggcatctgatcaagctctgcctgaacttcagtacagccagcagggtgctgggctcagaataaatgcacagggtttgtcatgtatgtgaaaggcctggtctagtggccctgagggcgcctggaccagatgaatgttggccacagagaagaaagggatcagccctgccctctgcctcactgcaatcatgattcttggacccattttccagatgaggaaagtgaggctcaaagaagtgacttcacatgcccagggcaccacggagtggcagagctgggatttgnggcagtttgcttggccccaaagccctgctctccttccactctcttccattccacgccctccttcctatt

SEQ ID NO: 11125 - DNA, 391 bp, Homo sapiens
tacggctgcgagaagacgacagaaggggaaggacaggctgtgttacacgtagcactcaaatcttcgcttctaattactctcctgagattgcttgtacttcctggcccttctgggattgaggacttgctcattgtttgaatcttggacctttattccttcggaattagaaccataggtccccatgggctgatctcccatgtccattcccttctgctgtttgcgcaggtctaagacaatcacctcttccctcctcccacctcggtcttatctgtgacctcctactacctgaaatttgtaaactattatatacttttgttacaggaactgggtcctgctcaagaccccaagagagggttcttggatctcggacaagaaagaattcagggggagt

SEQ ID NO: 11126 - DNA, 388 bp, Homo sapiens
cgttgctgtccaaaatgctgcgattacaggcgtgagccattgtgcctggtcagagtgctgttttttataattggtgaacatacattgacacatcattgtcacctaaagtccttagagaatgtacagcttacttgtgtcatgggtcagggaatatcttaggttttctgaaagatgacacttaatttgggaaggagattccagcccagaatcatctctgctcaaccttgttttcttcacatgttaatgctattctttggccatccttggttcttgcctttgctttcagaaaatagcagccaaggtgtgaacaagtagatgggccagcaagggtggagtgaactggtaccagttactggggcccagtgtactggatgagggatggccagtg

SEQ ID NO: 11127 - DNA, 388 bp, Homo sapiens
ggcacgaggacacactcagggccagagcccgggaggagtgatgtggggctctgatgagaaggtggactcccggcggctgccatgggcactgcgcttggtcaagcgccctgctcttgccatcccgaaattccaaatcctcctgataatcctctcctcccccggtgttttgtaagtggtgccggagggcgtgtggagtctgggctgaggaggagcaagcatcgggctccctgctgtccttggcctccccgtccctgtgctccaggcttgcaatggacccactgagtttcctggggctcccgtaacaaatgaccgcaaacttagcagctaaaacgacacctgtctcctctctcccgtttctggagtcgggagtttgaggtgtctcaggctg

SEQ ID NO: 11128 - DNA, 391 bp, Homo sapiens
tacggctgcgagaagacgacagaagggggcccttcaacaaagggggcacatgcagatgagactccgtccaccccaggcagctttcctgagccctggaggacaggcttgaaatgactcctaggcttctggtgacccttgtcacctatctactgtttaggaagactggaatgggacctgagatttcgaattgctctccaactccctggtgatgctgaggctgctgtgcatgaactacatttggagctgcaagaatgcgtgacctatccaatccttcctctcatggaaacaccaactcatccatgccctctgtgctgaaacttcgtctcagcctgctggaatcacctgcaccccatgggaactgtagccatatcttcagtcctgtgagcccccg

SEQ ID NO: 11129 - DNA, 393 bp, Homo sapiens
attcgaattcggcacgaggcgcctcggaccatctcagatgccgagcttctggctactcttacgggggagggatcctgagtcaaaactattgaacttctccattcagaccgccactcacacctatgggaaaagggtgtccacgcagtccctggtctcacttgaagcagtccggagaaatatcatccctaccccaataatccccagaaggaacttacacttttttttaatcttttcctacaacttcatattttataaataaaaagacaaaaatgtcaggcctgtgagctgaagcttaaccattgtaacccctgtgacctgcacatatgcgtccaggtggcctgcaggagccatgaagtctggagcagccgaataaccacaaagaagtgaaacagt

SEQ ID NO: 11130 - DNA, 388 bp, Homo sapiens
  misc_feature 388: n = A,T,C or G
tacggctgcgagaagacgacagaagggggtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttctn

SEQ ID NO: 11131 - DNA, 403 bp, Homo sapiens
ggcacgagatcgtaactgcgaggactggggcgctggcaacagcaccctcgcctcgctgcagccggtcctacaggtcggggagcacgatctgcacttcgtctcaaagattcagcttttctcccgccccgactttctgggcgaccacttctctttcgaagatgaccaggccgctctgcccgcctccttccgacctcagtcctgccgggtccacggcggcagctggatcctgtttgatgagacgaacttcgagggtgaccagcacattctctctgagggcgagttccccactctcacggccatgggctgcctcgcctccacagtcctgggctctctccagaaggtatccctgcacttttcagagccttccattttcctgtatggactcgagtgcttcgaggggaag

SEQ ID NO: 11132 - DNA, 355 bp, Homo sapiens
  misc_feature 355: n = A,T,C or G
tacggctgcgagaagacgacagaaggggaaaaagatgggcctgaagtcatcccagtatgcaatagctgattatttgacaaagcatgtatcaaatagatgaaaatatcaaatagacgtgtgtgttaatagtcctcaacttccagtttagcctaggtgtatatttaaggtaggagatgatgacaatcatactcatattcactcttttagacttagaaggtttcttggaggacctataaattaacaattcttgtttttggaagggagaagactaagtggaccattgtaagtacttctcttagaactcaaaaaggccaagtcctgggtggcttggtaagttcaggattccctgggacan

SEQ ID NO: 11133 - DNA, 350 bp, Homo sapiens
  misc_feature 209, 270, 280: n = A,T,C or G
tacggctgcgagaagacgacagaagggttaactaaatttaactaaattaaatttatatttaatttaattaactggtgagaaagagcccatttcatttccttttaattgtgcctaatcacacctgtacattcatagcatttctagtcttggatgaatttattttaaactgtcaatgctcaaagtctcaggcctaggaaaagtcaggcagntagccctatgttggtttagctttaggcgtcacagttacagggcagagctactgaatggtangcagagcatnctttcaggaggatgtcatcagcccgcacagtggcagtgacctgcttcagccttgtgcagctaccagcatc

SEQ ID NO: 11134 - DNA, 357 bp, Homo sapiens
tacggctgcgagaagacgacagaaggggaaaagtaatgggagatgaagctggaggtctaagttgacataagatataaagatgaagggcttatacttcagattgaaaataggattttatataaaccaataaaaaggaacaatccacaaggtttttaattagggtagtgacataaccaggtttatgtttggtaacaactcagcaaaagacagaatatggcccagagtacagaaaagtcagaggcagattaattagctaaggagattacttactaccattctctagtcaaggaatgaactaaactagcagcaatgtgcataacacaaagatagaactgagcggacttaggaattatgaag

SEQ ID NO: 11135 - DNA, 372 bp, Homo sapiens
  misc_feature 372: n = A,T,C or G
ggcctacggctgcgagaagacgacagaagggtcagcctcccgagtagctgggattacaggcaggtgccaccacacccggctgatttttgtattttttgtagagatggggcttcaccatgttgcccatgctggcttactactactgatcctcagcggagagcactactcaaccccacaaatggctgatatcaacagaaatgagccgctgcgcacaaccagacaaactatcttctagaacaggagtaccaaatgacactcctgccagcaaactaaaaataagtctgtctgccaacatactactacaacggttggaattataattttttaaagcacgttcaggctcggcctagttgatcacacttgtaaacccan

SEQ ID NO: 11136 - DNA, 381 bp, Homo sapiens
  misc_feature 381: n = A,T,C or G
tacggctgcgagaagacgacagaagggttaactaaatttaactaaattaaatttatatttaatttaattaactggtgagaaagagcccatttcatttccttttaattgtgcctaatcacacctgtacattcatagcatttctagtcttggatgaatttattttaaactgtcaatgctcaaagtctcaggcctaggaaaagtcaggcagttagccctatgttgttttagctttaggcgtcacagttacaggcaagagctactgaatgttaggcagagcatccttccaggaggatgtcatcagccgccacagtgcagctgacctgcttcaagcctgtgcagcctacaagcatcacaggcctcttaccagactctccttcaacn

SEQ ID NO: 11137 - DNA, 375 bp, Homo sapiens
tacggctgcgagaagacgacagaaggggaaaaagatgggcctgaagtcatcccagtatgcaatagctgattatttgacaaagcatgtatcaaatagatgaaaatatcaaatagacgtgtgtgttaatagtcctcaacttccagtttagcctaggtgtatatttaaggtaggagatgatgacaatcatactcatattcactcttttagacttagaagttttcttggagaccctataattcaacattcttggtttttgtaagggagaagactagttggacaatgttagttacttctctgagatctcagagatggtcagctcctgggtgcctgtttagttcaggcattcccctgtgacaggatatgacagcacagtgg

SEQ ID NO: 11138 - DNA, 381 bp, Homo sapiens
tacggctgcgagaagacgacagaagggggagccaccgtgcctggcctacataaaggatttcattgaagatttgcaaatgtctgtgggctgggctgcctcaatttgaatcctgggtccgccgcttccctgctgtgtggccttgtgcaggttacacagtctatctgtgcatcagagtcttctgctgaaaaacggagctgataaaaaaaagagagagagagaaacggagctgatgagaatgactgttgcctcagaaggcttttgtgggaatccgtgggggtaaaaatgtgtaaggtgcaaagtgccttacacagatcccactctgactgtcatctcagatgaggaaacagaagttcagagagatggccaggcatggtggctcat

SEQ ID NO: 11139 - DNA, 373 bp, Homo sapiens
tacggctgcgagaagacgacagaaggggaaaaagacagcattgagctgggaagctcttcaattctctgtgcttttcccacattttgctgttgctcctggaaatacccacctctgagatggacactaaacaccagcctacagagttccttaaaatcagcggtctatactccagagattgaacaccactgggactttcattcttgctttcaagaccaaggaaaatgcaacttgtccagcttaacttggttttgagtttaagaatcttttctgctctggaagccacgtggttctgactccctagacctcttccaagaatttgctttggcattttgtggctcaaagatggaaagtcaggtgtttccattaattttca

SEQ ID NO: 11140 - DNA, 356 bp, Homo sapiens
  misc_feature 274, 282, 312: n = A,T,C or G
tacggctgcgagaagacgacagaagggaaatatctaatatattttttctaattaagaacaaataaatgaaaaaaacaagtgaaacctttaatttgcatataaataagggaattaacaccagcatctaaggttatgtcaatctgtagaagattaattctttctcaccagaatttggttccatgacatattcaagccatttatcaggcccagatattccactttccaggataagccttcacagtacaaaacatgaactggaccacccacttacgtngcataganggtctcttggttattttattcaaggccttnctaacctcgtgaggcagattgcacatacttactgtcataccaaa

SEQ ID NO: 11141 - DNA, 350 bp, Homo sapiens
tacggctgcgagaagacgacagaaggggatacaaaactccctcttgatggtggattagacaaaatggaagatatcccagaggaatgtgaaaatatttcctctttggtggcatttgaaaacctcaaggcaaatgtgactgacataatgctaatcttgttagtggagaacataagtggcctgtctaatgatgactttcaagtggaaataataagagatttttgatgtgctgttggtacctttccaaagcacctagatactataagatttggtgatgattggaccaagcaccattcaattaaacaacttcaggtttctccaagactttttggagtgacaaaaccatcagggtg

SEQ ID NO: 11142 - DNA, 383 bp, Homo sapiens
  misc_feature 383: n = A,T,C or G
ggcacgagagtcactcggttttgcgtgacctgattcaaattttccatctttgtcactttgattcccactctgagaagttttctcagtacatataaccttactatgtgatgactggcctgggtattcatatgtgcacttgttacctgttgcttatctcctgggggacccctggttcagaggggtttaagcaggtgtcctggtgagaccggggttataatcagagactctcagggttagagcttggccctgccactgagtggccttgggagtctcatttgacctctctgaaccttggattcctcacttgtgaaatggggacaggttgagttcctgcatggaaagtgtcttgcttgatgtctcgccaaaagaccaaaactgccgtn

SEQ ID NO: 11143 - DNA, 372 bp, Homo sapiens
tacggctgcgagaagacgacagaaggcctatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtaccgttaaagaattgtattgaattctttttagatcaaagtaaaaataggtcagcagagatttcagtttcccagggcttaaccagaaccgccacctcaatgcattgtcagta

SEQ ID NO: 11144 - DNA, 364 bp, Homo sapiens
  misc_feature 334, 364: n = A,T,C or G
tacggctgcgagaagacgacagaaggggccaacatcacatcattgactcttcctgagcttatgaacaaataaaaccgcaggtctccttcacaagaagctgactgctaaatatggtctgccctggtctgtgatttttaaatgagaatctatagttctggcctgaatttctatatttctcatgagaggtttgtgattatcaaacacaccatagtatgaaatcatcagaatatttaaaatgaagccctatgcaagtatgaaataccttatcatttaaatatatagactgtacactgacaggatgtctctggcattaaatgtcttttatgattatcgntacatgttttattgttattggtacatggtn

SEQ ID NO: 11145 - DNA, 365 bp, Homo sapiens
tacggctgcgagaagacgacagaaggggatttattttgagatatttgatgtgtttcaaaccgattttaaatgatattggctactgtgcaaacactaagaaaagttagtgcagccacactaatattagacaataagcctactttaagacaagaagcattattaaaagaatatttgatgatgatacaagggtaaatccagagtgtaatataataatactaaaattgtgaggacttaacatatggaaaatagttaatgaaataaggagaaatctacaaattcagaatccgattagaaagttaagtatatcttgggcccggcggtgtggttcacacctgtaatctcagaactttgggaggccgaggagg

SEQ ID NO: 11146 - DNA, 367 bp, Homo sapiens
gctacggctgcgagaagacgacagaagggggcgattgagcagcgggaagctgcttggacccagtctcaaacttagccctcatctatcacccgggcaggcctcctgggttgcagggacttagagaaaaggcagagctctcacggactatgaagctggggcgcgctcacctaagaggggtacgaagtagtgcttgtgcttcaaggagctggggaccgcagcaggggtgcacacacatcctgggcggctgtactagtgaccgaaggctaacttgttttcagactctacaagcttaaaaataaaatactttgcattctaagttgccaataaaatagaccttcatgggggcgaatggtcttttctactaata

SEQ ID NO: 11147 - DNA, 361 bp, Homo sapiens
tacggctgcgagaagacgacagaaggggacaccatgcattaaaaaaaaaatgagcatggctgcttcccagtaaaaccattcacaatcccaggtggcagtctggatttggtctgcactcatagttttctgggccctgatctcgaatatgtaaagagcacctacaaatcaacaagggggaaactggaaaagggcaaagactttagaggaaatccactcactttaaaggatatccagacgcccattaagcatgaaagatgggtagctttattaagaaatcggggaatggcaacttaaaacatggagcactgtacccaatccatggaatggtaaaatgaaaggctgaaaagcttaccgtttggca

SEQ ID NO: 11148 - DNA, 378 bp, Homo sapiens
tacggctgcgagaagacgacagaagggggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttcccttgctcaaggcttcatggagcagcctaagaaccgaccaccccacctcgacccccgcccagctgcaccatctgctcaaccactatcagctgggccctggccgcgggccgccaaccgcgtgggaccctccccc

SEQ ID NO: 11149 - DNA, 385 bp, Homo sapiens
  misc_feature 385: n = A,T,C or G
tacggctgcgagaagacgacagaaggggtttgaggcaaccccacctgcagtgggggctgagaagatgccagtggaagcaccagatcccagaggcaccctgtagggttgcctgtctcctgtgcgctcagggcctgccacttgaaatgaataaataagctaatgaagtgggagctttctgcagcatagtcacacggtcagcgcttggtgtggaggtcaggggcctattgtgggctgcccccaggaactgctcgaacctctcctctcaatccctgtctttgcagtgctcagtgacctgtggaaaaggctacaaacaaaggcttgtctcgtgcagcgagatttacaccgggaaggagaattatgaatacagctaccaaaccaccatcan

SEQ ID NO: 11150 - DNA, 352 bp, Homo sapiens
tacggctgcgagaagacgacagaaggggtttgaggcaaccccacctgcagtgggggctgagaagatgccagtggaagcaccagatcccagaggcaccctgtagggttgcctgtctcctgtgcgctcagggcctgccacttgaaatgaataaataagctaatgaagtgggagctttctgcagcatagtcacacggtcagcgcttggtgtggaggtcaggggcctattgtgggctgcccccaggaactgctcgaacctctcctctcaatccctgtctttgcagtgctcagtgacctgtggaaaaggctacaaacaaaggcttgtctcgtgcagcgagatttacaccgggaaggg

SEQ ID NO: 11151 - DNA, 371 bp, Homo sapiens
tacggctgcgagaagacgacagaagggaaaacggtgtgctagaaccaagccatctgttgccaacaggaagggtattagcaggtctgttatgagttgctcttccgttggtagtattgatgtgcctcgtaagttaacttgcaagaatccaggagaacaagccagaaaggctcacggagcccatgctgccagacatctgagccctgctaaacctcaggtgcagcaggggcagaccatccctctccaggtgttccaggaacattgcagaatggcctgatctctccaactctgtgtgggcccggtccagaccatgagggctctatggaggcagatggggttttgggccctggaccaaaacactcatctgcttacct

SEQ ID NO: 11152 - DNA, 362 bp, Homo sapiens
tacggctgcgagaagacgacagaagggggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccacctcgacccccgcccagctgcaccatctgctcagccactatcagctgggccctggccgcgggccgccagccgc

SEQ ID NO: 11153 - DNA, 359 bp, Homo sapiens
  misc_feature 359: n = A,T,C or G
tactgctgcgagaagacgacagaaggggcccccaaactcctccatcccaacaggcccagagccactgataatctcagcatttcctggccctctctgtctctttgcttctctctacctctgtttttctttccatttatattcctcacctgcccttcctcttaacatgtagctgattccctaaggcatcgtgttgcagtagaaagacctggatgctggattcttacagaccctggtttaaatcctgacttttacacttatcatatcactgatacctgttaaaatctgtatttatcacctctcagagcctcagtttcttcatctgaaagtgggtatactagcttgcctcattggatgacatn

SEQ ID NO: 11154 - DNA, 368 bp, Homo sapiens
  misc_feature 368: n = A,T,C or G
cgttgctgtcggcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtctcctagagtggcctcagctaggtaan

SEQ ID NO: 11155 - DNA, 374 bp, Homo sapiens
ggcacgagcagagactgtggagcaggaagagcttgtgtatacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagctctggcaggaggaagaaggagattttgatgaacagacagccgatgactgggatgtggacg

SEQ ID NO: 11156 - DNA, 375 bp, Homo sapiens
  misc_feature 246: n = A,T,C or G
tacggctgcgagaagacgacagaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttangttcctttcagctcatctgaagacagtggcagaaaattcagaaaaaaataagatggaaccagaaacctagcaatagtgttggtccccccctttgtcgacatcagagacaacatgaccacatgggccccc

SEQ ID NO: 11157 - DNA, 358 bp, Homo sapiens
tacggctgcgagaagacgacagaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagaa

SEQ ID NO: 11158 - DNA, 342 bp, Homo sapiens
tacggctgcgagaagacgacagaagggggacatcctcatgtaggttctacctatgtttacttgattaagtagaaaaaattattagtttattctgtagccaaaaataaaatggtgaaatgattgggatatattattgaatgatatatataatgaatgggatatatattaatgatatacttagataaaaatgttttaaaaattgagattttgtcttgaccagcttggcaacatggcaaacccctgttctattaaaatacaaaaatagctggcaggtggcccgggctgattcccagtacttggaggctgggggggagaatacttaatctggaagcggaggtgcag

SEQ ID NO: 11159 - DNA, 346 bp, Homo sapiens
tacggctgccagaagacgacagaaggggcccccaaactcctccatcccagcaggcccaaagccactgataatctcaacatttcctggccctctctgtctctttgcttctctctacctctgtttttctttccatttatattcctcacctgcccttcctcttaacatgtagctgattccctaaggcatcgtgttgcagtataaagacctggatgctggattcttacagaccctggtttaaatcctgacttttacacttatcatatcactgatacctgttaaaatctgtatttatcacctctcagagcctcagtttcttcatctgaaagtgggtatactagcttgcctc

SEQ ID NO: 11160 - DNA, 342 bp, Homo sapiens
tacggctgcgagaagacgacagaagggtacagagccataattccattagacgaaaaacacaaatagtcgtactttgtggctttgcttatagtggtgctgaaacatactgtttgacttatgaatgattccttttttaaaagcctggtccttttttaaaaacagacagcacagtcctagagcaacaccttcacttttgaggaggaggttgtgatcaagactcatcaggaatcccatgtacaggagagaacagaaaagtcataagcaaggaccacagaaagagacctaggctagactatggaactctccctgatgagcaactgtgtcaataacactatgaagaag

SEQ ID NO: 11161 - DNA, 332 bp, Homo sapiens
  misc_feature 210, 280, 281, 293, 294, 324, 325: n = A,T,C or G
gcctacggctgcgagaagacgacagaagggtgaaataaaaagacactggacagtgactcaaatccacattattaaataaaacagcactggtaaaggtacacataagtaaatataaaaaaagactgtaaatatacatctatataaacacatatatatgcacatatatacatatatatgtatagtaacccctttcttctcctctgtgacttnaaagacaaccacataaatagataattatacactgggtgtggggctcaagcctgtaatcccagcactttgnngagccgatgcanngcgatcacaaggtcaggagatcaaaccatnnctgctaa

SEQ ID NO: 11162 - DNA, 336 bp, Homo sapiens
tacggctgcgagaagacgacagaagggatcaccaactactgccctgaggcaagacaacatgaaatctcacctagattcttgctggagtttcctaagtggtatccttggttctgcccccactcccttccactctcctcggtctgttttcaaacagcagatgcagtgatcgtgttaaactacacattagatcatgtcactcctctcctcaaaaccctccaatttctacccatcacattcaaggaaattactgttatgtatcacttactataaaatgaggatcacgataatacctacttcatagagttgttgtgaggatttaaaaagtcagtatatgtg

SEQ ID NO: 11163 - DNA, 632 bp, Homo sapiens
  misc_feature 366, 611: n = A,T,C or G
tactgctgcgagaagacgacagaaggggcggctggggagcctggggacccatttgaggtgatcaggagatgtgtaaggtcaagtgactaatcctgtgatttctccaagatcagatgcacattccgtggaaatagatgtgctcgatggcagcatcagaagggaatcgatgtgcggggagctaggattagatgatgttaagctgaggattttatagtctgtttttcttgtaggagagtcaacaataggccggggttgtttcatcttcctgaataagcaagcaggtgggtttcagaaacagcagccacggcccaactgtgagtgtgtgtatgtgtgcttgtgttggggaaggtgtgtgtgcacatgtangtggatgtgcatgtatgtatgtctgtaagtctggtgtaaggtgtgtgcaaatgtgtgaacacttatgcgtgtgctgtgtgcatgtgtgtggccgtgcgtgtgtatatgcgtgcttgtgagtggttttgggtgtgtgcatgaacatttgtatgtttacaggtgtacatgtacatgtgtgtgcacatgtgtatctcagtgagtatgtgtatgagcatacatgtgtgaagtggtgtgtttttgtgtgngtggtgtaatatgcatgggag

SEQ ID NO: 11164 - DNA, 470 bp, Homo sapiens
  misc_feature 437, 449: n = A,T,C or G
ttggccgaagcggcctacggctgcgagaagacgacagaagggggcacagtctaagaggagagaagtggagggtgaagaggaggggacagcaactgatctctttatggcatcttatacagagttggcaccttggcaattaggatatcggggaccaaaagctgatgcaccactttaacaagatactttgtaaatgtagggcagggtggaggtcagaaacacaggcaggacttccaaaggctgggggcactgtccctgtgaggctcaagtgacaaggtgggagacaggattgggtggaggccacagttcttccatgttgaagaactctctagcatcctgaagactggctacctagagaccaacccagcgatgctgtgctttcttggtagactcctttgagaagcagtcgttgagagtctttgtggcagttgacaactggngactgggacatntggggagttggtggtacactt

SEQ ID NO: 11165 - DNA, 367 bp, Homo sapiens
tacggctgcgagaagacgacagaaggggtactcagataggtaaagaacaagtccagtggtgctgacagcaatggaatttaaaacttgattctaataatctctgagtcccgaaggaatgccacgcagacatccgtttgagtcacgagcttgtaactgaggatttgacaaagattgagtcctcactgtgtgccaggcaccatgctaaattttgtgctaggcacttgggatactctttcagacaagactttgtccctgctcacagagaaatctgataggttggcctatagtcactcttttctaaacttgacctatctacctgaattaaccgaaggagctggttagaaatacagattcctgggccaagaag

SEQ ID NO: 11166 - DNA, 360 bp, Homo sapiens
tacggctgcgagaagacgacagaaggggaataacaatgatttttttcttttgttttatttttatttttgagacagagtctcgctctgtcgcccaggctagagtgcagtggcgtgatgttggctcactgcaacctctgcctcctgggttcaagcaatcctcccacctcagcctcctgagtagtcgagattacaggtatagcaattttcagagttctggagagtcttggggagagagtagatgaatttgcataagaaagcaaggggatttctgagaaggaaggggccaagaatccaatctcttcttccgtagatctaaagttttgaaaatctgttggggtggcagtaaaagacactagtggt

SEQ ID NO: 11167 - DNA, 356 bp, Homo sapiens
tacggctgcgagaagacgacagaagggactctgtatcatttgggagatgaggcagccatgtcttttccttgacctctagccatgagagtaggtgggaaaaatgtaaagtgtggtttaaagaaatgtgaaggccgggcgcggtggctcacacctgtaatcccagcactttgggaggctgaggcgggtggatcacgaggtcgggagatggagaccatcctggctaacacggtgaaaccctatctctactaaaagtacaaaaaaattagccgggcgtggtggcgggcagctgcagtcccagctactggggaggctgaggcaggagaatggcataaacccaggaggctgagcttgcagtg

SEQ ID NO: 11168 - DNA, 353 bp, Homo sapiens
tacggctgcgagaagacgacagaaggggatagcagcatgagaatagactaatacaaatcccaatctacaaaatggaacaattcctttttattataccctctggtttgaacagttacttggttttgtcctccacccacattgacttattcttttggtaaacacaggtctcagaagtaactttttgttgccccggtttcagttattttggtagatagctttgaggctagtaccctgagctgacacagacccacatctgagcttggtctagccttaaggctcaaccaggactccttcactttcatttcaggtatttacaaataacaataattttaaaataaagaagaaaattatat

SEQ ID NO: 11169 - DNA, 390 bp, Homo sapiens
  misc_feature 390: n = A,T,C or G
tacggctgcgagaagacgacagaaggggaaagtagggtgatacgcagactcaactttaagtcttttggcatggtgctcttaggttataataatgtaacttcaatttttgaaaggcaaaatattttaccaagaccatgatttaatccaggcagtggaaaagatgagcttattataaggtgagctttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagn

SEQ ID NO: 11170 - DNA, 351 bp, Homo sapiens
tacggctgcgagaagacgacagaaggggtataaattacccaccctgaggagattctttatagtgtgagaattgactaatacatcatccaaataggagaggaagaccctccgtccaccttcagcgatgagataattctatacctagaaaatcctaccaagcctggcaccgtaattctagaataaacaactttagtatagtgtccggatacaaaatcaatggacagcaattaccaacatttctattggccaaccacatccaaactgagagtgtaatcaagaacaacatcctatccaacatacagtatccacttagaacatgaaatgcctgcgaacacagattacagacaaggg

SEQ ID NO: 11171 - DNA, 365 bp, Homo sapiens
tacggctgcgagaagacgacagaaggggactccattgaggactagttgctctcctgcacatgatgacaggagtaaaatataattgacttgtcagaaggtatccggttggccccagaaggtatagtatcatctcaggagatcaaggaaggtatccttctgcagtttgggggatctgaagaaaagctgagcagatcagaaatgaactcagcagaattaacattagaaagagagaaacaaggacaccaagaagcaatttcacccaggaaagcattccgttatgaaatccaagctctctttacatgaagactcagcctgcagacagctccctacacatgcaccccacagggaaggctgcttgtcaccag

SEQ ID NO: 11172 - DNA, 353 bp, Homo sapiens
  misc_feature 353: n = A,T,C or G
tacggctgcgagaagacgacagaaggggacacagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttggaatcagtatattggtggccagccagtgtattctacacatgctttgaggaaatcataaaagacaggagactcatagacattccatcatctcaaagggggtgagctgtn

SEQ ID NO: 11173 - DNA, 393 bp, Homo sapiens
  misc_feature 393: n = A,T,C or G
ggcacgaggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttn

SEQ ID NO: 11174 - DNA, 444 bp, Homo sapiens
tacgcacgactctcgcatccttttgcaagatcccatcgagtcgaattcggcacgagggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtaaggtgtatgtgctaatcggtctaattctt

SEQ ID NO: 11175 - DNA, 359 bp, Homo sapiens
tacggctgcgagaagacgacagaagggcaaaaacaaaaccaaaacactcttaatagaatagaaagaaaaaaacactcttaatagaatagaaagaccatccactgagtggtagaaaacatctgtgaattgttgtatacaaagttgtatacaaaatatataaagaaggccaggcacagtggctcacacctgtaatcccaggattttgagaggctgaggtgggtggatcacctgaggtcaggagttcgagaccagtctggccaacatggtgaaaccctatctctactaaaaatacaaaaattacccaggcgtggtggggtgcgcctgtaatcccagctactcagaaagctgaggcaggagag

SEQ ID NO: 11176 - DNA, 361 bp, Homo sapiens
  misc_feature 361: n = A,T,C or G
tacggctgcgagaagacgacagaaggggactgtgggctggtgtgtggaactggtgagaggggtagggcaagggagaagaagtttcctgcaatggtggtgacttgggtgggaaggggagggatgggcctgaaacttatttctgggttgtgtttgtgtttctttgtctctagtgtgctacggccaaatttagagtgaatcactccaagggttaactaatgtggggagcctcttttggcattaggtatgaagatggctgtagatagttgtagacagtgtggactggggcctcgagactgggcagagaggtgtcagctctttcctctgagcagaggatggctataaaagtgacagaggaggccgn

SEQ ID NO: 11177 - DNA, 465 bp, Homo sapiens
  misc_feature 396, 423, 432, 465: n = A,T,C or G
cttttggccgaagcggcctacggctgcgagaagacgacagaaggggatagcaggagcagtagatctggaagaagatccattatttactgacatttcaccagaaagcactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcataggcagttccgagactactgtgctatctgcttaagatgggagtggcctgggtctccaaaagcattggaaaagtgcaatttacaagctgcttttctttgaggtcattntttgaaagtgctcgtcgacagagtggngagaattcntgatcagccatatgatgtaacttacaagaaccn

SEQ ID NO: 11178 - DNA, 356 bp, Homo sapiens
tacggctgcgagaagacgacagaaggggtataaattacccagtctgaggagattttttatagtgtgagaattgactaatacatcatccaaataggagaggaagagactccgtccaccttcagcgatgagataattctatacctagaaaatcctaccaagcctggcaccgtaattctagaataaacaactttagtctagtgtccggatacaaaatcaatggacaacaattaccaacatttctataggccaaccacatccaagctgagagtgtaatcaagagcaaaatcctatccaacttacagtatccacttagaacatgaaatgcctgcgaacacagattacagacaaggtgaaag

SEQ ID NO: 11179 - DNA, 350 bp, Homo sapiens
  misc_feature 109, 308: n = A,T,C or G
tactgctgcgagaagacgacagaagggcaaaaacaaaaccaaaacactcttaatagaatagaaagaaaaaaacactcttaatagaatagaaagaccatccactgagtgngagaaaacatctgtgaattgttgtatacaaagttgtatacaaaatatataaagaaggccaggcacagtggctcacacctgtaatcccaggattttgagaggctgaggtggggggatcacctgaggtcaggagttcgagaccagtctggccaacatggggaaacctatctctactaaaatacaaaattaccaagcgtgcngggtgtcctggaatccagctactagagctgagcagagatcgt

SEQ ID NO: 11180 - DNA, 397 bp, Homo sapiens
ggcacgaggagagagagagagagagagagagagagagagagagagagagagagagagagagagagagagagagagagagagagagagagagagagagagagagagagagagagagagagagagagagagagagagagagagtgcgcgcgcgctctctcactctctcgtgtgcacacactctctctatatatatgtacacacactatttttttttgttctctctctccctctatatgtgtgtttttttatacacacacatatatatccctctgtgttttctctctctctctctcaaagacactctttttttttttttttcgccgcgcgattttttttctctagagagaacacacactctcacgtgtttgtgtagagagtgtctctcttatatacactc

SEQ ID NO: 11181 - DNA, 384 bp, Homo sapiens
ggcacgagggacaaccaaatgcacagtgattggttcaactctggacctgtgactcaagccagaccaagggagtgacatgcagggctttgcctggaactattctgaaaggggcactctctttctgctgggctactgataatatgtgcatccgtgatagaggagcctgcctgataataaagccaataagggaagagcagagccaagagatggtgggagagcagatgcctgaaaatatcatttgagcccctgggtccagctgcacctgaagccaccacgatctcctggactttgcagttacttgagttcataaataccctttggcattaagccagattgagtcttaatgcatatagaaataagagaagtgagaaaagaaattgaaaa

SEQ ID NO: 11182 - DNA, 361 bp, Homo sapiens
  misc_feature 318: n = A,T,C or G
tacggctgcgagaagacgacagaagggggctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttgggggtcagcaatatcacaaggctcatcgatttacctgggactgaagttgctcagctgatggggaagtgaccttaagttgcctgcgggctgcccagcatangattcttcggcttcatgctctcagcgaagggaaaagaggaatt

SEQ ID NO: 11183 - DNA, 361 bp, Homo sapiens
  misc_feature 330: n = A,T,C or G
tacggctgcgagaagacgacagaaggggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcanatggcattgatgcaggtaacatgcttaacac

SEQ ID NO: 11184 - DNA, 387 bp, Homo sapiens
tacggctgcgagaagacgacagaaggggggcaggatatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctccccgaggagtggtctgag

SEQ ID NO: 11185 - DNA, 376 bp, Homo sapiens
  misc_feature 224, 376: n = A,T,C or G
tacggctgcgagaagacgacagaaagggtgatacatctacaagtcaactcgttttattacgagtctagcaaaaccttgattcaaaaacttgtcgagggcagaaggacaaaagacattacagcccagtatttctcagggacacagatgcaaatatcctaaggaaaatatcggggaacaatagaacaatgcataaaagagagaatatattacaaacaaggtgggtntaccccaggaatgagcacttagtctaatattagaaaatcagaggatatagtttaccacattaaaagactaatgggaaggaagtataccagtaaccctcaccagatgcaggaacaaggattttgataaaatctcataaacagccaaccttttn

SEQ ID NO: 11186 - DNA, 379 bp, Homo sapiens
tactgttgcgagaagacgacagaaggggagagagcgaaagagcaagagggcaagagggcctgaactctctttcacaaaggctagcaaagaagtatgcacaggttaagggaaaaagtcacaatgaatcctgtagtacagactactttatcaaaagcagctaaaaaaagatctcattaactcccccaactcatctccacccacatctaaagagccacacacagcaccaccaaaggcagcagaacgagaacagcgttctcctcgacagaccagctgtgagtatccagacagacacccgacctcaacagctccagagcagccccagaacagcccctccgtaaccaccactcaagtaaccagctgggaaagtattaagaaaacc

SEQ ID NO: 11187 - DNA, 426 bp, Homo sapiens
  misc_feature 381, 426: n = A,T,C or G
tacggctgcgagaagacgacagaagggggatgacatcatggcagacagtggaagagcatctgcaatgccaaacactcctacccacagtattgctgcatccatttcccaacctcagactccaactccaaggcctatcatctgtccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagagagggtttactccactcatcttggctgcacagctggtcatgctggagtgtggaaatattgctggacaatggtgcagacattngagcccagtctgaaagacccaggacacacactctgcttgcgtgtn

SEQ ID NO: 11188 - DNA, 465 bp, Homo sapiens
  misc_feature 465: n = A,T,C or G
ttggccgaagcggcctacggctgcgagaagacgacagaagggggcagaacctgttgagaaaggggcatccacagacatctgtgccttctgccacaagaccgtgttcccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgactggctggacgactttacaggaattcgccccgtctgcacatctgtgaaatcccatcatcctcgn

SEQ ID NO: 11189 - DNA, 432 bp, Homo sapiens
tacggctgcgagaagacgacagaaggggaaaccaagagggtcggcagtggacgcgtacattttgtcacggagtccacagagctgagcttttgagcagactctgagaagtatcattgcttgtgttgaaagaatacaacaggatttaagtttctctttacaaattgcactgaagaaaggccgggcgcggtggctccccctgtaatcccagcgctttgggaggccgaggcggtgggatcacgaagtcaagagatcgagaccatcctgaccaacatggcgaaaccccgtccctaataaaaatacaaaaattagccgggcatggtgacgtgcacctgtagtcccagctactagatatgctgaggcaggagaattgctagaatccgggaggctgaggttgcagtgagccgagatcgtgccactggacttcaacctgcg

SEQ ID NO: 11190 - DNA, 418 bp, Homo sapiens
cgatgctgtcgccacgctttagggtcagacagacctgggtcaaatcccagccctgtgaagtaccagctgggcacccttggacaaattacatgacgtctctaaacgctaggctcctgtctactgcggctgcaccgtcgcccccctgtaagagtccccagcccactgagcccctgggtccaaagctccaggctgcaccccatttccaggactttggaaggttcatgggtcactccccactggagaggccccagctgctgccatcttacacagcatcagcaatgtttatgggccggcagaggcatggggaagcaaacggtctgcaggccgtgtttggagaaaaggaagagctgagttccaaaggaatctccaccacaggcatgtttatagagtttgtaaataattagaggcccacgctctg

SEQ ID NO: 11191 - DNA, 402 bp, Homo sapiens
  misc_feature 154, 281, 353: n = A,T,C or G
tacggctgcgagaagacgacagaaggggggtgccagctcagcagccccccacctctctttattctctccaaagctggtctttccgactatcattgtggtagggggaggacagatgctaaaggtggaagctgacctggagaaagagacacacggngtgactgtggcaaaggacagctggaaaagaaactctatcacttcttcattggcaaccacaaggcacctgaggccatggcactcccagaggctgtgcgcagagccaagcctctcaacctcttctggcncctgcgtctgcagcgaggtctctgctggtagacagtagactccttcgatgaggtgctcaaaatgctacccgngtggtggggctggcttgcagctggccaagtcaaagaaagtgcagaaaca

SEQ ID NO: 11192 - DNA, 409 bp, Homo sapiens
ggcacgaggctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaagcgacgctgtgcaatgtcaagagaggttttcgcttgtcacaagcaagggatgctcttggcatctagggagtggaggccaaggatgctgccctgcactggcattggcctcagagctcagtcttgccagggg

SEQ ID NO: 11193 - DNA, 390 bp, Homo sapiens
ggcacgaggggggtttgggtatgtctgttgctgtgtaggtaggtatgtgggtccttggggtatgtctgagtctgggtgtgtgtgtgtgtgtgtgtgtgtgtgatctatgggagtgggtttgggtgtgcctgtgtgtacctgctgctgtgtgtgggtaggtgtgtggctctctggggggtgagcaactgtaagtgttgctgtgtatttgggtctggatgtgtctgctgcggtgtgcaatgtgggtgtgtctgcatgtgggtgttctcaacacctacggaggataaacacatctttttatcgtggctctttctagtttaaaaactgctttttaaacccggaaatgacccccaggctgtcattcgattcctgcaggacaacaccttccccccg

SEQ ID NO: 11194 - DNA, 390 bp, Homo sapiens
cacgaggccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaac

SEQ ID NO: 11195 - DNA, 386 bp, Homo sapiens
  misc_feature 359: n = A,T,C or G
atccgatgctgtcgctgagctgcaaggtcacatagctagtaagggattgttctgggctgaagaaaaaggatgcatggaggggagtatcttgcccaaggtcacgttattagtaattagtggagtcagaattccaatgcaggttccttcactccagctcttcttacctcaaaaaacacacttgcctggaccctcccctggagatggatttaattggcttgggcatggcgatatttaaaacttccccaggcgattttaatgcacagccagactgagaaccactgctttaccccatttttggagtaaaaggaattaccctccttaggaaatctggtcgctctatgtggccattcctttatgtncctgcccctccgtcacagaaacacacc

SEQ ID NO: 11196 - DNA, 379 bp, Homo sapiens
tacggctgcgagaagacgacagaaggggaacagaaggctgaggactgcccaggtccagagtcaccaagagcttgttgtcaggttttcacttgctattcgcagagattttttttaaaggcactatttgtagtgttaaaagggtgaatttatcagaaggcataataatcataaatgtgtatatgcctaataatagaactttaaaaggcatgaagcaacactcaaaaggattaaagggagatcatctcacccccttcttaccaattgatagaatgatctgatgaaaacagtaaaataacaacagatctgaacactgtcaaccatcttgacaaatacttatgcctagtgttccattattggaacactacacatgtggaatgag

SEQ ID NO: 11197 - DNA, 382 bp, Homo sapiens
cgttgctgtcggattctccttctgcaccacttgattcccacctgggacctccagcaagaagcaggtgggcttagagaacttgctgtatttcgggacactgaacgtgtagatggttctggcactgaggcagtggtgctcgctggcagctggctggagagtgatctggactggctggccatggggagtgactggaaatagggtctgtttggaaaagaagcagagagtggcagagctgctgtggggactggtttcacacagccatgacagagtggggttggcagacatggaagggcgttgttttttgtttttttcagattttctgcacgggatagggcttggttgtgtcacccaggccaaagtgcagcggcgtgacacagttcag

SEQ ID NO: 11198 - DNA, 377 bp, Homo sapiens
ggcttgctgggatcatggcggggaatcactgcgagctcctgccgctggcccgtggcaggctcggggcggggttggggtggcttcttgtgcctcccttaaagcgcggggctcagcgtcctggcccagcgccccagcagcaggtccaagtgggtccggctctacagcggcggcacctacttcctcaccactgggcagacgccgctgtgtcaggacccgaaatccttcctgtacctcttgagccaggccgaccccgacccggactcggacaagacggagttttgttcttgttgcccaagctggagtacaatggcacaatcttggctcaccacaacctctgccacctgggttcaagcgagtctcctccttcagtctcctga

SEQ ID NO: 11199 - DNA, 387 bp, Homo sapiens
  misc_feature 387: n = A,T,C or G
catcgattcgaattcggcacgaggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcactggcctatgcatttgcgcgagtgagn

SEQ ID NO: 11200 - DNA, 386 bp, Homo sapiens
ttcgaattcggcacgaggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcat

SEQ ID NO: 11201 - DNA, 350 bp, Homo sapiens
  misc_feature 350: n = A,T,C or G
tacggctgcgagaagacgacagaagggctactcaacatcgtgtggttctgccaagtaaaccacaaaatgcaaagaatccatgatgtgagacctgtgtttcccataaataagagataaaaataacatctaggctgggcctggtggctcatgcttataatcccagcactttgggaggcagaggtgggcagattgcttgaggtcgggagtttgagaccagcctggccaacatggtgaaaccccatctctactaaaaatacaaaaattagctaggtgtggtggtgcatgcctataatcccagctacttgggaggctgaggcagaagaatcgcttgagcctggaaggtggaggtn

SEQ ID NO: 11202 - DNA, 352 bp, Homo sapiens
tacggctgcgagaagacgacagaagggctactcaacatcgtgtggttctgccaagtaaaccacaaaatgcaaagaatccatgatgtgagacctgtgtttcccataaataagagataaaaataacatctaggctgggcctggtggctcatgcttataatcccagcactttgggaggcagaggtgggcagattgcttgaggtcgggagtttgagaccagcctggccaacatggtgaaaccccatctctactaaaaatacaaaaattagctaggtgtggtggtgcatgcctataatcccagctacttgggaggctgaggcagaagaatcgcttgagcctggaaggtggaggtttc

SEQ ID NO: 11203 - DNA, 352 bp, Homo sapiens
ggcacgagcctgacctcactgtgaccttgacttgattagtgccttctgccctccctggagcctccactgcctctggaattgctcaagttcattgatgaccctctgaccctagctctttccttttttttttttcccccacggaaagggggcccccttttgtgcccaaggtgggtttaaaacccgggccctaaaggaaccctcccccctaaccctttaaaggggtgggaataacggggggaacccccattcctggcctggagccaactttttaatggccggttaatttaagccccttgcccgaaatctgtgctttgggcctctccggccctgagaccgccttttgctggccaag

SEQ ID NO: 11204 - DNA, 314 bp, Homo sapiens
  misc_feature 280: n = A,T,C or G
tacggctgcgagaagacgacagaagggctactcaacatcgtgtggttctgccaagtaaaccacaaaatgcaaagaatccatgatgtgagacctgtgtttcccataaataagagataaaaataacatctaggctgggcctggtggctcatgcttataatcccagcactttgggaggcagaggtgggcagattgcttgaggtcgggagtttgagaccagcctggccaacatggtgaaaccccatctctactaaaaatacaaaaattaactaggtgtggcgtngcatgctataatcccagctactttggaggctgag

SEQ ID NO: 11205 - DNA, 430 bp, Homo sapiens
  misc_feature 430: n = A,T,C or G
catcgattcgaattcggcacgagctcccagcctcaggtgatctgcctgcctcagcctccccaaagtgctgagattacaggtgtgagccacagcgcctggccatatattgcttttttcttattatcagagccagttcataattgtggaaaaatagtgtttgtaacaatgtaagtatggataaatcatctttttaattttgtgattcatataggtttgttgttgttgttgttgttttgtttttatcttgagacagagtcttggtctgtcacccaggctggagtgaatggcacaaccatggctcactgcagcctcagaagcctgggcaacatagcaggaccctatctctactaaggaaaaataaaacaattatccaggctcggcattggacaccttcatggtcccaggtactgaggaggctgatattggaggn

SEQ ID NO: 11206 - DNA, 380 bp, Homo sapiens
tacggctgcgagaagacgacagaagggaaatgagatcataaggatgaggccctaattcagtaggactagtggctctgtaagaagagcaagagagacctgagatggtatccactggccctctcaccatgtaaatgccttccacctccatcaaaagggggccctagacctcagacttcccaagacaatgaacccaagacatttcactatgatttgtcaagagcgaagattaaagaaaaaagcaggggccaggcatggtggctcacgcctgtaatctcagcactttgggaagccgaggcaggtggatcacttgaggtcaggagttcaagaccagcctgaccaacatggagaaaccccgtctctactaaaaatacaaaattagc

SEQ ID NO: 11207 - DNA, 405 bp, Homo sapiens
ggcacgagagtgagagagagagagagagttagagagagagagagagagagagagagagagagagagagagagagagagagagagagagagagagagagagagagagagagagagagagagagagagagagagagagagagagagtgtttctctctcccccacaagactctctgtgctctcttttctctcccccccccacactctctctctcactgtgtgagagccccccccccctctttctttcttttttttcttagataaaaaactctctctgtgtgagatctctcttttgtccccccccccccgctcgcgcgcgcgctctcactcccttgttttgtgtagtgtgtgttctctctccctccacacacgccccctttctctctgttagttttctctctctctctg

SEQ ID NO: 11208 - DNA, 381 bp, Homo sapiens
  misc_feature 381: n = A,T,C or G
tacggctgcgagaagacgacagaaggggaacaggaatttaaagcacattgtcgagtaagtgttgtttggtgtcagcaaataaaccaggatggtctcaatctcctgaccttgtgatccacccgcctcggcctctcaaagtgcttggattacaggtgtgagcagctgtgcccggccaagttttcggtaattctaattttcatttaaaatttgacttattggcagcacgtgtcagttattttcctttaggttttctttgagaaaatgtcaaatacctaaatctgaataatcatagtttgttggtcagttctttcaaataaaaatgattattcataaaaaaaagcggctagttcagcttacagatcagtggcgtggtctcagctn

SEQ ID NO: 11209 - DNA, 371 bp, Homo sapiens
  misc_feature 24, 25, 26, 27: n = A,T,C or G
tacggctgcgagaagacgacagannnngaacaggaatttaaagcacattgtcgagtaagtgttgtttggtgtcagcaaataaaccaggatggtctcaatctcctgaccttgtgatccacccgcctcggcctctcaaagtgcttggattacaggtgtgagcagctgtgcccggccaagttttcggtaattctaattttcatttaaaatttgacttattggcagcacgtgtcagttattttcctttaggttttctttgagaaaatgtcaaatacctaaatctgaataatcatagtttgttggtcagttctttcaaataaaaatgattattcataaaaaaaagcggctagttcagcttacagatcagtggcgtg

SEQ ID NO: 11210 - DNA, 377 bp, Homo sapiens
tctacggctgcgacaagacgacagaaggggcgttttataagaaacaaacatggccccaaaaccttgttttatggaaaatttcaagcatacacaggtagagagaatcatataataaatgccatttacccatcacccagtttcaatgttaccagcatcttgccgggcctgacacagtggcttatgcccgtaatcccagcactttgggaggccaagtggggaggatggcttgaggccaggagtttgagaccagcctgggcaacgcggtaagaccctgtctctaaaaaacaaaacaaactcttgccaatatttttatcagttgtacccacttttttctttcctggtgtattaaagcagatttcaggtatcttgttaattgg

SEQ ID NO: 11211 - DNA, 396 bp, Homo sapiens
  misc_feature 387: n = A,T,C or G
ccatcgattcgaattcggcacgagccgacctggggaacatagcaagaccccatctctacaaaaatgtaaaaaataaaaattagccgggtgtggtggtacatgcctgtaatcctagatactcgggaggctagggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatcctaagacctaacataatagagacagtggagatgggtctctttcgttctcagggcagacagatggggggctgagcctctatcaagaagcagagtctatccanatgtgtatg

SEQ ID NO: 11212 - DNA, 412 bp, Homo sapiens
  misc_feature 382: n = A,T,C or G
cgttgctgtcggcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactgtttatgctatgagatactgactgatgtacatgtacatttagtgtttctttaggtatacctgacttattcattgaacacctatccactgatctcanaagtattcctcacggtagtctccattcctg

SEQ ID NO: 11213 - DNA, 384 bp, Homo sapiens
  misc_feature 369: n = A,T,C or G
ggcacgagaatcgcttgagcctgggagatagaggttgcggtgagtgaagatcacactgctacactccagcctgggtgagagagtgagactctgtctcaaacaacaacaacaacaacaacaacaaccacaaaacaaacaaaaacccctgattcctggagatcctgattccataggtgtggtctctgcaagcaattttatctggaattgaagaccactggtgttctgggacaaaggttttgaaacagacaggggtccaaattctggctctaccacttattgaggtgtataaatttgaggaagttactaaatgctctgaacttcagtttctcctggaaaatgggataattatgtctagcttgtggggctatntgtaggatgaaatga

SEQ ID NO: 11214 - DNA, 394 bp, Homo sapiens
tacggctgcgagaagacgacagaaggggatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaggaggaattaattcctcagctcagggagcaatgtggtttagagctcagtattgacaggtttcgtctaaggaaaaaaacatggaagaatcctggcactgtctttttggattatcatatttatgaagaggatattaatatttccagcaactgggagggtctacttgaagtcttgatgggtaaagaagagagtccatgtacagcttgcagtttgcaaa

SEQ ID NO: 11215 - DNA, 337 bp, Homo sapiens
tacggctgcgagaagacgacagaaggggggctgcttcataagtctgacttcatatgacagctagattcaaaaggatgaaatcagtagaggtgagacctcttgatgccttggcttggaagtcacatattctattggccaaagcaaatcacaaggccaccacaaattcaaggagatgaagaaatagactctacctctcttgattggcttataatatggtcagttcttcagaggaagaggaaaatttcatctggcctcaaatctcagtgatcgcatttgtgggaacataatgtctgaagtaaagactaagtagaagtctgacaagcaaaaaaagaaaaag

SEQ ID NO: 11216 - DNA, 394 bp, Homo sapiens
ggcacgagcactaaggaggccgattctttccggctcgagcaggtccggacccgcccctctggcgtctagcagtctcggaggcctgcccgtatagttcagggccggacagcgagcggcggcgacttgccagtaaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtg

SEQ ID NO: 11217 - DNA, 367 bp, Homo sapiens
  misc_feature 308: n = A,T,C or G
tacggctgcgagaagacgacagaaggggatccccaggctaagccattgtttattctttgtgaggtgtttgtcttgggagatatatgcatacaatgtggtgttgctataatgagtgctgagatttcaaccctataagagccatgggctctggagaactgtgaactgggacatttctaatgtgatgaggattgacaggttgtgtctgataccatgtgctaacagcctgaagatattgagaaaaggactacacaaaatgaatgacaatggacagtggtttgatacacggcccttgatagtgattttgaggngaaggcacacagtcagctattgagggatttgcagcatcactataacaccacccctaccg

SEQ ID NO: 11218 - DNA, 388 bp, Homo sapiens
tacggctgcgagaagacgacagaaggggacagctgcttagtaaaagcaaccccaggacacaatcttacttctccccaaattatgaaaaagagagctgtaggaacactgagagttgcagttggagtttgcaaacatttgggtcttattactactcagttcacaaaaagttaatttctgaatcagccctggcatccaataagggtagggaaatgcttccaggaccagcagctgttgttgatatgggctggaggacggactcttttactggatcattaaagtacttactatgttcaagacaatggtctaagtggctgcaaatattaacgtattttattctcataacaactcataaggccagcactattagcctcattttatggataaggaa

SEQ ID NO: 11219 - DNA, 381 bp, Homo sapiens
tacggctgcgagaagacgacagaaggggacagctgcttagtaaaagcaaccccaggacacaatcttacttctccccaaattatgaaaaagagagctgtaggaacactgagagttgcagttggagtttgcaaacatttgggtcttattactactcagttcagaaaaagttaatttctgaatcagccctggcatccaataagggtagggaaatgcttccaggaccagcagctgttgttgatatgggctggaggacggactcttttactggatcattaaagtacttactatgttcaagacaatggtctaagtggctgcaaatattaacgtattttattctcataacaactcataaggccagcactattagcctcattttatgga

SEQ ID NO: 11220 - DNA, 406 bp, Homo sapiens
ggcacgagccagaagagctgcagtcctacatccagaagctcagtatagcagtggagcaggctaagcagaaaatcctccaagcggaagtcaacctcgaggtggatgtggtagacagcaagccagagacccctgacctggagcagctggagccgtctttggaagatgtggaaagcatgaatgattttgatcccttgttttcagaggaaacacctggagtggagaagccggtcaccactgttcagcccgtgtttaacttggcagcatatcatcagctatttgttgggacagaaagaattcgagctccagagattattttccagccatctctcataggagaagaacaggctgggattgcagagactcttcagtacattctggacaggtacccaaaggacgttcaggaaat

SEQ ID NO: 11221 - DNA, 378 bp, Homo sapiens
ggcacgagaccagtgaagatgaggaagtctgggggccgagaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataagccgaatggcagttgctgctcgggaaggggatgcgcatcctcttggggctctgcctgtggggaccctcatcaacaacgtggaaagg

SEQ ID NO: 11222 - DNA, 681 bp, Homo sapiens
  misc_feature 452, 570, 635: n = A,T,C or G
ggcacgagacgagttccaaaattaaatcactaataaaaaacacaccaaccaggaaagaaaaaaaaaagccctggaccagatggattcacagctgaattctaccaaatgtacaaaagacagctggtaccaatcctactgaaaccattccaaaaaatcaaggagaagggattcctccctaactcattctacgaaaccagtatcatcctgataccaaaatctggcaaagacacaacggggaaaaaaaaaacaaacttaagggccaacatccttgagggaaatagatgcaaaattcctgaacaaaatactaccaaactgattttaggaccacaccaaaaggttatttcagttggatcaagtatgctttattcccggaatgcaaggctggttccccatatgcaaatcattgattgtgattccccaattaaccggatttaaaaccaaaattcacttantcatatgatcttctcaatagacacagaaccagcttttgataaaatccaccatccttttattttaaaaacctctcaaaaacttgccttaaaggaacatacctacaattataagagcctntttgaacaacccattaaccttttgtgacaggccaagctgaacattcccctagaactgaacggaanggcgcttttcattcctcctttacataaattgaggctatcgaaaata

SEQ ID NO: 11223 - DNA, 376 bp, Homo sapiens
ggcaccaggggaggctgaggcgggtggatcacctgaggtcaggagttcaagaccagcctgaccaacatggagaaaccctgtctctactaaaaatacaaaattagccaggcatggtggtgcatgcctgcaatcccagctacttaggaggctgaggcaggagaatcgcttgaacccgggaggtggaagttgaggcgagcaaagatcgtgccattgtactccagcctgggcaacaagagcgaaactccatcttatttaaaactggaggagctcaaggcgcccggccttcacaaaaaagtggggcggactatccggaattccgaacatgaaaaagaccttggagaagttggcgcaaacccttcttgatatcgtggaaaaa

SEQ ID NO: 11224 - DNA, 378 bp, Homo sapiens
  misc_feature 27, 28: n = A,T,C or G
tacggctgcgataagacgacagaaggnnccagaaggctgaggactgcccaggtccagagtcaccagagagcttgttgtcaggttttcacttgctattcgcagagattttttttaaaggcactatttgtagtgttaaaagggtgaatttatcagaaggcataataatcataaatgtgtatatgcctaataatagaactttaaaaggcatgaagcaacactcaaaaggattaaagggagatcatctcacccccttcttaccaattgatagaatgatctgatgaaaacagtaaaataacaacagatctgaacactgtcaaccatcttgacaaatacttatgcctagtgttccattattggaacactaaacatgtggaatga

SEQ ID NO: 11225 - DNA, 388 bp, Homo sapiens
  misc_feature 86, 88: n = A,T,C or G
ggcacgaggtgaaagtgttttctgtccgtggaacatcctttgactttctcatcacactgagagagagaactagtctcgagagcagntntttttttttttttttttttttttttttttttttttttttttttttttttttgggggggggggggggggggggcccccctttttttttttttgggggggaaaaaaagggggggggtccaaggggggtttttttcccggggggtttttttgggggaaaaaaccccccggggttttcctttgggggggggggcccggaaaatttttggggccccaaaaaggggccccccccccccgggggttttttttttttgggggcaaaaaggggggggggggggggggggcccttttttttatttttttg

SEQ ID NO: 11226 - DNA, 401 bp, Homo sapiens
  misc_feature 401: n = A,T,C or G
atcgattcgaattcggcacgagatcacctccttcaaggacagagtgccctcacctagggccagggggaggtgcagaagcacactgctagccaatttgtttcaagaaaaattcttggtaggctgctgccagcagaagtgctgcctgttgaggcctgtcactgaatggtaaagatctgtggccaagaaccccaaagggccagattctaatccagatccatcactgcttgctgtgagacctcgggcaagattcttagcttctctgtgcttcactttcctcgtctgcgaagtctgtatgcacagcacaaagtggttgggaagactggtgggattccggcaggggtggagctctgcagactgagacactcagttggctgttactagtgggggctgccatctctaan

SEQ ID NO: 11227 - DNA, 396 bp, Homo sapiens
tacggctgcgagaagacgacagaagggagcctggccaacatagtgaaaccccatctctactaaaaacacaaaattagccaggcttggtggtgcgcacctgtaatcccagctactggggaggctgaggcaagagaatcacttgaacctaggaggcagaggttgcagtgagcctagatcgtgccactgcactccagcctgggctggacagagcaagactccatctctgaaaaataaaataaaataaaataaaacaaaaaaacagaatagaagaagatagctaagaaccacagtggtcaagccagcctggcttcaacagagatgaatggagagaccacggtcagccccattaacagaagaactggggccaggaacggtggctcatgcctataatcccag

SEQ ID NO: 11228 - DNA, 439 bp, Homo sapiens
  misc_feature 329, 343, 387: n = A,T,C or G
ggcacgaggaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaaccctgaagatgcgcgngcacttcctggtgngtgacgagctgtactgtgagaagcatgcccgcaggcgctactcngcacctgcaccttcagtcttcgggcctgaagcaagcatgccctcagcctgcg

SEQ ID NO: 11229 - DNA, 608 bp, Homo sapiens
tactgttgcgagaagacgacagaagggttttgtcgaggatttctgcttgtttgttttgagacggaatctcgctctgtcacccaggctggagtgcagtggcacgactgaggctcactgcaacctccgcctcccaggttcaagtgattctcctgcctcagcctcccgagtagctgtgaccacaggcatgcaccaccacacccggctaatttttgtaattttagtagagatggggtttcaccatgttggacaagctggtctcatactcccaccctcggggatccaccccccttggcttctcacagtgctatgatttctcgtgtgagccatcacaacccacctggctcaacgggtaatatcctgtccctgtctgaatttgcaaaatagcccccgcggggctcttcaccctttaagcacctattcctcccggtttaggcctagaaatatttcaaacgcgtgatgttattcatcttacatgatcccccacatgccttcatcggtgggcaaagaaactttttacgcaaaacaaaaaataaatttgtgcggttttctaacccccacccacgggggaaacctttttcataaattataataaccggtgggtgcctcag

SEQ ID NO: 11230 - DNA, 407 bp, Homo sapiens
  misc_feature 407: n = A,T,C or G
cgttgctgtcggtgaagttaggtgaccagacctcgattcagattttagaatcagactctttgatttggtgtcattaacattgattgaagaatgttttgaaagctgaggtattaagaaacaacacaaaggtggagtttaaaagaggaagttgagcgtttggagagagtgccatgccaaaggaggggacttttaagaaaaggaagacaacacttagtacttctgtgtacccagccttgtaggaataactttacctgtgtaatcttattttattctcacagtaccatgtaaagtatgaattatcattgtccctatttgacaggtgaattaagtgaagtttattgtggttaaataacttgcctgaatgtcgtgctgctggtgcaaggttaatctggatttaaactgagatn

SEQ ID NO: 11231 - DNA, 404 bp, Homo sapiens
  misc_feature 325: n = A,T,C or G
attcgaattcggcacgagcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccacaacatcagggctgtggtgaccgggctgggccacacgtgggcatggaccanagacgacgtgatcctccacgtgctcccgctgcaccacgtccatggtgtggtcaacgcgctgctcttgccttctctgggg

SEQ ID NO: 11232 - DNA, 431 bp, Homo sapiens
ggcacgaggttgggtgtgggtggcggggggcctgggtggggtccactgagtcgcctcccctgtctgcctgcacttcctcctggaggaaatggggacaacaggatgaagtgagggcctgctgagcccagggctgccacctgggagtgaagccggggcaggctgcagggtccgggcccttctgtgtgggcaggtggaagtggtggggatgcagtgaggctccccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcctccagcgtggtccggcgagccttg

SEQ ID NO: 11233 - DNA, 367 bp, Homo sapiens
tacggttgcgagaagacgacagaagggtatgaagtatatgggaggatgtgcaaaggtgatgtgcaaatactatgtcattttatatcagggacttgagtatcctttgttaccctcaggagatcctgaaaccagtcccccatggatactgagggctgactgtatagtcctatcctcacggaactttcattctaatgggggaagactgactataaacaaaatatatgttatacgtggtggtgagtaccgtggagaagtaacaaatggggcaaagtgagttatacagctccattcttagaaaccttggagtacttttcttagtttatactcgtggtgggttgcttttgtctcctttattacatgggactct

SEQ ID NO: 11234 - DNA, 375 bp, Homo sapiens
cgttgctgtcgattcaatgggttgcagctgtgacaagagcaacaacaaaaatattgtgcgtctttcttttttttaataatggcacaaaaaggcaaaaccatagatacagtaaacggatgtgtggttgccagtgtttggcggggagagggttcaataagtgagcacagggggttttttagggtgaagaaatgtgggtatatgactgtgcattggttgatatccattaaacttaatagcacaaaaagtgaaccttaatgcatgcaaagttaaaaaaatcacttaggacatttagataattccaaaatgtcatgcagaatatgacaaacatcttcaccgtattacaaatgtgtgaaatgacctcatgaagaggataga

SEQ ID NO: 11235 - DNA, 360 bp, Homo sapiens
tactgctgggagaagacgacagaaggggaggacgcagtgtcacttccatggcggtcccagaaaaaaatgcctgacctgaaccgatcactaataaacatcagaagaacccaaattggggtatgttctgcaaaataactggcccatagtcttcaaaaatgttacggtaaaggaaggtgaagaaaggctgagaagttggttcagattaaaggaagctaatgagagtggccaatgcagcttgtggtcaccagtttggttctggaccacgcagctcatggcaagaaagatattatttggataactggtggaatttaatatgaactgtggggctgggagtggtggctcacatctgcaatcccagcg

SEQ ID NO: 11236 - DNA, 335 bp, Homo sapiens
tacggctgcgagaagacgacagaagggaaacactacatcactgcctactccaagccctagctccagtacgggaagtgaaccatgacaggaaatttaacatctacaggaaaagtagaaacacaattcttctaaaggtttatataactccaactaaggtcatctctttcttgccattaacttcctgaacgcctgtaatccagcactttggaggccgaggcggctgatcacgaggcaggaatcgagacatcccgctaaacgtgaaacctgctctctacaatacaaaactagccggctaagggcggcgctgtagccaactacttgaagctgagcagaga

SEQ ID NO: 11237 - DNA, 361 bp, Homo sapiens
ggcacgaggacctgctgtgtgaccctggccagtctctgcccctctctgggcctcagtcttcctcatctcaaacatgagaaaggacaaaatcctggactggggtgatggtaaaggatgtagcctgaatgtgtgtggtcttctgggccttgggaccccatgtttgtccatcacttggaacctcacgtgtggctggttcctgaaaaacctgcccttcctccagaactctccgtggctcgtctgtgccctgcctgcctatggaattgggaaaagcaacctgactgctatggagttcctggtctgtctgctcatggccccatcctgggggcagggcctcggttgtggaccctcccctaacttgggg

SEQ ID NO: 11238 - DNA, 364 bp, Homo sapiens
tacggctgcgagaagacgacagaagggaggcactgattttttttattggttaagttccatcaaatattccagggaaaaataactctgatcttgtaactccaggccctcctttttttttttttgaaaaggaatttcctttttggaaccccgctctggcggaaagggcccaattttggttaaatggaaattttgccttcggggttaaaggggttctcccgcccaaaccccccaaaaacggaaaaaccagagacctccaaagacagatgggcaaataatggcaatatgccaacgtcgggttcttaatcttggcaaaggtatcgcggccacataagatgactacattagtgaaaatggatttaggctg

SEQ ID NO: 11239 - DNA, 382 bp, Homo sapiens
  misc_feature 371: n = A,T,C or G
cgttgctgtcggcttctgggctccctctaaagcctaccctgcgcccaggtctccatgcttgaggccaagggctacagggaccttagggaaggggatccgtctccagcagccctggccctgtctcccccagactcaggccccgagaagcggaaggtggcctaccagcacgtgcctgtgcccgggagccctggggagtcctacttggtgctggcgctggaggtggcactgctggggctggggcagcagcgggccctgccggaggggctgtacgcccaggacaaggtggtgcgcaacgaggagcagctgctggccctgctggaggaggtggagttggatgagcggttggtgcaggtgctgcgcaagcaggcggngctgctgctgg

SEQ ID NO: 11240 - DNA, 439 bp, Homo sapiens
  misc_feature 390: n = A,T,C or G
ttcgaattcggcacgaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatgggacccaagttttaaacttagatgtgcttcatcttagtgaaatttaattcacaaggaatcatacattgtgttnttgaggctgcgcgcagtgactcacacctgtatcccagcaatttgggagg

SEQ ID NO: 11241 - DNA, 396 bp, Homo sapiens
cgttgctgtcggctccctggaggtgaaggagggacgtcccaaggaagggtctttgagaaaggggtaggggacgacatcaggagaaggctcccaggaactgtctcaggggagcgaaggttttgaggggacagctggggtctccagtatatataccacggtgcaggctgagggaggtacttcttggcacaaggcctcggaaagttcaggagccctggaaaggagaaggaataagacggcaggaggaagagagagagagggtagaatggaagaatctcacttcaattctaacccagacttctggccttctatccccacagtctcaggtcagatcgagaacacaatgttcatcaacaagatgaaggatcagctgttgccagagaagggctgtggtctggc

SEQ ID NO: 11242 - DNA, 389 bp, Homo sapiens
  misc_feature 357, 384: n = A,T,C or G
aattcggcacgagccaccgcggcgcttttctcccttagatgccttttatgaacaagattttactagaagacatcactattactggattcttcatgaaagagcactggctgatatttatatcgggctattagctgagtggtagtctgcctggtcgcaattgcttctatagttgattgaatgctcttaacacggagagatgccctgtacagacttttggggaactgggtactgatgaacccgaacaggagttgcttctggttttaattctgctactactggtgcatgatttacagctaaaccagagaggagtctgcaatgccgagtggaagaaggaggaaaccggagtgtgagccaganctgggtgggcagcatggcttggatcancaact

SEQ ID NO: 11243 - DNA, 372 bp, Homo sapiens
  misc_feature 21, 22, 24, 25, 26: n = A,T,C or G
tacggctgcgagaagactacnnannnaagcacggaaacaggagcccgagccataaatgtaaatacccagcagaactggattgcgccgtggggaaggctcctcaggataaaccctttgaggaagaagaaactaaagagatgcccaagctgcagtgtgaactctgtgatggagacaaagcagtgggggctggaaaccaaggaaggccccaccgacatcttacttctcggccatatgcctgcgagctctgcgccaagcagttccagagcccttccacactcaaaatgcacatgagatgtcacaccggggagaagccataccagtgcaagacctgcggacggtgcttttcggtgcaaggaaacttacagaaacatg

SEQ ID NO: 11244 - DNA, 386 bp, Homo sapiens
gatcccatcgattcgaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctcttcagtatgtgccagagcaagccc

SEQ ID NO: 11245 - DNA, 378 bp, Homo sapiens
  misc_feature 351, 353, 355, 356: n = A,T,C or G
tcggcacgaggagagaactagtctcgagactagttctctccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccacccttgtgaaccaggctgcacagccctggccttgcgcaccacattgacctcactgcagacatncntnngcacaaccctgtccaagtgtcc

SEQ ID NO: 11246 - DNA, 387 bp, Homo sapiens
tcgaattcggcacgaggagagaactagtctcgagactagttctctccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagaccatccctgccaacaaacccctgtcccaggtg

SEQ ID NO: 11247 - DNA, 391 bp, Homo sapiens
cgttgctgtcgctttcagtcacccttcagggcagtgagctcccctctggcaaaaagcaagtccagagatgtcatccaagaacctaaggcctagactcagggaccccaagaggggtctctatttgttgctttaccccactgtggccaaggtggtagcaagtgcaaggcaggctgggcgcagtgtctcatgcctgtaatcccagcactttgggaggctgaggcgggcagatcacttgaggccaggagttagagaccagcctggccaacatggcgaaaccctgtctctactaaaaataaaaaaaattaggccgggagcggtggctcactcctgtaatcccaacactttgggaggccaaagtgtacggatcatgaggtcaggagtttgagatcag

SEQ ID NO: 11248 - DNA, 358 bp, Homo sapiens
cgttgctgtcggaagcgatgtgctcactgtgtgagcaagttcactgttgcctacagggctggaatggtagaagactcttgaagcttaactcattccccacaaggcatgcaattttttccccagtattttattgactggtttgatggttcaggcttcaggtctgtaggggagtgcataggaagtgattgtggccaaaacatgtgagtaaatgcaacacccaatggtgagcaaaggtcccatccttgacagaggtggctggaggagctctcagtgagttgcatcgagattttttttttttttttttaaaacaaagttggttttttgtgccccaggcgtgaatacaagtgcttaatctccg

SEQ ID NO: 11249 - DNA, 380 bp, Homo sapiens
cgttgctgtcgctttcagtcacccttcatggcagttagctcccctctggcaaaaagcaagtccagagatgtcatccaagaacctaaggcctagactcagggaccccaagaggggtctctatttgttgctttaccccactgtggccaaggtggtagcaagtgcaaggcaggctgggcgcagtgtctcatgcctgtaatcccagcactttgggaggctgaggcgggcagatcacttgaggccaggagttagagaccagcctggccaacatggcgaaaccctgtctctactaaaaataaaaaaaattaggccgggagcggtggctcactcctgtaatcccaacactttgggaggccaaagtgtacggatcatgaggtcaggag

SEQ ID NO: 11250 - DNA, 372 bp, Homo sapiens
tacggctgcgagaagacgacagaagggggcattcggagggaagctgacatccacgccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtg

SEQ ID NO: 11251 - DNA, 367 bp, Homo sapiens
  misc_feature 18, 21: n = A,T,C or G
tacggctgcgagaagacnacnaaagggatcctctggggcacttagaggactctaatgagacccaatgttgtgtactgaactattcctgacttgtgaaattcatcttttatcccctactttaacttttttttttttgaaacagggtctaattttgttccccaggctaaagggttatagttaactacagtttccacctggccccaaaaaaaactcccccctcagtctttcaggtagttaaaaccacaaacccagcccatcaccctcagttaattaaccaattttattttttgtaaaacctaaatttttttacgaaccccaggctgatttaaaactctggggctaaggcaatcttttaaccctggccttt

SEQ ID NO: 11252 - DNA, 396 bp, Homo sapiens
ggcacgaggagagagagagagagagagagagagagagagagagagagagagagagagagagagagagagagagagagagagagagagagagagagagagagagagagagagagagagggagagccccccctctgtgtctctcacacctctccccccccttggggggatcttttatgtgtgtgtgtgtgtatatgtctctctctgcgtgcgcgctctctttttatacgcgtggctcttctctgttttatatcgcgcacacacacactctcctctagaaaaacacacacactctctcttctctctctgtctctctcatatatatacacaccctctcttgtgtgtgtctccactcacacactctcttttctcgagatatatatcttctctcctcttttt

SEQ ID NO: 11253 - DNA, 373 bp, Homo sapiens
ggcacgaggccacctgcaagaccgttctccaagtgaccttggactgacccacttctccccacttctcactaggtgacagagagaacagccttgctatctggtcaggagaatgacaacctattggaaaaagatctgtgtggttacaaggagtatggcacaaggttgctaactggctcggacactaacatgtcacctgtggatgctgggaataccatagccaccttttacggaaacttatattatgtttttggataccctgtaaaactttgctctgacaaggaacctcctttactgccccaggaacatgacagcaggcacactcatggaatagcctgggctctgcatgcacccttgtatgcttcagtccagtgag

SEQ ID NO: 11254 - DNA, 386 bp, Homo sapiens
ggcacgagcccaggaggaaccccctggccagagcagggcccctgtgttgaccgtggtgtccaagttcaaggcctcactggagcagcttctgcaggtcctacacagcaccacgccccactacattcgctgcatcaagcccaacagccagggccaggcgcagacctttctccaagaggaggtcctgagccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttg

SEQ ID NO: 11255 - DNA, 424 bp, Homo sapiens
atgcaccttagaagacacttcaaatgccgctactggatgattccgccggatcccatcgattccaacatcactgcccactctggccccatcactagcatcgccttctctgagaatgggtactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacaggcctgagggcc

SEQ ID NO: 11256 - DNA, 372 bp, Homo sapiens
  misc_feature 372: n = A,T,C or G
ttgcggcacgtcgagtgcgccctgtccggcggcgtggacagcgccgtggccgcgctgctgctgaggcggagaggttaccaggtgacaggggtgtttatgaagaactgggactcactggatgaacatggggtctgtactgccgacaaagactgtgaagatgcttacagagtttgccagatcttagacatccctttccatcaagtgtcctacgtaaaggagtattggaatgatgtgttcagtgactttttgaatgagtatgaaaaaggaaggactcccaatcctgacatagtttgcaacaagcacaatcaaattaggtgcttttttcattatgctgcggataatcttggggcagatgccattgccacaggtcan

SEQ ID NO: 11257 - DNA, 223 bp, Homo sapiens
  misc_feature 24: n = A,T,C or G
ggcacgaggcaagacagacctgangaaagacaaggagcagctgcggaagctcgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcaga

SEQ ID NO: 11258 - DNA, 312 bp, Homo sapiens
  misc_feature 106: n = A,T,C or G
tacggctgcgagaagacgacagaagggggtcacaaaggtattgacttttggtcagaagttccagggggcgagaagaatgaactaactccatgcattctttttgtgnttttggttttggtttttttgagacggagcttcctcttttgcccagctggagtgcggggctcaatctcgctcactgcagctccgcctcccaggtcacgccttcttctgctcaggcttcgagagctggactacagggcccaccacacgccagctaatttttgatttttagagagacgcgtttctcgggtagcaagatggctcgactcc

SEQ ID NO: 11259 - DNA, 361 bp, Homo sapiens
tacggctgcgagaagacgacagaagggagcatctagtacattctgatctatttatagaatgaagatttcaaattcagatcaaataattgagaaagcctttcacaaaaagggattgaaggccacaaacaggtcatatgctatgaacattctctcagttgtttactatatagtattcaatatatctttattgaacttctattatgttctaggttcttaacaaaatactagctaactgaatccaacaacatatcaaaaagataatccaccataatcaggtgggtttcacaccagggatgcagggatggtttaacatacgccagtcaataaatgtaatacaccacataaacagaatcaaaaacaa

SEQ ID NO: 11260 - DNA, 395 bp, Homo sapiens
  misc_feature 120, 121, 124, 125, 126, 127, 128, 130, 133, 134, 135, 139: n = A,T,C or G
ggcacgaggaagagagaggcagtggcagagggggggcaccttttatttctatttttaaagggacaggacactaattctaccccacttcaaccttgaattcaggggggtggggggagggcnnttnnnnntnttnnntcanattcaaaaattgattcctaaaaaaactttcctgttccgtgtgggaaacatgttgctacaaagattgaagaaaaacatcatgctttttgtagacctatttctcccccctaacttcccccgttgattgatttcaacttctccctggcggagacccttcaacttgaaaacctcctactctttttgtgtaacaacctataatgttctttaacacctaaacagtggcggcctcttcttttcttagaatactacaaagtggg

SEQ ID NO: 11261 - DNA, 381 bp, Homo sapiens
  misc_feature 371: n = A,T,C or G
ggcacgaggctcggcctgcaaggctgttgtttcaagaaatgaaaatgaagggcgccctggaataggttcgccgaagagagagcttgcaggcctctgggaagcaagccatcgtgtggcagaggcccaggtggcaaggaaccaagggcggcttctggccaacagccagcgaggacctgagaccgtagcccaacacccctccaggaactgaattttgccagcaaccagtgagtgaccttggaagtggatccttcccccgaaagcccggctttcagacggaggctggtgggacctcaaccccagcttgtatccaggctcttgacaccatctggagaaggaattcaagagtgtgtcagaaaatgatgaaagtacanagatttattg

SEQ ID NO: 11262 - DNA, 413 bp, Homo sapiens
  misc_feature 215: n = A,T,C or G
tacggctgcgagaagacgacagcagggagaaacagaaacttggtcttccagccccttatcagcctgggcacaagagcgacactctgtctcaaaacaaacaaacaaacatttaaaaagcgtctttggatttaaaccctcatctgttttctatttcatttattctttggtttggtttgagacagagtcttgctctgtcacccaggctggagtgcagnggcatgatctcagctcacttggcctccaaatgctgggatacaggttgaaccaccgtgcccagcctatttatttattcctaaatatgtagatgtgcaggggcagggctcacacctgaatcccacacttgggaggcaggcaggcgataacgagccaggagacgaaacatcggactacatggtgaaccttgctttctaaag

SEQ ID NO: 11263 - DNA, 386 bp, Homo sapiens
  misc_feature 188, 214, 265, 268, 274, 275, 276, 281: n = A,T,C or G
tacggctgcgagaagacgacagcagggagaaacagaaacttggtcttccagccccttatcagcctgggcacaagagcgacactctgtctcaaaacaaacaaacaaacatttaaaaagcgtctttggatttaaaccctcatctgttttctatttcatttattctttgttttgttttgagacagagtctntctctgtcaccaggctggagtgcagnggcatgatctcagctcacttggcctcccaaaatggctggaattacaggtgnganccaccnnncccanccctatttcatttattcttaaattatggtagaagcgccaggtgctttgctcacacctgtattcccagcatttggaatagaaaaggggggggattcgtggccaggg

SEQ ID NO: 11264 - DNA, 410 bp, Homo sapiens
gagcccagctagtagcttggtcgaacctttgtacgttgcggcctacgtctgcgagaagacgacagttgggacagagtaaacaaacactccacagaatggaagaacattttcataaactatgtacctgacaaaggtctattatccagcatctgagagcgtcttaaacaaattcacacgaaaaaaaacattaaaaagtgtgcaaaggacatgaacactttaaaagaagacatacatgtgaccaacaagcatataagaaaaactcaacatcagtgatcattggagaaatgcgaatcaaaaccacagttagataccatcccgcaccattccgtatggctattactaaaaagtcaaaaacatagcagatgttgtgaggatgcgaaaaaagggatgcttatatgcagttgataggg

SEQ ID NO: 11265 - DNA, 381 bp, Homo sapiens
  misc_feature 318: n = A,T,C or G
ggcacgaggagagagagagagagagagagagagagagagagagagagagagagagagagagagagagagagagagagagagagagagagagagagagagagagagagagagagagagacacccctctctctctctgtggggggggcgcggggcgcccccccccccgggggggagacactccgcccccgcgcttggggagagaaatatatgaggggtggggcgcgtttataaagaggggggggcgcgtgtgtatacacagaacacacgcgctctctcgcgcgggggggggcgcccccacacacccgtgtctcttttttntgtggggggtccctggagggccccccaaacacgcgacacacctgtgtgtggtgtgcggagggt

SEQ ID NO: 11266 - DNA, 372 bp, Homo sapiens
tacggctgcgagaagacgacagaagggatcctctttggcactcagaggactctaatcaaacccaatgttgtgtactgaactattcctgacttgtgaaattcatcttttatcccctactttaacttttttttttttgaaacagggtctatttttgttccccaggctaaagggttaaagctaactacggtttccacctgggcccaaaaaaaactcccccctcagtctttcaggtggttagacccccagacccaggccttcaccctcggttaataaaccaatttaatttttgtgaaaaactaaatctttttacgtagcccaggttgatttcaaactccggggttcaggcaatccttctcacctggcctttaaagg

SEQ ID NO: 11267 - DNA, 389 bp, Homo sapiens
  misc_feature 389: n = A,T,C or G
ggcacgagggttgctggaatggctgtatcatagcgatatttatctcttcctgctcctcgataggccactggccctgcaccctttaccttctccactctttgatcaaaaacagggtatatgaacaaattttctagtcgagttttcaatgggaatttgttcttacattatggctcccgaggggaagcgattactttttttaattttaaattttttttttaattgcacttcttgtaaagagggagaaaaaaaatcaaaggcgctttgaaacgggggctctctgtgcaaggatgactaagggtacgtctttccgtgtgggatgctggggaacagccagatttattatatttttttgcaagcattgaataatctaggttttaaatattattatn

SEQ ID NO: 11268 - DNA, 354 bp, Homo sapiens
tacggctgcgagaagacgacagaaagggtgatacatctacaagtcaactcgttttattacgagtctagcaaaaccttgattcaaaaacttgtcgagggcagaaggacaaaagaaattacagcccagtatttctcagggacacagatgcaaatatcctaaggaaaatatcggtgaacaatagaacaatgcataaaagagaaaatatattacaaacaagttggttttaccccaggaatgaaaacttagtctaatattagaaaatcagaaaatatagtttaccacattaaaaattaatggaaagaattatacaattacctcaacagatgcagaaaaagtatttgataaatctcataa

SEQ ID NO: 11269 - DNA, 632 bp, Homo sapiens
  misc_feature 383, 446, 449, 507: n = A,T,C or G
tactgttgcgagaagacgacagaaaggggaatcccagtactgtgtgtgccctgttcactcctcctttgctttcccgttttcagtatgcttgaaacttttcaaaataaaaagtttgggagaggaggaatctaagtaatcctcataaaattaaataattaaatcaaaggccccatttccaactcctttttggattaaagaaaataatttataaatgaatagcttctataatatgaatccatctttataaaaagtaattcattggccgggtgtggtggctcacgcacggcctgtaatcccagcactttgggaggccaaagcaggcgaatcacgaggtcaagagatagagactatcctggccacatggtgaaccacgtctctactanaatacaaatttaacttggctaatggcttgcgcctgaaccccaactacttgggaggctgaaganganaatcgcttgaactctggagcaaggttgcagtgagtcaaaatcttgcactgaactcagncttgggacaaacgagactcctttcaaaaaaaaaaaaaaaagcgccgggccggggctcccctttatcccccttttggaggcaaggggggacccaaaacagaaaggacccccctattggaggtaacc

SEQ ID NO: 11270 - DNA, 609 bp, Homo sapiens
tacttttgcgatatagacgacagaagggtacggctgcgagaatacgacagaagggtaaagacagaaagttacagagttgtggggaaaacatccactcttttaatagagaggactcagttttcttaagtaatgaaagacctgataaaacacaagatcaagtacaggaaattattttgataaaacacaaaatctttctttggcagattacttaaaaggtgaagaaaaacctcttataatttttttccttacgtccttccttccctcctcctccttcctgctccctccctctattactttccttttctttttactttcctttccctctctttatctttctttctttctttccttggtttttttgggcaaagccatctctttttgatcccgatacggggagaaggcaacaatttgggatccctgaccctcttgcttacgaattaaaacatttttctgctaaaatccaaaaaattggcggcacagggggggcccctgaatcccaattctctgaggctggagaagaaatggatgaccccgtagcggggttgcaagacccaattgtcctgcctccacctgggacgaggggatccccccaaaaaaaaaaaaaaaaac

SEQ ID NO: 11271 - DNA, 456 bp, Homo sapiens
  misc_feature 456: n = A,T,C or G
gaattcggcacgaggagcggcaggaatttcggccccaggcatctagttaaattattggtttattattattactatcatcatcatcgtcatcattattattgctgtaacaatcagactaaataaagccagggcctagccagccaaccccctccaacgtttttatttcattctcttctctattaataacaaccacaactaatgcctgttaattaattcccccttcagccagggctgcttggaagctaattttggttaaatcagcagaggctaatggtaataataataaagggattgggtcagcctggtcaattgaactctggttctccctggaaggacctgctgctttgcagacccatgtgtatttccagaaaccaatcggaactcagggttacactgattcccttttgagataaatctgtgccatgaagaaggggattatgtgagggaggacttttn

SEQ ID NO: 11272 - DNA, 402 bp, Homo sapiens
  misc_feature 55, 402: n = A,T,C or G
ggcacgagaaggcagacataagcggcaacatcacgatgaggaagctgagactcanaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtaccaactgtgtgaccttgggcaagtccgtgctcctctgtgagcctcagtgtctctgcctgtaaaatgggataatgacagcaacatcaggtttgccaccaggatcatataagaaaatcaaagctgtgtacgacaccaacn

SEQ ID NO: 11273 - DNA, 400 bp, Homo sapiens
tcgaattcggcacgaggctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggagcaaacccatttatatcagctttgatattgacgctctggatccctgctatgcgccagggacagggacaccctgaaattgctgtctcacttctaggcaggctctggagatcatcaagggcttgcaa

SEQ ID NO: 11274 - DNA, 415 bp, Homo sapiens
  misc_feature 382: n = A,T,C or G
ggcacgagcaagaactgggacgtcgagtggtctggagattacagcctctgccccaggtgcacccagctatatgagaaaggtggggaccgggcaggggaactggatgctgggggccacaaggggaatggccaggctcttttacaggctttagcacagaccctcttttctcatggctttccaccttgtagctatgggactatctcttcaactcagggaactcttccacaggagtccatccagtatgtaaaacagggacacatagctcctctgagggtggtgggagtggaaggcctgggaccccactgtcctgtgtctgaggtacttcctggaacctcacgtctccatttggcgggttggaagccttattcaggcagtacattancaaggccctgtgtcttgagagtctgaaaagagc

SEQ ID NO: 11275 - DNA, 365 bp, Homo sapiens
tacggcttgcgagaagacgacagaagggtccagaaaaacagttgaatgtgggtgatggactttgaaatggactcttgaagttgacggtgttcagtaagggtgggcgcctgagtgctctgcgagggttgtgcctcctccccctttcttttgagatggagtcttgctctgtcacccaggctaagtgtagtggtgtgatcacggctcactgcagcctcaacctcccaggctcaagtgatcctcctacctcagcctcctgagtagctgggactacaggtgtgcaccaccatgcccagctaatttttttgtattttttgtaaagacgcagttttgccatgctgcctactgggtagactcctgggttcaag

SEQ ID NO: 11276 - DNA, 383 bp, Homo sapiens
  misc_feature 383: n = A,T,C or G
ggcacgagcaagaactgggacgtcgagtggtctggagattacagcctctgccccaggtgcacccagctatatgagaaaggtggggaccgggcaggggaactggatgctgggggccacaggggaatggccaggctcttttacaggctttagcacagaccctcttttctcatggctttccaccttgtagctatgggactatctcttcaactcagggaactcttccacaggagtccatccagtatgtaaaacagggacacatagctcctctgagggtggtgggagtggaaggcctgggaccccactgtcttggtgtctgaggtacttcctggaacctcacgtctccattgagcggtttggaagccttattcaggcagtacattagn

SEQ ID NO: 11277 - DNA, 389 bp, Homo sapiens
  misc_feature 128, 129, 130, 131, 133, 142, 145: n = A,T,C or G
tacggctgcgagaagacgacagaagggggattcgagtgattctcctgccttagcctccagagtagctgggattacaggtgtgtgccaccacgcctggataattttgtatttttagtaaagatgggggnnnntncatgatggnccngggggggtgaaactcctgtcctcacgtgttctgtgcgcctggcccttcctaagtgctgggagaactcccctttaagtttgctacctagtttggacttccagtgccccctgggggggggggataatttgtgcctttttagaacagacggattttttccttttttttcacgaaagtgtggttctcctaaccttgagcgattcgcccgggtcggtttcctctttttcttggcctccccgccctcgcg

SEQ ID NO: 11278 - DNA, 650 bp, Homo sapiens
  misc_feature 575, 618: n = A,T,C or G
tacggctgcgagaagacgacagaagggtttacgtacatttaatcctcacagcaaccctacgggataatatcgatgtgcaccatttctatagaaatgggctctatctttaaaagaattcagacagcttgttaatctacctccccttccccttgctaaaaagggtgtgaaaagttgcggtcattgagatcagagaaagaagtgcactgggggggtcaaccaatgacgtttttttgtcaaactgaagctttgcttagttcctagtcaagagctctgcttagtgatctatctgcccagggcttagggaagtccctgagcttatttgtttctcagccgaactgcctcaactccagtggggaactgtggcaagctccagagcagtgacttaagtggttggtaagtggctcagccccaaaaaacagtccccaagccatttcttttccaaggaggtttcagggaaaggagcactgctggtctctctttgtgaaaagatctttatttgtgaaggcattcactgtatgccactggcctttggcactgccaaagctgggtgcagtggctcacccctgtcataccangacctttggggaggctgagaatcgaagaataccttgagcgcanaggtggagatcagcctgggcaccataatgaga

SEQ ID NO: 11279 - DNA, 446 bp, Homo sapiens
  misc_feature 381, 438, 446: n = A,T,C or G
attcgaattcggcacgaggaggactcggaagtcttcatgatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgccggcacttctgggtgggtgacgagctgtactgtgagaagcatgcncgccagcgctatctcgcacctgccaccctcagctctcgggcctgagcccgccatgcnctcagccn

SEQ ID NO: 11280 - DNA, 391 bp, Homo sapiens
  misc_feature 51, 52, 53, 54: n = A,T,C or G
ggcacgaggctgctcaggtctctccacactccggctcactatagccctgcnnnncgcagcagggctggctggctagcccagaggaaggaacaacgtacagtgaaaagaaccccagaccaggaaccagggaggctagctccactttctgtgtgacctttggcaagtggcattgcctgacttgtttcctcactcacattcaacttagaattgctgtgcatatactatgtgccgggcaccgtggtgtgtacgttaacaagcattgggtctttaaatcttcccaacaatcctatgcggaattgccccattcccatgtcacagatgagaaagcaggaactcagagaggtgaagtgacttggccaagggcacacagcaaagaaggaatcaggtctgg

SEQ ID NO: 11281 - DNA, 363 bp, Homo sapiens
  misc_feature 363: n = A,T,C or G
tacggctgcgagaagacgacagaagggggtaggttttgtatgactaactcaattttggaactcatcgttggtttgttcagggtttccatttcttcctggttcaatcttgagaggttttatgtttccaggaatttctctatttcttctagttttctagtttgtgtgcatagaggcatgtggaatagtctcagggtttcttgtatatctgtgggtcagtggtaatgtcacctttgtcatttctgattgtgtttatttggatcttgtctttttttctttattaatctagctagtggtcttcccatgttatttatgctttcaaaaatatcaactctgtatgaattaacagcatttgccgtgacctgn

SEQ ID NO: 11282 - DNA, 392 bp, Homo sapiens
tattgttgcgagatttactacagaaggggaaggacaggctgtgttacgcggaacactcaaatcttcgcttctaattactctcctgagattgcttgtactttctggcccttttgggattgaggacttgctcattgtttgaatcttggacctttattccttcggaattagaaccataggtccccatgggctgatctcccatgtccattcccttctgctgtttgcgcaggtctaagacaatcaccttttccctcctcccacctcgggcttatctgtgacctcctactacctggaatttggaaactattatatacttttgttacaggaactgggtcctgctcaagaccccaagagaggggtcttggatctccgacaaaatagaattcagggggagg

SEQ ID NO: 11283 - DNA, 401 bp, Homo sapiens
gattcgctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccgg

SEQ ID NO: 11284 - DNA, 436 bp, Homo sapiens
agagaatacagctacttgtgcggtttgccagagactctaaattcgaagttggcggttcgtgaatgtcttatccgtgacatcagacgaagagggaaaaatattgttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatg

SEQ ID NO: 11285 - DNA, 365 bp, Homo sapiens
tacggctgcgagaagacgacagaaggggatgtattttgagatatttgatgtgtttcaaaccgactttagatgatattggctactgtgcaaacactaagaaaagttagtgcagccccactaatattagacaataagcctactttaagacaagaagcgttattaaaagaatatttgatgatgatacaagggtaaatccagagtgtaatataataatactaaaattgtgaggacttaacatatggaaaatagttaatgaactaaggagaaatctagcaatttagaattctattataaagttaagtatatcttgggccgggcggggtggttcacacctgtgatttcagaactttgtgaggccggggagg

SEQ ID NO: 11286 - DNA, 455 bp, Homo sapiens
  misc_feature 334: n = A,T,C or G
ggcacgaggtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagccacatctgtggtgcaaaatgctgacattntcccaagaggtacacaaggtgggagaggcctgctgtatcaaaggtggtgtgtaagaaacaggggcctgattagtagcagagaactgcgtgagaaaaatgccagagaaagggacttgcaact

SEQ ID NO: 11287 - DNA, 367 bp, Homo sapiens
tacggctgcgagaagacgacagaaggggagataaaaattcttaggagataaacttcattatggaaaatttcattaaatttttataaatattgagaagggaaatagcgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagttattgaattttccagttctg

SEQ ID NO: 11288 - DNA, 351 bp, Homo sapiens
  misc_feature 6: n = A,T,C or G
tacggnctcgagaagacgacagaaggggagataaaaattcttaggagataaacttcattatggaaaatttcattaaatttttataaatattgagaagggaaatagtgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagttatt

SEQ ID NO: 11289 - DNA, 363 bp, Homo sapiens
tacggctgcgagaaaacgacaaaaaggaagatggggagtgcacagcaatggacagaatgaaggatggctggtcccacagagttagctgtggctaaaaaaaactgtctctagagagaggagagattggtgggcagtttttgtgactcggacacattaaaacacatacatactctcaaatgaagttgcattcaggcaaatgcaaagaaatacagaattcatatttataaaaaccaaaagaaaaaagggaaaacaatgccttgtgtgagaataataaacatcaaattctattattattatttttttaagatggggtctccccctgttgcacaggctgcagtgtagtgacacgaacatggttcatgg

SEQ ID NO: 11290 - DNA, 379 bp, Homo sapiens
  misc_feature 356, 370, 371, 379: n = A,T,C or G
tacggctgcgagaagacgacagaagggtcattatggaaaatttcattaaatttttataaatattgagaagggaaatagtgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagttattgaattttccagttttgctgattatcttataanaagtttataatggnntttttcan

SEQ ID NO: 11291 - DNA, 375 bp, Homo sapiens
  misc_feature 27, 28: n = A,T,C or G
tacggctgcgagaagactacagaaggnnaattatggaaaatttcattaaatttttataaatattgagaagggaaatagtgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagttattgaattttccagttttgctgattatcttataaagttttataatggttttttt

SEQ ID NO: 11292 - DNA, 348 bp, Homo sapiens
  misc_feature 2, 3: n = A,T,C or G
tnntgctgcgagaagacgacagaaggggagataaaaattcttaggagataaacttcattatggaaaatttcattaaatttttataaatattgagaagggaaatagtgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagtt

SEQ ID NO: 11293 - DNA, 361 bp, Homo sapiens
tacggctgcgagaagacgacagaaggggagataaaaattcttaggagataaacttcattatggaaaatttcattaaatttttataaatattgagaagggaaatagtgtagtataatcctcctgtattcatcatccagtttaacaattgtcacctcatacccaatcttttttcacctgtactgtcccccacctggattgttttgtagcaaatcccagacatcgcatcattttgtccataaatatttcagtatgcctctctaaaatagtaaaactctttacaaaataaccttaatatcaatattgtacctaaaataatgaacaataattacacaatcttatcagatagttattgaattttcca

SEQ ID NO: 11294 - DNA, 363 bp, Homo sapiens
  misc_feature 363: n = A,T,C or G
tacggctgcgagaagacgacagaagggtattaccctattgacctgccacatggtagagataatgatcagtaaatactgaaggaactcggagactggtggcggcagggggaaggcagggttcctccgtatgctgagcgccagtcccctgggcccacttttcttttttttttttttaattttttaatccttaatggaaacggagtctcgttttgttgttcaggctgaagggcgggggcacaatcggggttaattgaaagctccgcctgcggggttaacccatttttcttgcttaagcttttccaagaagttggaactacgggcccccgcccccaccccgggttaattttttggaattttaagaan

SEQ ID NO: 11295 - DNA, 378 bp, Homo sapiens
ggcacgaggtagtcccagctactcctgggactactcgggaggctgaagcaggagaatggcatgaacccaggagacagagcttgcagtgagccgagatcgcgccactgcactcaagcctgggcgacagagcgagactcctctcaaaaaaaaaaaaaaataacctgggggggggggggcatgcttgaacctcccgggttactcggggggctggggcgggaaaccctttggaccccaggagggggaaatggcagggagctgaaattgccccaccgcactcaagctgggaaaaaaaacaaaactccgtttcaaaaaaaaaaaaaaaaaaaatttgccttttgggaaaaaattaaaaccccccttttcaaaaatttttttaag

SEQ ID NO: 11296 - DNA, 394 bp, Homo sapiens
ggcacgaggtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcaaaggtgtgtgttagagaa

SEQ ID NO: 11297 - DNA, 392 bp, Homo sapiens
cgttgctgtcggtttatccttctgcaccacttgtttcccacctgggacctccagcaagaagcaggtgggcttagagaacttgctgtatttcgggacactgaacgtgtagatggttctggcactgaggcagtggtgttcgctggcagctggctggagagtgatctggactggctggccatggggagtgactggaaatagggtctgtttggaaaagaagcagagagtggcagagctgctgtggggactggtttcacacagccaggacagagtggggttggcagacatggtagggtgcttttttttggttttttctgattttttgtacgggataaggcttggttctgtcacccaggccaaagtgcagcggtgtgagcacagctcactgcagcctg

SEQ ID NO: 11298 - DNA, 394 bp, Homo sapiens
atcgattcgaattcggcgcgaggccccttggaccatcacagatgccgagcttcgggtaactcttacggtggagggatctgcagtcaaaactattgaacttctccattcagaccgccactcacacctatgggaaaagggtgtccacgcagcccctggtcacacttgaagcagtccggagaaatatcagccctaccccagcaatccccagaaggaacttacacttttttttaatcttttcctacaacttcatattttataaataaaaagacaaaaatgtcaggcctgtgagctgaagcttagccattgtaacccctgtgacctgcacatatccgtccaggtggcctgcaggagccaagaagtctggagcagccgaaaaaccacaaagaagtgaaac

SEQ ID NO: 11299 - DNA, 377 bp, Homo sapiens
cttccctggccactcgggccccattactagcatcgccttctctgagaatggttactacctggctacagcggctgatgactcctctgtcaagctctgggatctgcgcaagcttaagaactttaagactttgcagctggataacaactttgaggtaaagtcactgatctttgaccagagtggtacctacctggctcttgggggcacggatgtccagatctacatctgcaaacaatggacggagattcttcactttacagagcatagcggcctgaccacaggggtggccttcgggcatcacgccaagttcatcgcttcaacaggcatggacagaagcctcaagttctacagcctgtaggccctggcccttttgatggagg

SEQ ID NO: 11300 - DNA, 704 bp, Homo sapiens
  misc_feature 530, 590: n = A,T,C or G
catcgattcgaattcggcacgagcggagccagggactccagccccaaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctncagggtcactctcagagggtcttgctcaagctcacggggcctttgcttcggccaactggngagacaattccaaaatgggagtgggaccacccctagaccccttaaattcaacttcaaagccggtgaagaaagaacccgtgaacaatctaggccgtgctaagcctcatttatcag

SEQ ID NO: 11301 - DNA, 391 bp, Homo sapiens
  misc_feature 310, 391: n = A,T,C or G
ggcacgagcttgagtgcaggagttcaagattagtctatgcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttanaattacactgaacttttggaataccttgtatctccataaaatgccctctttttaaaagtagttacccgcagagctgtgctn

SEQ ID NO: 11302 - DNA, 404 bp, Homo sapiens
  misc_feature 17, 21: n = A,T,C or G
aattccggtgctgtcgngcgnacgtccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttccttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccc

SEQ ID NO: 11303 - DNA, 454 bp, Homo sapiens
ggcacgagaggacgccgcggtgaagttctccgtcatgatcctgaggggcctcttcctctgccccctcgttcaccccgcagaccagaaccaggactggagctgggtctccaggtacggccatctcatgccttgtttgcatccagcgcctatcagccactcaccacgacgggacgcggaagtggcaggtgacgggggtgtgtgccagcagatgcggatgccaggaagagtgcgagaacaggggtgggattaccgtctgtctgggaggggctccaggtacccctcttccccggcagacccactgggagatggctgcttgccaggcccccagaaagaacatctgtctatacggtgctgaaatcccaatcaaaaggattgtttagaaatgattttttcacaaggctgaccttctgcagctcgctgagcactcccagggcctcagcactcccaggtcggg

SEQ ID NO: 11304 - DNA, 400 bp, Homo sapiens
cgttgctgtcgctatgttgcaattcaagtcataaactctttgttctctgcaacaggaggtaccacatttatcttgttgactgtgaagattgttcaacctgaattgaaagcacttgcaatgggtttccagtcaatggttataagaacactatgaggaattctagctccaatatattttggggctctgattgataaaacatgtatgaagtggtccaccaacagctgtggagcacaaggagcttgtaggatatataattccgtattttttggaagggtctacttgggcttatctatagctttaagattcccagcacttgttttatatattgttttcatttttgctatgaagaaaaaatttcaaggaaaagataccacggcatcggacaatgaaagaaaagtaa

SEQ ID NO: 11305 - DNA, 394 bp, Homo sapiens
ggcacgaggaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgc

SEQ ID NO: 11306 - DNA, 370 bp, Homo sapiens
tacggctgcgagaagacgacagaaggggcaacagtggactgacagcctgactctacttccctcacttttctcccagcacacacagcttagtaaggtaggtggattattaaaacgtagctgtccccagaaaggtattaggcttttctagtctgctcattgaataatcaggacaaaaggggtagaagattatgtaaacacattttgaaatttttaaaaattcagggtttcatcctttattagtttgctaaggataccataacaaagtaccacaaactgagtgacttacacaatagaaacttattttcctgcagttctggaggctgaaagtccaggacaaggtgtcgacagctttagattcttctgaggcctc

SEQ ID NO: 11307 - DNA, 372 bp, Homo sapiens
  misc_feature 360: n = A,T,C or G
tacggctgcgagaagacgacagaaggggggttcaactctgaatatagcaaagccgtggggcatttatatccaatgaacagagtgagggggtccgtgaatggaaaattactaagaggagacaacgaagatagggaaattcttctaaagagactaacagaattcttgctgaaggcaggccagggtgattagatatcaaggataggggatttttgctagactgacttatcagaattcttgctaaaactggactaggcaggccaaagacaaggcccaaagatgaggcctatttgagaagagggcacaaagaacctggtctaaagtttgtttacagagacagtctttgttggtatcctctatggnggtacttgctaa

SEQ ID NO: 11308 - DNA, 646 bp, Homo sapiens
  misc_feature 328, 409, 414, 439, 519, 551, 633, 646: n = A,T,C or G
tacggctgcgagaagacgacagaagggactgtaagatacagaattgccgctgggcatggtggctcacgcctgtaatcccagtactttgggaggctgaggcgggcggatcacgaggtcagttcaagaccagcctgaccaacatggtgaaaccccgtctctactaaagatacaaaaaagttagctgggcatggtggcacgtgcctgtaattcgagctactcaggaggctgaggcaggataattgcttgacctcgggaggcagaggttgcagtgagcagagatcgcaccactgcactccagcctggatgacagagcgagactccgtctcanaacaaaacaaaacaaaaacagaattgccttctcagtaaaggaggaaataacatttataataactatcactttagtgatagntattntaaatctttgaaaaatggacacttncaaattaccgtgctcattataaattgagaaatacggttctattaataatattctgctaggccaggcagggtggctcacancctgtatcccagcacttgggagggcgaggtangcaaatgacttgaggtcagggagtcgagaccagtctggcccacatcatgaaacccctactaaaatacaaaaaatagctgggngggggggcatgcn

SEQ ID NO: 11309 - DNA, 373 bp, Homo sapiens
ctcccgcagtgctgggattacaggcatgagccaccgcgcccagctgcctttttttttttgagtctggctctgccactgaggctgaagggcaggggcccaatttaagctaactgaaacctttgcctcccaggttaaagcgatcccttttttttttttttttttgaaaaaaaatttaatttttccccccaggctggaagggaagggcccaaatttggcccccccccccccccaaattttttggttttttaaaaaaaaagggggtttccccggggggggaaggaggggccagaatccctgaccctgggaaccccccccccaaaccccccaaagggggggaaaaaaagggttaggaccccgggccggggccaaaaag

SEQ ID NO: 11310 - DNA, 381 bp, Homo sapiens
cgttgctgtcggtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatctttta

SEQ ID NO: 11311 - DNA, 362 bp, Homo sapiens
  misc_feature 362: n = A,T,C or G
tacggctgcgagaagacgacagaagggacagtttatttactcacaggttgtacagacaggaggccaggtacatcatgcagggccacatgggaaagacatcagggtggtctgaaggcagaagacacgagcaaggggaggatttaggccatgacctttactgggacttccatacaataggcaatgcagggcagggtgaacagtttatgactggctagtttgaataactgccttgggctttgggctacataaggatggtttctagttgcttggtacctggccctagtgtcagaagtgtcctggccgggcgcggtggctcacgcctgtaatcccagcactttgggaggccgaggcgggtggatcan

SEQ ID NO: 11312 - DNA, 415 bp, Homo sapiens
  misc_feature 408: n = A,T,C or G
tcccatcgattagcttgtttttgttctgagcgaagcattttatttatgagagaagacgacagaagggacagacccatggaacagaatagtgagctcacatataaacccacacatacacactcatctgacctgtgacaagagtgcagaggatacacaatgggaaaaagatagtctcctcaacaaatggagttgagaaaattggatatccacatgcaaatgaagaaaatcgaatctttatctgacataatacaaaaaatcaactcaaaatggattaaagagatggcataagacctgaaactgtaacactcctagaagacaatgtacaggaaaagctccatggcattggtcttggcagggattactttaatatgataccaaaagcacaagcaacaaaagcaaaatagacanatgagac

SEQ ID NO: 11313 - DNA, 608 bp, Homo sapiens
  misc_feature 414: n = A,T,C or G
atcgattcgaattcggcacgagatttgatgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagctcctttgagagactgaggcaggaagattgcctaagcccaggaggccaagtctgcagtaagctatggtaacaccactgcactccaacctgggcaacagagggagactctgtctctaaaaaaatagaagaatttgccctgcatggtggctcacgcctgtaatcctatccctttggaaggccaangggggcgatcacttgacgtcgggagttcaagacaaccctgacacatggaaaaacccatccggcttaaaatacaaatatactatggttggtgggccaggcttgaatccacattactcggaaggttaggcgggaaatccttggacccgagggggaggtcgcgtgaccagaaccgccctttcattcagctggcaaaa

SEQ ID NO: 11314 - DNA, 226 bp, Homo sapiens
ggcacgagcttgtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacgg

SEQ ID NO: 11315 - DNA, 279 bp, Homo sapiens
agggtagactgggagcccctgagtggaagctgctgctcaggccggggctccctgagggcagggctggggctgttctcatactggggctttctgccccaggaccacaccttcctgtcctctctgctcttatggggccggaggctgcagtgacccaggggcccccaggaatggggaggccgccttgctcatcgccaggcctcctcacttggccctaaccccagcctttgttttccatttccctcacatgtgacaagccgaggcggtgagccgggcaagagt

SEQ ID NO: 11316 - DNA, 476 bp, Homo sapiens
  misc_feature 32, 42, 44, 45: n = A,T,C or G
aataccaagcctacttgggttctttttgcacnggatcccatncnngattcgacacttcgtgcagccgagatgagaagaaggatggacgagtatctataacacgccatccgtgctacactagaaaccagtacgcaagccccgttggctaggaaaactgactatgtcatttccatcacccggatttacatcacggatcgcaccacacggctgactgtgctgactgaccgctccccatggctaactcacgcctgtaattccatcacttggggaggccgaggtgggtagatcacgaggtcaggagttcgagaccagcctggccaacacggtgaaaccccatctctactaaaaataaaaaattatccaggcatggtggtgggcgcctataatcccagctacttgggaggctgaggcaggagaatcgtttgaacccacgaggcagaggttgcagtgagccgagatcgcgccactgcactcct

SEQ ID NO: 11317 - DNA, 401 bp, Homo sapiens
  misc_feature 401: n = A,T,C or G
ggcacgaggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgan

SEQ ID NO: 11318 - DNA, 435 bp, Homo sapiens
  misc_feature 316: n = A,T,C or G
gattcgaattcggcacgaggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgngaggggttgacaacaactcttccaacaattctaattccagtaacggggactcagattccaataggcaaagtgtctcagaatgcaaagtatggcgaaatccactaaatttatttaggggg

SEQ ID NO: 11319 - DNA, 357 bp, Homo sapiens
tacggctgcgagaagacgacagaagggagtttggccctttgatgcattttgagtttttatatttttaatatggatattcagttttctggcacttatttgttgaaagagggtactttccctattgaatggtcttggcacccttgtcaaaaagtatttgaccattgtctcaatcagtttggcttgttataacaaataaccataggctgggtgcggtggctcacacctgtaatcctagcactttgggagcctgaggcaggcagatcacttgaggtcaggagttcaagaccagcctggccaaaacatgggccaacatggtgaaaccccaactctactaaaaatataaaaattagctggaag

SEQ ID NO: 11320 - DNA, 365 bp, Homo sapiens
  misc_feature 365: n = A,T,C or G
tacggctgcgagaagacgacagaagggggagaacatgtttaattagtataaactaaacatgttttgggggtgtaaaatgaatatgtttgcatcaaaagcatgcataagctgaagagatcaacacagcacatttaatggttaattaaacctatggtctcatagaagagaagagagtatgagttgtgaattctgatacttacaggatataggttattaccccgatactcctaaaaacaacacaaaacaaacaaaaaaacatgtcagaagaatagtcaaataaatcagaaagcaaacaacaccaaggacatactccttaccacatatctgcctcaagaccaagaggttcatagttgactatctcaggn

SEQ ID NO: 11321 - DNA, 311 bp, Homo sapiens
tacggctgctagaagacgacagaagggttataaattacccagtctgaggagattctttatagtgtgagaattgactaatacagcatccaaataggagaggaagtcaatccgtccaccttcagcgatgatataattctatacctagaaaatcctaccaagtctgccacaataattctagaataaacaactttagtaaagtcgcaggatacagaatcaatggacaaaattaccagctttctataagcaaccacatccaggctgagagtatagtcaagagcaaaatctatccacttacagtttcacagagagag

SEQ ID NO: 11322 - DNA, 452 bp, Homo sapiens
  misc_feature 332: n = A,T,C or G
cgaattcggcacgagaggacgccgcggtgaagttctccgccatgaacctgaggggcctcttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgagagatggctgctttgcaggcccncagaaggaacatctgtctatacggtggctgaaatccaatcaaaagtattgttagaaatgtatttcttcacagggctgacttctgcagttcgtgagcactcccaagtctcagcactccagg

SEQ ID NO: 11323 - DNA, 363 bp, Homo sapiens
  misc_feature 217: n = A,T,C or G
tacggactacgattgcgacatgacaacagacagggatgagttttgactatgcactgctattatgcaacgtgtcaaactctgtattccagacattagtgaagctattgctttatttggtcacctgttatacatctgcctatacaacgcttgtagccatcactcccacgctttccttttatagcttcatgttacaacgggcacagtgcgacgttcttanctaattttttaaatattttttgtagacacaaggtttcaccatgttgcccaggctggtcttgaactcccgggctcaagtgatctgcctgcctcggcctcccaaagtgctgggattataggcatgagctaccacaccagaccaagaag

SEQ ID NO: 11324 - DNA, 306 bp, Homo sapiens
tacggctgcgagaagacgacagaagggtattaccctattgacctgccacatggtagagataatgatcagtaaatactgaaggaactcggagactggtggcggcagggggaaggcagggttcctccgtatgctgagcgccagtcccctgggcccacttttcttttttttttttttaaatttttaaaccctaattggaacaggggctcccttttttgctcaagctggaaggggggggcaaaaacggggtaaattgaagcccccctgccgggttcacccattttcctgcttagcctttccgagagcagg

SEQ ID NO: 11325 - DNA, 359 bp, Homo sapiens
ggcacgaggctccttggagcagtacacctgactgtcccagccattggagagagcccagtgctggtagccttcgacggggatgagggcgtcgtgacgcggctccgggtgcccgctgatcccgggcaccaccgacacgtccaggttttaaatgctgagtgctcgtgtgcagccagcgcacagaccatggccacagagcagcgcctcgctcagccagacctactgcacccctcaagtggagagcaaatggacaggtctgcagaaaccccttcgggccacctccctcctctttgtggggagaaggtggtgtttgacgggtgagagcacccggacatcggagcactatgcggccaaaatttagg

SEQ ID NO: 11326 - DNA, 365 bp, Homo sapiens
ggcacgagaaacctctcacacacgtcgtatttgcatggtgaacatagccctgtccctcttgattgctgatgtctggtttattgttggtgccacagcggacaccacggtgaacccttctggagtctgcacagctgctgtgttctttacacacttcttctacctctctttgttcttctggatgctcatgcttggcatcctgctggcttaccggatcatcctcgggttccatcacatggcccagcatttgatgatggctgttggattttgcctgggctatgggtgccctctcattatatctgacattaccattgctgtcacgcaacctagcaatacctactaaaggagagatgtgtgctggcttaact

SEQ ID NO: 11327 - DNA, 222 bp, Homo sapiens
ggcacgagctggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcgatagcccaaaagaggac

SEQ ID NO: 11328 - DNA, 411 bp, Homo sapiens
cgttgctgtcgagcagagtgaaggttatttattaccctctttctctcaagtgctttaaagaagaaacctccctggggtttcttttcttttttttttttttttggaaaacggagtttggttttgtcccccgggcgaaggggcggggcaaaaatctaggtcaatggaaccctgggcccccgggttaaaaaaaattttcgggcctaaccccccaaggaggggggaataaaaagctgggcccccctgcccaagttatttctggtttttaaaaaaaaacagggttccccctgggggccggggggggtctaaaactccggccctaaggggaccccccggcttggccccccaaaggggcccaaataacgggggggaccccccggccccaccccctccttgggtgttaacccaacggag

SEQ ID NO: 11329 - DNA, 405 bp, Homo sapiens
ggcacgagcatccccttggtgaccttcaaagagaagcagagagggcagaggtggggggcacagggaaagggtgacctctgagattcccctttttcccccagactttggaagtgacccaccatggggctcagcatctttttgctcctgtgtgttcttgggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcagacccattcccggatctgctccagtgcctcaacctctccatcgtctcccatgccacctgccatggtgtgtatcccgggagaatcacgag

SEQ ID NO: 11330 - DNA, 404 bp, Homo sapiens
  misc_feature 404: n = A,T,C or G
ggcacgaggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggn

SEQ ID NO: 11331 - DNA, 358 bp, Homo sapiens
tacggctgcgagaagacgacagaagggctcgatctcctgacctcgtgatccgccctcctcggcctcccaaagtgctgggattacaggtgtgagccaccgtgcccggccctgtatatgaatatttatagcagttttattcgtaatagacccaaactggaaacaatcagatgcccctcactgggtaaatggccaacaaacagttgcctatccacaccatagaatctgaacattcacgctactctgcaataacaaggaacaagctggccaggcacagtggctcatgcctgtaatcccagtactttgggagactgaagagggaggattgcttgagcccaggagcttaagaccagcctgaact

SEQ ID NO: 11332 - DNA, 378 bp, Homo sapiens
cacgagctttgcccgagcgccacagagaacgcgagccgggagtccgtggaggccatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaattgatcaaattatttcaactcccgccatgtgacgcaaagctgcgagctaagacagggactgttgccaattttccaagctgtcag

SEQ ID NO: 11333 - DNA, 392 bp, Homo sapiens
cgattcgaattcggcacgaggtagtcccagctactcctgggactactcgggaggctgaagcaggagaatggcatgaacccaggagacagagcttgcagtgagccgagatcgcgccactgcactcaagcctgggcgacagagcgagactcctctcaaaaaaaaaaaaaaattacctgggggggggggggcatccttgaacctcccgggttactcaggaggctggggcaggagaaccttttgaacccaggagggggaaattgcagtgacctgaaatcgccacccggactccagcctgcaagagacacagactccgtttaaaaaaaaaaaaaaaaagaagttttgtttggggaggaaacataagcccctgcttagcaggggttgttgaaaagggg

SEQ ID NO: 11334 - DNA, 392 bp, Homo sapiens
  misc_feature 349, 361: n = A,T,C or G
cgaattcggcacgaggatctttgacttaacttttgtatatgatgtaaagtcactgtcaaacatcattcttttgcatttggctgtccaggtatcccagcattatttgttgaaatgcctacacttctttatattcccttgactcctctaaccaaggcaggtggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggngctcctgaaggntcctgtctcagccttacacacattacctggg

SEQ ID NO: 11335 - DNA, 609 bp, Homo sapiens
  misc_feature 527, 566, 594: n = A,T,C or G
tacggttgcgagaagacgacagaagggtacggctgcgagaagacgacagaagggtcatgaaattccagtcattttacttttattaacatgcagctagaaccatgctagtgaataacttagatattagatactgtgcagccatattcaggcaggtcttaaatataactggatgcttgaaactttatctgagtcttcctaaaagtatctgggaagttaaggagaacgtttttgttggctggaagccatccttcctcatacaactaaatgatatttaatttaaaatatgaactttaccttaaatattaattagaacctaaaattaaaatattggccaggcgcggtggctcatgcctgtaatcccagcactttgggagcccgaggcgggtagatcatgaggtcaggagatcgagaccatcctggctacatggtgaaaccctgctctactaaaaaacaaaaaatagccggcatagtggcggcgcctgtaatccactactctggggctgagcaggagaatggatgaaacccgnaggcgtgcttgagtgagccgagatgtgcactgcactcanctggtgacgatgagactcgtccaaaaanaaaaaaaaaaaaacg

SEQ ID NO: 11336 - DNA, 621 bp, Homo sapiens
  misc_feature 438, 530, 565, 568, 621: n = A,T,C or G
tacggctgcgagaagacgacagaagggtacggctgcgagaagacgacagaagggtcacacctgtaatcccagcactttgggaggccatggaaggtagatcacaaggtcaggagattgagaccatcctggccaacatggtgaaaactcgtctctactaaaaatacaaagattagccagacatggtggtaggcacttgtagtcccagctactcacgtggctgaggcaggagaatcacttgaacccaggagacagaggttgcagtgagccgatgttgcaccactgcactccagtctgggtgacagaggaagactccatctcaaaaaaaaaaagaaagaaagggacaggtattttgatcaaattaccacatgtgggaaaccggaaaaggagggcccaataaattaaatgaatagaacttctaacagggaggccggggaattngtgccttagctcagacactccatgggacactctgagtcttctgcaaaacagggacagcaatttgggtaaaaacaaacctttgcaggtgcggnggtgctcatgcctgtatcccacatttggaggctgngcngtggatatgagttcagagtcagacaccctgcccgatgtgaaccctgcttctan

SEQ ID NO: 11337 - DNA, 402 bp, Homo sapiens
  misc_feature 77, 78: n = A,T,C or G
cgttgctgtcggggaggatcacttgagccccgaagtttgagactagccttggcaacatagggagacactgtctccanntaaaaaaaaaaaaaaaaaaatttttaaatgaaacttttcttttaaaacccaaggtttaaaatttaccacaaggggcccataggttaactaaacccaatgtttaccaaatcttttatttaaaataacaaaataatggggggaaaaaattatggggggcccgggggtggcaataaaaattttaatgctttaaaacgacatgaaaattctttatattgccaggcaagggcaagaactaacaatccaatttcaatttgggggaagaacccaaaataacaaccgggggaacaaccttggagagatttttaaaattagatcttttaggga

SEQ ID NO: 11338 - DNA, 398 bp, Homo sapiens
  misc_feature 398: n = A,T,C or G
ggcacgagatacgagaaactaatggtagttacaggtagtgagtaaagtgtgttatgtaggttcttctagcgccatcgctggctgataagggtctaaagttgtctctggtgactaacttttgtccctggtagaaagaggaggtgggacacctttgaaaatgtatgtcctgctcttaggtacatagtggaagggtagggagcttgttttgtacagatgctcctctacttactctacttaggatggagttacatcccaataaacccattgtaaattgaaaatatcattagttgaggcccagcgtggagcctcactcctgcctcagcctcccaagtagctgggactatagaaaggtcccccttctgggaaagaccgagtgaagaaaggtggatcctacatgn

SEQ ID NO: 11339 - DNA, 450 bp, Homo sapiens
gtcttttggccgaagcggcctacggctgcgagaagacgacagaagggtacggctgcgaaaagacgacagaagggttgtcagaagacatgggaacacatctttaaaaacatgaaacaaaagaactgtcaactcagaattctacatagagcaaaaattgtcaagaatgaaagcaaaaaaaaaaaaaaaagaaccccttttggggaaaaaaaaaaactttaaaaatccggcccggggggggggctccccccttgaaccccaaccttttgggaggctgggggggggtggtcccgaaaatggggaattggaacccttctgggaaaccggggaaaaccccccctttactaataaacaaatattaaccgcgccggggggaaggcccttttgccccacttcctggaagcttagccagaaaatggggaaccccggaggcgatttgcagaggccgaaacc

SEQ ID NO: 11340 - DNA, 388 bp, Homo sapiens
tacggctgcgagaagacgacagaagggtacggctgcgaaaagacgacagaagggttgtcagaagacatgggaacacatctttaaaaacatgaaacaaaagaactgtcaactcagaattctacatagagcaaaaattgtcaagaatgaaagcaaaaaaaaaaaaaaaaaacccccctttggggaaaaaaaaaaaatttaaaaatcccgcccgggggggggggctccccctggaaaccccaccttttgggggggcggggggggggggtccccaaaaccgggaaatggaacccttctgggcaaaccggggaaacccccgtttttataaaaaaaaaaaaaaataacccggccgggggggcggggccttgtacccccacctcctgggggggtg

SEQ ID NO: 11341 - DNA, 426 bp, Homo sapiens
  misc_feature 259, 367: n = A,T,C or G
tacggctgcgagaagacgacagaagggtacggctgcgagaagacgagagaaggggccacccagtttcacacaggccagagaggctgacctacctgcccagaggcaggggaagaatccagaggacctctcccggaggaggcacgagaagcccacgtggcagccaagaagagggagagcatcctgtgccccggaagcacaatgccaggggcagacatgcactgggaggcacggtgccagggacaccttcagtgagcacagngtctgggtagggcttcggaaggggtgagggcggaaaagcaagccaagccggtgtgtggaggccctgcctaatcttgttagactaggataggaacatgccaaaaatgtntacgcccgtggctcacacttgtattcactttggaagcttgagctggggaaaatctaagt

SEQ ID NO: 11342 - DNA, 382 bp, Homo sapiens
  misc_feature 382: n = A,T,C or G
tacggctgcgagaagacgacagaagggtacggctgcgagaagacgagagaaggggccacccagtttcacacaggccagagaggctgacctacctgcccagaggcaggggaagaatccagaggacctctcccggaggaggcacgagaagcccacgtggcagccaagaagagggagagcatcctgggccccggaagcacaatgccaggggcagacatgcactgggaggcacggggccagggacaccttcagtgagcacagggtctgggtaggcttcgggaggggtgagggcggagaggcagccaagccgggttgtgggaggccctgcctaattctgtaaagactaggattagaaacatgacaaaaatgggttaggcacggtggn

SEQ ID NO: 11343 - DNA, 395 bp, Homo sapiens
gattcgaattcggcacgagactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtgacacattcctaggaagacacaactatccaaaccactcagaagggag

SEQ ID NO: 11344 - DNA, 388 bp, Homo sapiens
  misc_feature 388: n = A,T,C or G
tacggctgcgagaagacgacagaagggtacggctgcgagaagacgacagaagggaagtctttcttgaagactgtccctcttaagcttccaattgatgtgtttacatcacaggatatttacgcattggatcatttgatgtgctgagactgaagacaatcacttcatgtgctacttttccaactctaactaaataggcctgggtgtgggtgtcagctgtcaacttctctaggaaataacatgtatctagcctattggggagcttctctagtcccctctgttagctagataaaacagctgctttttggaagtctgggccaatggcctgcataattgaggctttgtgttctaaggcaattatggctagtttatggcagcagaggcgttaagn

SEQ ID NO: 11345 - DNA, 394 bp, Homo sapiens
  misc_feature 394: n = A,T,C or G
ggcacgaggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggcn

SEQ ID NO: 11346 - DNA, 384 bp, Homo sapiens
  misc_feature 384: n = A,T,C or G
tacggctgcgagaagacgacagaagggtacggctgcgagaagacgacagaagggctattgtgctcttgcctgggcttctagacagcatcttagatcagataaaaaaaaaaaattaagagtggggggtatttactgaatgcttactctgtgggagctggtatattaaaagctttaggtacatttcttgtttagggtttccaacaattttacgaagtagttcttatttatacatggagaaacaggttcagagaagtaaagtaatcaaattcacatgcagctaataaatagcaaagctggccgggcacagtggctcacgcctgtaatcccagcactttgggaggccgagccaggtgaatcacgtgaggtcgggagtttgagatcacn

SEQ ID NO: 11347 - DNA, 470 bp, Homo sapiens
ttttggccgaagcggcctacggctgcgagaagacgacagaagggtctgttaaagctaaatatatgaatgctctgtgactctatagttatacccctaagtatggaaccagaaaagtgtacatatgcatgtagatatacatgctcaagtcttatgttcttagcagtagtttttttttttcttgagacagggtcttgctctgttgcccaaactgaagtgggcaggggggatcacagctcactgcagcctcaaactcctgggctgaagcaatccttccacctcagcctcctgagtagctgggactacaagggtacaccaccacgcctggctgaattttcaattttttgtagagatgaggacttcgtgtgttgccaaaagctgggctagaactcctggcatcaagtgatcctcctgtcttggcctccccaaagtgttaggattactgggatgaggccccaagccttggcctagcg

SEQ ID NO: 11348 - DNA, 344 bp, Homo sapiens
  misc_feature 144, 202: n = A,T,C or G
tacggctgcgagaagacgacagaagggtacggctccgagaagacgacagaaggggatccagaatacatttccaacaagagcactggccaagtcagcttcttctgagagagtctctagaagacatgatactacactcagctttgngtctctgcctcttactcgtcacaggttcttccaaccttgcattgcaataaaaaagaanaagacccccctcagaactctcaagagatggggggatgacatcacttggtacaacttatgaagaaggctctttatgctcaaaaaagagaagccataaggtaatcataactcgagatggcatactctaggcctaaagaggaatg

SEQ ID NO: 11349 - DNA, 624 bp, Homo sapiens
tctttctactgttgcgagaagacgacagaagggagccacactgcctagagagtaagcagagagagaattgtcattaacccaaagaccatcttcgaaaacagactggctgcggctgagtgcggtggcacacgcctgtcaccccagccctctggaaggccgaggcaggaggaccacttgagcccaggagttcgagaccagcctgggcaacatggcaagaccctgtctctatctttctaagtaaaacaaaataaaaagctcagaccggcagcacatggttctttccagctgttcccatgaacaggcttcaggacaagcccatgcaaaggcagggagaaatggggtggggacccccaagatcacccccttgtctgatgcgtaagtggaggtgggcaacaaagttacaagcttgggagggggccaatgctttggtgcgagcattcaccaacctgtgacaataagagaggagaaacaactccctcgacccggaaaggcttaaaaccctcccacacttctggccatattcactgcagaacacaatggggtcaggcgtgaaggtcacatctgtatcccacactttaggaggtgtggcagcgatactgagggaggggataacaacactgcgct

SEQ ID NO: 11350 - DNA, 348 bp, Homo sapiens
gctacggctgcaagaagacgacagaagggcctctatcactttttcgcattgtgtcccttttctctccttagtacaacaaatgaagaacaattttccaagagaagaaatgacacactggatcctgaactgtaagtacgatccccttgaatagtcagtacgctttggcttttctttttccctttcattctcttgaaggttgcatgaccaatcagatgatcctatattcttgggctaaatctacataacatacatctaatggatagtaaaaccatggaaaacactgaagtactaaggaacattatttcttaatgataattctaatgttcttaatgttgaatgtgaaacatt

SEQ ID NO: 11351 - DNA, 450 bp, Homo sapiens
  misc_feature 22, 403, 404: n = A,T,C or G
tacggctgttagaagattatcngaaggggggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaacaaagaatggaaaagaaaatacagagagaacgagaaatggannagggggagtttgatgataaagaagcatttgtgacatctgcatataa

SEQ ID NO: 11352 - DNA, 409 bp, Homo sapiens
ggcacgaggccctctggggttggcctcaaactgtgatcacccacacacccactttctgttgggtggcggctctaagaggagctccactggattcctgaacaggagactcaccccctcccctggccctgggcagagggagaacctgggccctgggtcagtggccccagagcagtgtctgcctcccacaggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatg

SEQ ID NO: 11353 - DNA, 394 bp, Homo sapiens
  misc_feature 343: n = A,T,C or G
cgttgctgtcgggggaatcaccatgtttgtgtggacccagtttctaagggcttgcatttgcatatcaaaggttgccaacctggctctaagagccggggctttacaagaaacttttctggagatgcttcaaaaaaatgaaaactccagcctgaccaacatgtagaaaccccgtctctactaaaaatacaaaattagccgggcgtggtggcgcatgcctgtaatcccagctactcgggaggctgaggccagagaatcgcttgaacccaggaggcggaggttgtggtgagccaagatcgcaccattgcactccagcctgggcgacaagagcaaaactccgtctcanaaaaaaagaaaaagaaacaaaacaaaaaacttcccaaggacccaaggaccc

SEQ ID NO: 11354 - DNA, 394 bp, Homo sapiens
tacggatgcgacaagacgacagaaggggggggaaggggctcacagccaccacggaatcaggttttccggggcaggaggggagccgcgatctctagggacacagtgtcccagactgtctttttcctgttggagtaaaatccattctatgtttaaacaggggctgtgtaagtggctcttccaagtgaaatgcaaacaggacgccttcctgtttctctaagggttctgttctcccttcggcatttgtgtcctcacccaggaactgaagtgccgcagccccaactcaccagagctccagcttcacgcgccggccgtccagcaggatggtggtggtcttgtagtcgatccctgcgaggaagcacagggcgctgaggggacgcgccactcctggagcgag

SEQ ID NO: 11355 - DNA, 389 bp, Homo sapiens
ggcacgagggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgt

SEQ ID NO: 11356 - DNA, 400 bp, Homo sapiens
  misc_feature 218, 298, 324, 341, 382, 384: n = A,T,C or G
cttctgattcggcacgaggttcattccataagcggcaatttccagtttctaagacattgccagagctctatgagttagtgaacaactatcagcctgaggttctgtggtcggatggtgacggaggagaaccggatcaatactggaacagcacaggcttcttggcctggttatataatgaaagcccagttcggggcacagtagtcaccaatgatcgttgnggagctggtagcatctgtaagcatggtggcttctatacctgcagtgatcgttataacccaggacatcttttgccacatanatgggaaactgcatgacaatagacanactgtcctgggctatanggaggaagctgaatctctgactattctacatttgaagaatngngaagcactttgagaga

SEQ ID NO: 11357 - DNA, 361 bp, Homo sapiens
tacggctgcgagaagacgacagaagggtacggctgcgagaagacgacagaaggggtctcaaaccctcggcctcaagtgatccccccacttctgcctcccaaacatttctgttgttttaagccaccagattagtaaaaatttgttatgtgagctctgtgaaactaacacaagttgaaaattacaatggtgtctccactctctctaaacttagggtggttgttagcttgggagaagtttcagaagaccagttttgaaacaaaaatattgattctaatataaagccattaagatgagattaatttagactatgaccaaaaatctgagccataaatcacacatttataaatatataaaaagttat

SEQ ID NO: 11358 - DNA, 362 bp, Homo sapiens
tttttttttttggggttctcaggttcttgttacaactgagtccggtttggaggaggtgtgggccccctccccccaggaaaaacagcactggaggcaaggtttctataaatcaaaaaaaaaacagtgtgaaaatgtcagccctcaactggaagccgtttgtgtacggggggctggcctccatcactgctgagtgcggattgcccccgcgatgttacgccaggcatcctatggcaccatcaagataggcacttaccaaagcttgaagcgactattcattgaacgcccaaaaaattcggatgcaagcgcaaagcaacaccattcaaggaggaatgataggcaacttcatgaacatttaccagcaa

SEQ ID NO: 11359 - DNA, 616 bp, Homo sapiens
tactgctgcgagaagacgacagaagggcagtggctgttcatgggcacgtttatcacatatggccccagttcctattgcctgggctggttcaactcctgggctctagctatcctcctgcctagacctcaaggtattgggattataggcataagccaccacaccctgccagatttgtgcattttaattttggcagattcttccaaacactcccaagtgttagaccactttatttgttctggaaatgtacagagtacccatcttcttataggtaggttatcaaacttggatttttgccaatggaaaatgaaaaatgggctgtgtgtgctggcttccacctgtaacccccacattttgggaggtggggccaggaggctcacttgagcctaggaggtccaagctgtggtgacctgtgatttcaccactgcacaccatccttgatgacagaccctgtgtccaaaaaagggggaaaaaggctgggtgtcatggctcaacctgtatcccacccctttggaggccgaagcggcttattagctgatgcaggatttgaacccgctggcgacatggtgaacccatctcactaaaatacaaaaaaatagctgacatgtggcaggatctt

SEQ ID NO: 11360 - DNA, 396 bp, Homo sapiens
  misc_feature 338, 339, 396: n = A,T,C or G
tcccatcgattcgaattcggcacgaggtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttggtttgccaatatgaagaaaaagggccttatttcttaactgtgctgggattgcaacactttttaaaaaatggttgcttgaaatactacnntgatataataagaatgtgcacaggagtttttattgaacttgattattttaaagagan

SEQ ID NO: 11361 - DNA, 404 bp, Homo sapiens
ggcacgagaatacaacaaaatgtttaatgagcaaattcgtcttagcaaatatgaaactgccacagagagtaggagaggggcagggcactgatgcccggatttcttgattttggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactg

SEQ ID NO: 11362 - DNA, 374 bp, Homo sapiens
  misc_feature 345, 360: n = A,T,C or G
tacggctgcgagaagacgacagaaggggcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggaaaacttcngcaagactttgagangcactacacaaatg

SEQ ID NO: 11363 - DNA, 375 bp, Homo sapiens
  misc_feature 302, 346: n = A,T,C or G
tctacggctgcgataagactacagaagggcattttatattgcaataagtacctaagactgtgtaatttataaagaaaaaagatttgttttcttcatagttatgcacaatgtacaataagtgtggtgccaacatctgcatctggtgagggtctaaataagcttacaatcatggtgaaggcaaagagaaaccacacatattgcatggggagagagggagcaagcatgaaaagaaagtgccaggttctttaaacacgcagctctcatgtgaattaacagaatgagaactcattgatcaccacggngatggtgcgaagtcatctacaagagatttgctcccatgacctanacacaccacacaaggatccacatcctacg

SEQ ID NO: 11364 - DNA, 381 bp, Homo sapiens
tacggctgcgagaagacgacagaaggatcctacaggttgagggcttattccttcaagactgagccctacttctgaggccaattgcaggttccacattctttcacctgtttttctgaccaaccggctataaatcgaggtttccatgacacccctggattcaattaatttgctagagcagctcacagaactcagggaaaaaccaggggagaagtaacacgcaagacccagcaagcgtgtgaatgtgtaagatcccaagtcaaaggtcaaaccgcctacttgtctctctcaagtcgccatcttggtcctcttccaagtatactttacttcttttcattcctgccctaaaactttttaataaactttcactcttgctctaagagt

SEQ ID NO: 11365 - DNA, 378 bp, Homo sapiens
cccatcgattcgaattcggcaccaggctggacgggagcagctggagcgtgagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtggtcgttgagtgctcttctcaacaaccctaggaggggtcttgaagcttttgagattaacaatggcaggaaaatcatcactttttaaagtaattctcccttgaagatgggggagttgcaaagagtcacttattgacagatatgaactaataaggg

SEQ ID NO: 11366 - DNA, 347 bp, Homo sapiens
tactgctgcgagaagacgacagaaggggcaccatgtctcaggagttctccaagttgcagagtaaaggggagacagccgaatcacgagtgtctgtcctggagtccatgattgatgacctgcagtgggatattgacaaaattcgaaagagggaacagcgactcaaccgacacttagcagaagtcctacaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcgg

SEQ ID NO: 11367 - DNA, 387 bp, Homo sapiens
  misc_feature 387: n = A,T,C or G
tacggctgctagaagacgacagatgggtacgggtgcaagaagacgacacaggggtacggttgctacaagactacagacgggcaagcgacttttgcacctctggctcccaagtagctgggattacaggcgcgagccatcacacccagcttagatttttagagcggtagtaatgtatgaagcagaaaagtgcgaacacgaccacctgactgcttttcctgcttgaaggctgattacaaaggtaccccttgaggtagtggacagttttacagggtttccaccattaacagaattgggtagagtagctcagtgtgcctcaactgtttgtacaaacaatatggtttatgctgaacaccgctttccctctgggagtctagactttttgtatgn

SEQ ID NO: 11368 - DNA, 403 bp, Homo sapiens
  misc_feature 305, 403: n = A,T,C or G
cccatcgattcgaattcggcacgaggccgcttgtgctgcagccatggtaaggctggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaaactctgcttttgccacgcacttttgngaatgggcaggagacctgcttcctctctccagagggtgcattttccaagcttgaacgcttcatgtgcctactctgcaagactgaagagtttgctctgn

SEQ ID NO: 11369 - DNA, 390 bp, Homo sapiens
ggcacgaggacacatagattggaggtaatttaatggtttatgtattccatgcaaatggaaaccaaaagaactgggatagctatacttaggtaaaatagattttaagtaatgtatacaaggagacaaaggtcattgtataatgataaagggatcaattcaagaggatataacaattataaatatatatgcactcagcatcagagcacctaaatatataaagcaaagatataaagatctgaagagataaactgcaatactataatggtagggtacctcaatacccattttcaacaatgtacagatcatgcatacagaaaatcaatatggaaatgttggaattgagccacagtttacacaaatggatctaacatatatacagaacatttcatt

SEQ ID NO: 11370 - DNA, 396 bp, Homo sapiens
  misc_feature 36, 37, 38, 39: n = A,T,C or G
ggcacgaggagagagagacctagtctcgagagcagnnnnttttttttttttttttttttaagaaaccaccgggtttttttttcctaaaacggaaatcttttccggttttaaaagctaaacttccaaagctcccgccggcatttttttttcaaacccccggggaaggggcccggggtaaaaaaaccaaacctgtaaaagggcttaaaaaaccccctgggaaaggggggccccatcttttcctttcctcccccggaccccaccccaaaggcccaaaagccctaaaaaaggggaaaaaggggtccaggggggggaaccattttccccagccccccccaaaacccgggaaaaaacccccaaccggagggaacccaggggccccacctctttccagggaag

SEQ ID NO: 11371 - DNA, 378 bp, Homo sapiens
atacgcagaacaggttgcagctgtgaaaagggtcaagcaatgtaaagattactatgagattctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccggggctttgagggcgacatcttcccctgaggacctcttcaacatgttctttggcggcggctacccttctagtaacgtccacgtct

SEQ ID NO: 11372 - DNA, 355 bp, Homo sapiens
tacggctgcgagaagacgacagaagggaatgcaatggcattatctcggctcactgcaacctccacctctcaggttcaagggattctcctgcctcagcctccatagtagctgggattacaggcgcaggccaccacacccggctaatttttttgtacttctattagagacgggatttctccatgttggtcaggctagtctcaaactcctcacctcagatgattgcccaactcagtctcccaaaatgctgggacttgcctttttaaatttaaacatgttttagaactcacctattgatcacaattttttgattgagccttttctattgatagcaccgagaggctgaagcttcccgact

SEQ ID NO: 11373 - DNA, 388 bp, Homo sapiens
ggcaccaggagagagagagagagagagagagagagagagagagagagagagagagagagagagagagagagagagagagagagagagagcgcccgtgagagagagagatatctctcttgagggggagagacatacctacacagagagactgtgtgagagagagagtttgctttttatacacacacagagagggtgcgctatatacaccttttcctatcgggtctcctctctcccccccattgtgaggagctctcttctcttttctaccctctttctctgcacacatacatgcgagatttgtgggggtgggcacatacgcgcgcgcgccccttgtgtgtgtgtgtgttgtgctctcttctctcatgaatatctctcgcgcgcacacggg

SEQ ID NO: 11374 - DNA, 351 bp, Homo sapiens
tacggctgcgataagacgacagaaggggcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaag

SEQ ID NO: 11375 - DNA, 384 bp, Homo sapiens
tacggctgcgagaagacgacagaaggggcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttgggtcagaaccgtctctgtgagctggagaaacttcggcaagactttgaggaggtcactacacaaaatgaagagc

SEQ ID NO: 11376 - DNA, 352 bp, Homo sapiens
  misc_feature 73: n = A,T,C or G
tctatttttgctagaagacgacagaagggggaaaatacaacaatcacatgctttttattatctccatgattgnattctttttaaaaaggagctgtgtaaatgatacaaacaggaagcagggaaatactgggtagaagaagtgtggtccctggcgagagccacaccctcaagcctggacccatggcccaaagtgagaacatgcatttctgttttccccacccgaatgttgccttttccaaaaccatactggcctgccctgtcccccatcctgtgcccataaaaaccacaggccccaccagcagagcagcagagcagctgagaaagacagaagagaagaagtagctggacgttg

SEQ ID NO: 11377 - DNA, 376 bp, Homo sapiens
ggcacgagatatcctctgccccttgccatctacctgtgaccagcctccagtctcctcaactctaggctggggagagtcttccatcctgatggggggtggggtacgggggtgagccctgggtccccctctgggcagatcccgttacacctcttggtggggtccttgattgggctacgctctggaactgtggatgcagctgcatgaggcttggaaatggccttgaaggagcccgggggggccccttgccccagagtaccctttccccataaaagggggggggcttggcctgcttcgggaacttttgtgatctacaagccatgggaactgccctttatgctggcagggtgggcaaaaggtggccccaagcatttcaagg

SEQ ID NO: 11378 - DNA, 373 bp, Homo sapiens
tacggctgcgagaagacgacagaagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccaaagactacttttttggaccaaggctgctcttctccagtgtaaatcgactgtcccaccccaacttgcacaaaaagacaagcacataacgggctgagggaccacaggctcatgcacacttaaa

SEQ ID NO: 11379 - DNA, 382 bp, Homo sapiens
cgttgctgtcggctgacttccggtggtgccaaagccgtttccgtggaatcaggccggctggtgagggtacagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgatttcggtgtcactatcctgggatccaagtcatggcagagtagctggcttcgaagtacagtctttgcaggatgcaggaaatcagcttggtatggaggatacatctctgagctcttgaatgctcaccccagaacacaaaggtaccaattctagaaggtg

SEQ ID NO: 11380 - DNA, 408 bp, Homo sapiens
  misc_feature 333, 386, 400: n = A,T,C or G
tacggctgcgagaagacgacagaagggggcattcggagggaagctgacatccacgccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagcccgtgccaagtgaaatgtgaggccaagtcagccttgaccaagccgaaaataaccataacttgtaaaaagtctcanatgaagaaaacccaagggttgcatttggtgaagagtgcaggccagatgaacangctttctggtggcnctttataa

SEQ ID NO: 11381 - DNA, 382 bp, Homo sapiens
ggcacgaggccatgcaccaccattcatatttgctatgaaatgaagacagtgcatggcaagtacctggcctgctacagaggatcactaaaattcttctgatccccgtccagcccagagggccggctacaggaggtgctagctcaggggcttgagaatcctttccccctcagcccctgggatgggacctggtgagccctccaaatgtttcctggtccctcctggggcctggctcagtgctcgctttgggcacagcgtcagatgtgagaagaggatggacaggaggctgttggctgctcctgacccccggccctctgccttgcagggtaagaccgtgatccaagcggagattgacgctgcagcggaactcatcgacttcttccgg

SEQ ID NO: 11382 - DNA, 352 bp, Homo sapiens
  misc_feature 352: n = A,T,C or G
tctactgttgcgataagacgacagaaggggcggagggaaaagcaaggtgttgtgggggggttgaattcaaagatgaagaatttgtaaagaaagccctagaaactatgaacaaatatgatcttagtggaagaccccttaatattaaagagggaggcctgaggcgacggagagagatggggagcggctggtcggtggagcagtcagaacatttattgattaagttcgctgttttatttgggcacggttgatggtgccccaaaacaattaaaacatcaaagatcactgatcacagatcaccataacagataataatgaagaaggttgagatatttgatgaattaccaaaatgtgn

SEQ ID NO: 11383 - DNA, 379 bp, Homo sapiens
tacggctgcgagaagacgacagaaggggcggaaggaaaatcaaggggttgtggtgtggttgaattcaaagatgaagaatttgtaaagaaagccctagaaactatgaacaaatatgatcttagtggaagaccccttaatattaaagagggaggcctgaggcgacggagagagatggggagcggctggtcggtggagcagtcagaacatttattgattaagttcgctgttttatttgggcacggttgatggtgccccaaaacaattaaaacatcaaagatcactgatcacagatcaccataacagataataatgaagaaggctgagatattgcatgaattaccaaaatgtgatacggagacacaaagtgagcacatgttgg

SEQ ID NO: 11384 - DNA, 374 bp, Homo sapiens
ggcacgaggcgaaatgagctcgggcgctgtcggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagta

SEQ ID NO: 11385 - DNA, 128 bp, Homo sapiens
atctgcctgtgcctactcgggcttttcttctccccgtgtggagtggaagtttgaccaaggagacaccaccagactcgtttgctataataacaagatcacagcttcctatgacgacccgggagatcttc

SEQ ID NO: 11386 - DNA, 445 bp, Homo sapiens
  misc_feature 375: n = A,T,C or G
ggtcaagtcggcacgaggcggcggccaggtgttggaggcctttgctacgcggtccgaggctttcattgcacaccgcggctaatgccgccgccacggctacagaaacgacctcccaagacgtcgcggcgacccccgtcgcgcggtacccgccgattgtggcctccatgacagccgacagcaaaacttgacggctgcggcggatcgagcgctggcaggcgacggtgcacgctgcggagtcggtagacgagaagctgcgaatcctcaccaagatgcagtttatgaagtacatggtttacccgcagaccttcgcgctgaatgccgaccgctggtaccagtacttcaccaagaccgtgttcctgtcgggtctgccgccgnccccagcggagcccgagcccgagcccgaacccgaacctgaacctgcgctggacctcgcggcgctgcgtgc

SEQ ID NO: 11387 - DNA, 410 bp, Homo sapiens
  misc_feature 282, 410: n = A,T,C or G
tacggctgcgagaagacgacagaaggggataaaatggaatgacatcgaacggaatggaatggaacagaatggaattaaatggactcgaatggaattggctcgaatggaatagaatcaaatggaatgggatcgaatggaatagaatagaccaaaatgtaatggacacaaatggaatagactcaaataatatggactcgaaagtaatggtctcgaatggaatttattttgataagagtgaatcgaatggaggcaatagtattgaaaggaatagatttgaatggnatgagtggaatggaacgactgaatagaacgactcaatattatgactgcatgaattgattcgatgcaatgaatcgatggatgtaaccaaatgattgaatgatgcaaccattgaaagattgaagcatttn

SEQ ID NO: 11388 - DNA, 399 bp, Homo sapiens
ggcacgagactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttactaacccagattgaccttgaggataacccctgggactgctcctgtgacctggttggactgcagcaatggatacaaaagttaagcaagaacacagtgacagatgacatcctc

SEQ ID NO: 11389 - DNA, 358 bp, Homo sapiens
tacggctgcgagaagacgacagaaaggtttgtcgttatattgggaacgataaaaaaaatccttttttccgacccatgtggaccaagctggcctcgaactcgtgccctggaacccccgcctccgtgagggcccgagggcaggcgcaaccggcctgagccacaatagctccgggtgtcggggctgtcctttagtccctttgatcttacgcaaggtgagggagccaatcaccagaggctcccccctgtcgtcacccagtccccagggccagtgagggccctgcgttccatggcgccccctggagggaggaaggggaactgtatctgagagttcagtatctgacaataaggaaaaggcatag

SEQ ID NO: 11390 - DNA, 384 bp, Homo sapiens
tctacggttgcgagaagacgacagaagggagtgacagatactatatgattccatgatatgagtcatcataagtagtcaaatagaaacagaaaggagaatggtgttactcaaggtctaaagagagggtaaaatgggcagttgttacttaatggggattggtttaattttataagacgtaaaagttctagagatctttacataacaatgtaaatactcttaacgactacaatgtacaacttttttgaggtaggttctcactctgtcctgcaggctagaatgaagtcacataatcatagctcactgtagcctcaacctcccatgcacaagtgattcttctgccacgggctcacaaggagctttgaccacaggtggaaaactcaacac

SEQ ID NO: 11391 - DNA, 427 bp, Homo sapiens
attcgaattcggcacgaggagagatctggttttctttgtgacactgaagctcatactaaaatgtttcctataaattagaattccacaaaagagttgttggcagagacttttgtgctttgttttgttttgttgtctctccacagccatgtttgggggagttcattggtgacaatttttaatggaaagaggctctcactttgcggccctttagaggctgtggtgggcggtgattgctcaccagaaaagctgctgcttcaccctccgctgtgcacaggagactgcgaaatttggccagctgttgagagctgatgtttataggttgctttaaaacaatccatgtgacactctcaagacgaggtggaactgtaggaaaccaggatatgtccagtagtcccaggatggtgaagcagagacaataggtcataat

SEQ ID NO: 11392 - DNA, 380 bp, Homo sapiens
ggcacgagtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagacttt

SEQ ID NO: 11393 - DNA, 361 bp, Homo sapiens
tacggctgcgagaagacgacagaagggaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagatt

SEQ ID NO: 11394 - DNA, 366 bp, Homo sapiens
  misc_feature 18, 20: n = A,T,C or G
tacggctgcgagaagacnanaaagggtacggctgcgagaagacgacagaagggtacggctgcgagaagacgacagaagggcaaaaataggaaacttagatgtaacttagcactttttttttttttttttggaaagggggtctccttttgcccccaaaggggggggggggggccccttttaatttcagggcacctttggcctcgggggtaaaggaatttttttggcctaaccctccggggaagggggaataaagggccccccctcccccccccgggaatttaatttttttttttttgaaaaaaaattcccccttggtccccaaggtggaatggaggggggggaattttggttcagggaacccccccc

SEQ ID NO: 11395 - DNA, 208 bp, Homo sapiens
ttcgaattcggcacgaggactaagtcggctacagggagtccgcgcgctcggccaggcagcctctgacaatagcggcccagaaggcctctagagatatgccgagacgcattacatatggccgaccttgagaggaaacgtacgaggagcttgggtcactatgcgcacactgccaatagcacatggagaacgggctctatctcgccgaggg

SEQ ID NO: 11396 - DNA, 393 bp, Homo sapiens
  misc_feature 354: n = A,T,C or G
ggcacgaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggntttcagtggcccctgctgagacctcacactgagccaact

SEQ ID NO: 11397 - DNA, 416 bp, Homo sapiens
tacggctgcgagaagacgacagaagggggcattgtgccatagaattgggaagggaagccccagcatccaacttctccccatggagaggagggttttaaccccacatatagcatcctaacttaagattcttcatggtctggctcttaattcaccaactctgggagcagaggggattagacatacgcaagtctttctagaccacaggaaaaaagccgcagttagatatgggcatttaagcacttcagagctttcatcccccaggagcaatacatagaagggacttaagaaatgaagctccctggttgcccccagaaggagtttatgacacactattccagcagcttcttggttggttggcttctaactaactttacattggggagtttaggggcagtcaaatattaaccctgcaccag

SEQ ID NO: 11398 - DNA, 375 bp, Homo sapiens
tacggctgcgagaagacgacagaagggggcattgtgccataaaattgggaagggaagccccagcatccaacttctccccatggagaggagggttttaaccccacatatagcatcctaacttaagattcttcatggtctggctcttaattcaccaactctgggagcagaggggattagacatacgcaagtctttctagaccacaggaaaaaagccgcagttagatatgggcatttaagcacttcagagctttcatcccccaggagcaatacatagaagggacttaagaaatgaagctccctgtttgcccccagaaggagtttatgacacactattccagcagcttcttgtttgtttggcttctaactaacttacat

SEQ ID NO: 11399 - DNA, 349 bp, Homo sapiens
  misc_feature 3, 4: n = A,T,C or G
tanngctgcgagaagacgacagaaggggatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtg

SEQ ID NO: 11400 - DNA, 361 bp, Homo sapiens
tacggctgcgagaagacgacagaaggggatgtgagctgtgtggatgaaatcctaaaagagatgacgcattcatggcctccccctctaacggctattcatacaccatgcaaaacagaaccttccaaatttccttttccaactaaggagtctcagcagtccaattttggcactggagaacaaaaaagatataatccttctaaaacttcaaatgggcaccagtctaaatctatgttaaaagatgacttaaaactaagcagcagtgaagacagtgatggggaacaggattgtgataagacaatgccgaggagtacaccaggaagtaactctgaaccttcacaccataatagtgaaggagcagata

SEQ ID NO: 11401 - DNA, 460 bp, Homo sapiens
  misc_feature 452, 460: n = A,T,C or G
gcttgttcttttggccgtagcggtctacggctgcgagaagacgacagaaggatacggcagcgagaagacgacggaaggttacggctgcgagaagacgacagaagggaatctgtacaaattattatttatataaatttaggaacaaggaaacaacaaaatgtaaaactggaaccacgccaattactggaaatcaagtatatatggaagagtcaagatcaaataaccaaaatccccataaattgtcaggagtttgagagcagtctgtccaaaatagtgaaatcccatctctactaaaaacacaataattagccaggcatggtggcgcacgcctataataccaagctactcggaggctgagaagggaggatcagtaaagccatggaggtcgaggctgcagaagcagagactgtgcacttgacttgcagctggggacagagtgagaacctgtccanaaaaattn

SEQ ID NO: 11402 - DNA, 427 bp, Homo sapiens
ccatcgattcgaattcggcacgaggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggagga

SEQ ID NO: 11403 - DNA, 380 bp, Homo sapiens
  misc_feature 380: n = A,T,C or G
ggcacgaggtttcatgctggtttccagattttattgtttggctacgtacaatggaactttaagtcatatatacatacatatatatatatatatatatatatatataattctaaggggggaaatgttatatttttctgtttctataagagatgaatacaggggacactttttctattggtaatgattgagttcacctctttcagaagacattttctttctcttctgagtaattgaaataaaatctggcccttgtgaaaccctggaaatcttatgtctgttgaaataccacgttaaacacactccaagagatctgttcacactcacattcttttgtatacttctgaggcgcctgagaaaaagacttcattatttatgagaan

SEQ ID NO: 11404 - DNA, 377 bp, Homo sapiens
tacggctgcgagaagatgacagaagggtacggctgcgagaagacgacagaagggtacggctggcgaaaaaacaacaaaagggtacggttgcgaaaaaacaacaaaagggtacggctgcgaaaaaacaacaaaagggtacggttgcgaaaaaacaacaaaagggtacggctgcgaaaaaacaacaaaagggtacggttgcgaaaaaacgacaaaagggtacggttgcgaaaaaacgacaaaagggtacggctgcgaaaaaacgacaaaagggtacggctgcgagaagacgacagaagggtacggctgcgaaaaaacgacagaagggttcggctgctagaagacgacagaagggtactgttgcgagaagacgactgatg

SEQ ID NO: 11405 - DNA, 389 bp, Homo sapiens
cgttgctgtcggtttcgtacgtagcagagcagctccctcgctgcgatctattgaaagtcagccctcgacacaagggtttgtcttttgattttttttttcctaattgtgtgaacctttctgaaacagaaaggaactttaaaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatc

SEQ ID NO: 11406 - DNA, 367 bp, Homo sapiens
tacggctgcgagaagacgacagaagggtacggctgcgagaagacgacagaagggttacggctgcgagaagacgacagaagggaccacaagtgacttgggggaaggagacaaaatctggcagtctgctgaacagggcggaattttagattgaagaccctagaattaaggtgggaactccaatgggatgtcctcagggagtcacttaggaaaatgatgaaccacgtgtgtgcaataatgtgtgcaatttgacacacagttttaatgcagacaaaaatctttaataatcatgaagctatttccataatatgaagaaatttaatatatgttaaaattctatgtatttctttggtggtttccttttttagag

SEQ ID NO: 11407 - DNA, 355 bp, Homo sapiens
  misc_feature 355: n = A,T,C or G
cagactatggcggggcatggtggcgtgagcctgacatgctaagtacctttgaggaggatggacgaaacacaactagaacggggagtaggaaagggtttattcgagatagtcgcgatgctattgcttcatgggaaacaccgatactccgtcttcaacaagatatccactactaatgcctttaacttatgttacaaggtcaaggggaagagaaggagcgtttgacaaaatatctctgagttctgggtattttcagtcaaaactttaaacctgtagaatcaatttaagggttggaaaaaatttgtctgaaacatttcataatttgtttccagcatgaggtatctaaggatttagaccn

SEQ ID NO: 11408 - DNA, 387 bp, Homo sapiens
  misc_feature 351: n = A,T,C or G
ggcacgagccaccgcggcgcttttctcccttagatgccttttatgaacaagattttactagaagacatcactattactggattcttcatgaaagagcactggctgatatttatatcgggctattagctgagtggtagtctgcctggtcgcaattgcttctatagttgattgaatgctcttaacacggagagatgccctgtacagacttttggggaactgggtactgatgaacccgaacaggagttgcttctggttttaattctgctactactggtgcatgatttacagctaaaccagagaggagtctgcaatgcctagtggaggaaggaggaaccggagtgtgagcagtanctgggtgggcagcatggctgggatcaccaccatcga

SEQ ID NO: 11409 - DNA, 384 bp, Homo sapiens
  misc_feature 384: n = A,T,C or G
gcctacggctgcgaaaaaacgacagaaggggtaaacaatgaaattaaggcacaaataaaaaaaatttaaataaatgaaaacagaggcacaggtaccaaaacctctgggatgcaacaaaagtagtgttaagaggaaattttatagtgctaaatacctaccgcaagaagttagaaagatcccaatttaatgatttaatactacacctaaaggaactagaacaacaagaacaaacatttcaaagctagcagaagaagagaaataactaaaataagagcacagctgaatgaagttgagacccagaaattaatataatcaacacaactaaaaattggttatttgaaaggatacacaagattgatagaccattagctagattaacaaaan

SEQ ID NO: 11410 - DNA, 382 bp, Homo sapiens
ggcacgaggcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggggaaagccagtctggcggcaagtataaaactaggt

SEQ ID NO: 11411 - DNA, 385 bp, Homo sapiens
gctacggctgcgagaagacgacagaaggatacggcagcgagaagacgacggaagggtacggctgcgagaagacgacagaagggaatctgtacaaattattatttatataaatttaggaacaaggaaacaacaaaatgtaaaactggaaccacgccaattactggaaatcaagtatatatggaagagtcaagatcaaataaccaaaatccccataaattgtcaggagtttgagagcagcctggccaaaatagtgaaaccccatctctactaaaaacacaataattagccaggcatggtggcgcacgcctataatcccagctactcgggaggctgagaagggaggatcagtaaagccatggaggtcgaggctgcagtaagcagagac

SEQ ID NO: 11412 - DNA, 402 bp, Homo sapiens
  misc_feature 363, 402: n = A,T,C or G
ggcacgaggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgaggactttcttcatcttcttgctctttttcccatccttcaccggggncttgtgcaccctggccatcaccatcttgagattgaagcn

SEQ ID NO: 11413 - DNA, 398 bp, Homo sapiens
  misc_feature 88, 90, 93, 99: n = A,T,C or G
atccgttgctgtcggaaggctgaggaggccacggaggcccaggaggtggtggaggcaaccccagagggggaaggggtggaaggttttnanccncccggnctgatcttcaataaggcggaggtgagcgaagacgagccgtccagcaaggcgcagcgcacaaaagagaataggcagaaggtgaaggggaacatttcgccggtgacccgtaggaactaccgtccgctgttggagcgcctgcaagcacgagcacatcctgctgcactagctgcccgaccttgatgaggcaaaggtgtaggagctgtaagcgctgctgatgtgcaacacattttactgtgccgagatcgctcacaatatttcctccacaaccgcatagtcatcgaggaaatatctggccaatg

SEQ ID NO: 11414 - DNA, 369 bp, Homo sapiens
ggcacgagacagaaggtctgacacaggaactttgagaagacgtgacagcaatcccttcaccttttgaattgtcatggagcctatcaaaagacaagaaaagtccattcgttctctcaaatgacagttacctgtaaaactagctcatgtgatgagaccacagtatcattgcaatgatagctgtatctgtctttttttttttttttttttggaacgggcttactttctttcttaaaaaagctttggttttgccccccagctggaaggcaaggggggaatttggggttaatggaaccctcgtttcccgggttaaaaaaatttttctgcccaaaccctccggagaaggggggcccattacccccccccgtttat

SEQ ID NO: 11415 - DNA, 682 bp, Homo sapiens
gaggagagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaggtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcacaacaatatcagtacattgtccgctgagtgggttagtaaagctaatgccacacacgagataaggtcgagctggaagagttcaacctgggcattgtatatctctgtatatggtctatgagcaggcctctagatgacattcactgcccaaatttgaaaacttcttttgagaccttgttaacaatatgatctgaggcttgtgaaatgttattttgagagataatggcccccataatgagcgtgt

SEQ ID NO: 11416 - DNA, 389 bp, Homo sapiens
tacggctgcgagaagacgacagaaggggacagtgatgtgggcaagaggggaggacatgaacaccaccatctatgaaaggtaacagccaccgctattgacacatctggccatttgcctgactattccttgtgctccagaccaatatatgcagttcttggattggactgattgagaaggaaggggatcctgaatgttacaatagccataagtaagaagacagtgataaagctggggacattaagcctctaagttttgaagacagatggatcctggagaatgacagtggataatcataaacttgagcaagtgatgactctaactgcagctgttgtactagatatggttttattgcttgagcaagctctttaggccttaatgattgacatgat

SEQ ID NO: 11417 - DNA, 422 bp, Homo sapiens
gcctacggctgcgagaagacgacagaaggggtaaacaatgaaattaaggcagaaataaaaaaaatttaaataaatgaaaacagaggcacaggtaccaaaacctctgggatgcagcaaaagtagtgttaagaggaaattttatagtgctaaatacctaccgcaggaagttagaaagatcccaatttaatgatttaatactacacctaaaggaactagaaaaacaagaacaaacatttcaaagctagcagaaaaagagaaataactaaaataagagcagagctgaatgaagttgagacccagaaattaatataatcaacaaaactaaaaattggttatttgaaaggatacacaagattgatagaccattagctagattaacaaaaaagaggttcaaataagcacaattagaagtgacaaaagtg

SEQ ID NO: 11418 - DNA, 368 bp, Homo sapiens
ggcacgaggaaaattcaggacctttttgtggaactataagtagcaaaaaaaagaaaaagatgatgtatctcacaaccagaaatgcagaatttgaacgtcatgaaatccagatatatgaggaggtagccaaaatgcctcccttccagagaaaaacattagtattgataggagctcaaggggtaggccgaagaagcttgaaaaacaggttcatagtattgaatcccactaagatttgaactacggggccatttactttactgaaacccaagggaagagaaaaaagatgggcagcatataagtttgggtcacgaactgagatgggagcagaaataaaacctcgaaggatttgaacatggcgaataagaagg

SEQ ID NO: 11419 - DNA, 405 bp, Homo sapiens
tcgattcgaattcggcacgagaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtgggg

SEQ ID NO: 11420 - DNA, 391 bp, Homo sapiens
ggcacgagcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaat

SEQ ID NO: 11421 - DNA, 408 bp, Homo sapiens
cgttgctgtcgaatcccagcactttgggaggctgagatggatggatcatgaagtcaggagttcgagaccagcctggccaagatggtgtactaaaaatacaaaaattagccgggcctgttggcaggagcctgtaatcccagttactctggggactgaggcaagagaatctctggaacccgggaggcaaaggttgcagtgagctgtaatcgcgccattgcacttcagtctgggcaacaagagcgaaactccatcttaaaaaaaaaaaaaaaaaagggggttttgccttgtcccccaggttggagtgcaggggggggattttggttcactgaagccttgacctcctgggctaaggggatcctcccacctcaccctcccaagtagctgaaactccaggcacagtgcggcctt

SEQ ID NO: 11422 - DNA, 399 bp, Homo sapiens
  misc_feature 275: n = A,T,C or G
cgaattcggcacgaggggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcancccgagtcaagcacctccgcacccaccgtggtgaacgggcccggccaccaccaccatccactctgctgcggccacataacccacctggcccagtacccatggcccctcgaccccgagttcgggg

SEQ ID NO: 11423 - DNA, 352 bp, Homo sapiens
tacggctgcgagaagacgacagaagggatcacaacacccaagtcccttcaaatacctggaaagcctttccaagaaaggtggcaaaaacaagcacagactctgaacactacaacgaatacctaactcttcaatgctcagacaccaatgaacatccacaagcatcaagagaatccaggaaaacatgacttcactagaccacatgaggcaccatggaccaagcctggaaggactgagatatgtgacctttcagatagagaattcagaatagccgtttaaggaaactcaaagaattcaggatacacacagagggaatcagagtctatcagataattagcaggaaactgaataataa

SEQ ID NO: 11424 - DNA, 359 bp, Homo sapiens
tacggctgcgagaagacgacagaagggtacggctccgagaagacgacagaagggtacgcctgcgagaagacgacagaagggtcttacaataatcctgtaagggaacatatacctctttttataaatgaggaaattggggcttagctaagttaacttgcacaaggtcacccatgtagccaagaagcgttacctagcttacattattaactcatgccacttttattttttgagacggagtctcaccctgtcgcccaggctggagtgcaatggtgcgatctcagctcactgcaacctccgccttcggggttcaagcgagtcttgtgccttggccttctgagtagctgggattacaggcgtgc

SEQ ID NO: 11425 - DNA, 365 bp, Homo sapiens
cgttgctgtcgaattgatacagaacccatttctcagagtctttttttttttttaaaaaaaattttctttttacccagggtggagggcaaggggccaaacttggtttattggaacctttgcccccggggttaaaggaaatttattgctttaccctcccaggaaggtgaaaataaagggccctggccccaaacccaggtaaattatttttttttagtaaaaagggaatttacccttttgggcccggggggttttaaacttcgggccttaggggatcccccggccttacccccccaaaggggtgggattaaaggccggagactttgctccccccctttaaaaaaaatggtaaacctaaaaaccccctt

SEQ ID NO: 11426 - DNA, 637 bp, Homo sapiens
  misc_feature 182, 188, 637: n = A,T,C or G
tacgtctgcgagaagacgacagaagggtacggctgcgagaagacgacagaagggtacggctgcgagaagacgacagaaggggcagtccttccacttcagcctcccgagtagctgggattacaggtgcacaccaccatgcccagctagtttttgtagagatggggttttgccatgttgcccangctggnctccaactcctgagctcaatctatccgtcctcctcagcctgccgaagtactgggattacaggcgtgggccaccactcccggcttccaaggcaggcatttaaatgttataaatagggagataagcaagaaccctgttggacctggtagaagcaaacatttattagtactattacgttgtttaacatatttgccgccctctatattcatgtcctcccaaaattattaaacaacctactcttatagttatttggcttatttctcacgaggaatataaattagtaaatattattgggccgggcgcggtggctcatgcctgtggggccagcacttttggccgaccagcggaggaagaccaccaagccaggactttgagaccggcttggccccacggggaagacccggtggtactaataatacacaaaaatgattggcattgtggcggcggcccn

SEQ ID NO: 11427 - DNA, 386 bp, Homo sapiens
  misc_feature 241: n = A,T,C or G
ccaggctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtgtccgttgagtgcatcttctcaacaaccctaggagggntcttggaggcttttgagattaacaatggcaggaaaatcatcactttttaaaggaaatcttctttgagatggtggaggtgggaagagtcacttatgaacagaaatgttactaataagtttgaaaccagctcttcatacaaaggtgg

SEQ ID NO: 11428 - DNA, 379 bp, Homo sapiens
  misc_feature 379: n = A,T,C or G
tacggctgcgagaagacgacagaagggtacggctggcgagaagacgacagaagggtacggctgcgagaagacgacagaagggtacggctgcgagaagacgacagaagggtacggctgcgagaagacgacagatagggtacggctgcgagaagacgacagaagggtacggctgcgagaagacgacagaagggtacggttgctagaagacgacagaagggtacggctgcgagaagacgacagatggatacggctgctagaagacgacagatgggtacggctgctagaagacgacagaagcgtgtggcgtgctcctgtagtcccagctacttaggaggctgaggccggagaattgctttgtatcaggaggcagaggttgctn

SEQ ID NO: 11429 - DNA, 368 bp, Homo sapiens
  misc_feature 275: n = A,T,C or G
gaaggcggctacggctgcgagaagacgacagaagggataagtctaataccaaattagaaactctagaaataaatatcagtgaaacttaaagcacagcaatataaagtatctaagctgaagcacagaaagaataaactatacaaagatgactggagtccatcatccaaaagctcctagatctgatacacaaatccattatagtctcaaaatacaaaatcagcatacacaaattagtagcactgctgtacaccaacaacgaccaagctgagaatcanatcaagaactcatttccttttacaacagctgccgaaaatataatactaaggatatacttacccaagaagtgatagaccccacaagaaaactag

SEQ ID NO: 11430 - DNA, 383 bp, Homo sapiens
tacggctgcgagaagacgacagaagggttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagatccgaattcagaggcctcaggtaatgacgacatcattttaaggcatggagctgagaagtctgggagtgaggagatcccagtccggctaaacttggtggagcattttcccattgagagccttccatgggaactcaatgttcccattgtaagtacaggaaacaagccctgtacttaccaaggagaaagaggagagacagcagtg

SEQ ID NO: 11431 - DNA, 223 bp, Homo sapiens
ggcacgaggggccacagccggaggacgccccgggcgcggtcggggagccctgcggctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtg

SEQ ID NO: 11432 - DNA, 358 bp, Homo sapiens
  misc_feature 78: n = A,T,C or G
tacggctgcgagaagacgacagaagggtcgcgcggattgctctccagcctgggagacaagagcaaaactccaactcanaaaaaaaaaaaaaaaaacccgggaaaaaatttttgggggtttttatttaaaaaaaaaaaaaaatttttttccccaaaaaaaggggggggattttaaatttttgaaaaaggggggggaaatccaaaaaaaaatttttttctggaaagaaatttcccttcaaaaaaccctggaaaaacccgggacccccccttctttaaaagggaacccctttgggggaaaaggggcttggttgggaacccttaatttaaaaaaagccctaaaggggcttttctttttggcg

SEQ ID NO: 11433 - DNA, 366 bp, Homo sapiens
tacggctgcgagaagacgacagaagggtatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagct

SEQ ID NO: 11434 - DNA, 403 bp, Homo sapiens
  misc_feature 302: n = A,T,C or G
ggcacgagctcaacccctgcactgggctagttctaaagaggaaatgtctctacgctgcggggatgcagcccgcaccctggggccccgggtatttgggagatatttttgcagcccagtcagaccggtaagctccttgccagataataaaaaggaactcctacagaatggaccagaccttcaagattttgtatctggggatcttgcagacaggagcacctgtgatgaatattaaggaaacctaaatccccgctagcgggaaaggttagactacctccatggctaaagacagagattcccatggngaaaaattacaataaactgaaaaatactttgcggaatttaaatctccatacagtatgtgaggaagctcgatgtcccaatactggagagtgtaggcgaggtg

SEQ ID NO: 11435 - DNA, 383 bp, Homo sapiens
ggcacgagaatgggattgacctgtatgcctgctctgccgagatgagagcagatggaatgagttggtgacccctcttaatctgtagcctcagggaaacacggctacccaatgccaagatggtaaaccctcaactcgaagagtaagatcaggacgtatgcttaaggtgtaaggctgaggagtagctggtaggcagtatgtttgccagtgacattgaaggtgagagaaacaaaaattacaaatgaatttattttctcaattctgtggtagaagtgttacaggcaggcctttgttcttagagctcccaagatggtggtggccactcccaagatggcagcaagccttttgttctctgacctggggttcttggcctcacggattccaaa

SEQ ID NO: 11436 - DNA, 353 bp, Homo sapiens
tacggctgcgagaagacgacagaagggtacggctgcgagaagacgacagaagggtacggctgcgagaagacgacagaagggtaattcctgttgcagacttcttatagccccaaggagaaaaaaaaatctattgactgttgtttttgttcagttctaattataattgaaaaggtactcgcaccaactttaaatcccctatgtccacactgtatgcaaaaatcagaaagggttatgaaaatacactctcctctgataatttccatagatatttcaactgcatatccatgtttttaaacctaaatctcagcctttgcacatattttgacactaggaagtgagtgagggagggcaat

SEQ ID NO: 11437 - DNA, 390 bp, Homo sapiens
tacggctgcgagaagacgacagaagggtacggctgcgagaagacgacagaagggtacggctgcgagaagacgacagaagggatttcttagcatatgctccctttttgatcttctgccaatgtttccatcttattatattaaatatgatatatgaatgtaatttaaattccatatacttgagcaaatatgagacaaaattccctttcatgttaatatttaatccaataaactatcacttgactttttgtaactatacatcatagaacatacatatctctcagttatatctcttaatctagttttttgggttaatgtatatatgtgaaaatttatattttaactcaaggtaaaagcaatatattaaacaagtatgggaaaatacatatgaga

SEQ ID NO: 11438 - DNA, 367 bp, Homo sapiens
  misc_feature 300, 319, 350: n = A,T,C or G
tacggctgcgagaagacgacagaagggactgcactcatggccaacggcaccataactcatgcctgaaagaaacttatctgacacatgaactttctttataaggcacatcacagccttgttgctcttgtgaacattagacagcactttagcactgtgtttaggggtcatttaaagagtgaaatcaccaatacaaagcacaaaaatgtgaagatatgtgatactaaacagaccacaaaaaggacactttacagtatgagactggagacacacaggcagactgttaccttggtcaatttcaanctgaaaggtgctttctggngcacttaaactctttgtcaaaagatcttganagtgcatgagtgtggtt

SEQ ID NO: 11439 - DNA, 352 bp, Homo sapiens
tacggctgcgagaagacgacagaagggtacggctgcgagaagacgacagaagggtacggctgcgacaagacgacagaagggtacggctgcgagaagacgacagaagggtacggctgcgagaagacgacagaagggagcttgaaaatcactgttctgcttggttttaagaaattcaaaggccaggcgcagtggctcacacctgtaatcccaacactttgggaagctgaggcaggtggatcacctgaggtcaggagttcgagaccaacctggccaacatggtgaaatcccatctctactaaaaatacgaaaattagcccggcgtgatggcgagcacctgtaatcccagctacct

SEQ ID NO: 11440 - DNA, 383 bp, Homo sapiens
  misc_feature 383: n = A,T,C or G
tacggctgcgagaagacgacagaagggtacggctgcgagaagacgacagaagggtacggctgcgagaagacgacagaagggagaaatcagaaaaattcgagatctctcaaatcaggaagaacagtacaatcgattcatgaaattggttggtggcaagaggagatcaagaagtaaatcttcagatcctgacctgaggcgatccttagataagcaacctactgatagtggaggaggcatttatcagtatgataactatgaagaagttgctatggatacagatagtgaaaccagttctccagctccttcaccagtgcaaccgccatttttctctgaatgttcattggggtatttttctccagcaccatctctttctttgcctccan

SEQ ID NO: 11441 - DNA, 363 bp, Homo sapiens
tacggctgcgagaagacgacagaagggtacggctgcgagaagacgacagaagggtacggctgcgagaagacgacagaagggcaaaaataggaaacttagatgtaacttagcactttttttttttttttttggaaggggggcccccctttgcccccaacggggggggaggggggccatttaaggtccaggccaccttgggcttcggggtaaagccggttttttgcgcccaacccccggggagcggggaaaaccggccccccctccccccccccgggatttaattatttttttttgaaacaagttcccccttttccccaggtgggccgggggggggattttgtaaatggaccctcccccccggtg

SEQ ID NO: 11442 - DNA, 373 bp, Homo sapiens
  misc_feature 332: n = A,T,C or G
tacggttgcgagaagacgacagaagggtacgggtgcgagaagacgacagaagggtacggctgcgagaagacgacagaagggaacggctgcgagaagacgacagaagggtacggctgcgagaagacgacagaagggtacggctgcgagaagacgacagaagagtacggctgcgagaagacgacagaagggcaaatacattggtcttattggacgtcacctgatcaaatcgtttctgttctcttctcctattgcccccaccccaccttctgtcaaaataccgtatcactgtaatctccaagttccctccaaactctagcttatcaaggctgagntatttcatattgctctcttagctcttcttcacacaacttcc

SEQ ID NO: 11443 - DNA, 395 bp, Homo sapiens
  misc_feature 395: n = A,T,C or G
ttcggcacgaggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgctttaaagcccgttcaagctgtatagtttgcacacccatcn

SEQ ID NO: 11444 - DNA, 355 bp, Homo sapiens
tacggctgcgagaagacgacagaagggtacggctgcgagaagacgacagaagggttcggctgcgagaaaacgacagaagggtacggctgctagaagactactaagggtacggctgcgagaagacgacagaagggtgcggctgcgagaagacgacagatcggtacggctgcgagaagactacagaagggtacggctgcgagaagacgacagaagggtacggctgcgagaagacgacagaagggtacggctgcgagaagacgacagaagggtatgatccaataacgtcatacttttatcattacatgtgaaaattttattcccaaaacacaaaacataataaattgtaattctgttt

SEQ ID NO: 11445 - DNA, 394 bp, Homo sapiens
cgttgctgtcggtgatgttaaagttttttcacataccttttggccatttgtatgtcttcctttgagaaatgtctattccagtcatttgcccattttttaatcaggttatttgttttcttgctatcgagttgtttgtgttctttatatattttgtatattagcccctttctaggttctctgttctgttccattggtgtatactgtttttatgccagtaccaggctgttttgattactttagctttgtagtatactttgagatcaggtgatatttacatgcctctttgttcatttccttaagctttatttgcctattcaaggtcttttgttattccacatgaattttaggattcttttctctatttctgtgaaaaatgtcataagaattttgatag

SEQ ID NO: 11446 - DNA, 364 bp, Homo sapiens
tacggctgcgagaagacgacagaagggtacggctgcgagaagacgacagaagggctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgacgtcagggaagacgcctcctct

SEQ ID NO: 11447 - DNA, 387 bp, Homo sapiens
ggcacgagctcaacccctgcactgcgctagtcctaatgaggaaatgtctctacgctgcggggatgcagcccgcaccctggggccccgggtatttgggagatatttttgcagcccagtcagaccgtttagctccttgccagataaaaaaaaggaactcctacagaatggaccagaccttcaagattttgtatctggtgatcttgcagacaggagcacctgggatgaatataaaggaatacctataacgccagaaaggagaaaggctaagactacctccatggctatagacagagattcccatggggaaaaactacaattaactgagcaatactttgcggaatctaaatctgcatacagtatgtgaggaagctcgatgtcccaatattg

SEQ ID NO: 11448 - DNA, 396 bp, Homo sapiens
  misc_feature 396: n = A,T,C or G
acggcacgagctcaacccctgcactgcgctagtgctaaagaggaaatgtctctacgctgcggggatgcagcccgcaccctggggccccgggtatttgggagatatttttgcagcccagtcagaccgttaagctccttgccagatagaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgn

SEQ ID NO: 11449 - DNA, 398 bp, Homo sapiens
  misc_feature 398: n = A,T,C or G
ggcacgaggagagatctggttttctttgtgacactgaagctcatactaaaatgtttcctataaattagaattccacaaaagagttgttggcagagacttttgtgctttgttttgttttgttgtctctccacagccatgtttgggggagttcattggtgacaatttttaatggaaagaggctctcactttgcggccctttagaggctgtggtgggcggtgattgctcaccagaaaagctgctgcttcaccctccgctgtgcacaggagactgcgaaatttggccagctgttgagagctgatgtttataggttgctttaaaacaatccatgtgacactctcaagaagaggtggaactgtaagagaaccaggatatgtccagtagtcccaggatggtggan

SEQ ID NO: 11450 - DNA, 434 bp, Homo sapiens
  misc_feature 366: n = A,T,C or G
atcccatcgattcgaattcggcacgagctgggcttctccaacaccatgtactcaagactaggggagatcatcagcatggatgggtccatcactgtgaccctggcagcgcaccaggctattggcctcaaggggatcatcttggctggcactgaggagcagaaagccaaatacttgcctaaactggcgtccggggagcacattgcagccttctgcctcacggagccagccagtgggagcgatgcagcctcaatccggagcagagccacactaagtgaagacaagaagcactacatcctcaatggctccaaggtctggattactaatggaggactggccaatatttttactggtgttgcaaagactgangtcgttgattctgatggatccagtgaagacaaatcacagcattcatagtagaaagagactttggtgag

SEQ ID NO: 11451 - DNA, 149 bp, Homo sapiens
cgcataggatcacgcgtaggtgagggatgattttttatacagacagaatctcactatgttgcctaggctggtcttgaactcctgggctcaagcaatacccctgcctcaacctccccagatgctgggatgataggcgtgagctaccacac

SEQ ID NO: 11452 - DNA, 597 bp, Homo sapiens
  misc_feature 436: n = A,T,C or G
tacggctgcgagtagacgacagaagggtacggctgcgagaagacgacagaaaggtacggctgcgagaagacgacagaagggtacggctgcgagaagacgacagaagggcgcccaggctggagtgcaatggcgcgatctcggctcactgcaagctccacctcccgggttcacgccattctcccacctcagcctcccgagtagctgggactacaggcacctgccaccacacccggctaatttttttgtattttttattagagaaggagtttcaccgtgttagccaggatggtcttgatattctgacctcatgatctgcctgcctcggcctcccaaagtgctgggattacaggcatgagccaccacgcccggcaattccttttatcttctaagaacctgactaaacacctcctccctttgagccctccatgtattgagnctatattatctctatttttccatggtttagcttagagctactgacattttactccatgagacaaacatttggcactggctggatattacttatctataggagaatacgctctaggagctggccacactacagtacttattgttctgatatgcaccctggcg

SEQ ID NO: 11453 - DNA, 638 bp, Homo sapiens
  misc_feature 415, 547, 549, 555, 561, 585, 586, 611, 614, 638: n = A,T,C or G
tactgctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggctgatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttccactgtcctgaaacaagatagagaatctgagcggncagtcatctgcccttagtgctgccgccgaaggctgaatgtcctggaaagtttgctgcacatctccatcatgacaaaagcattgtgccgaacagatgaaaaaatgcattggtcacgggatctttttatgttgntngtcttncttttnaagcacattgcttactttgtatannagaaaataaatatttgtcatttcanaanaaaaaaaaaaaaaaaaaaaaaaan

SEQ ID NO: 11454 - DNA, 635 bp, Homo sapiens
  misc_feature 410, 422, 537, 552: n = A,T,C or G
tattgttgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaatagagttgttaactctcatctggggagagccctgagatctacagtaaagctcttggccagaatatcagaggtctttaaaggaggtggaatttctcctattatagaaatcatcggccaggcgcggtggctcacgcttgtaatcccagcactttgggaggccgtggcaggtggatcacgaggtcaggagttcangaccagcgcggncaacatagtgaaaccccgtctctactaaaaatacaaaaattgggccgggtgtggtggcacacgcctgtagtcccagctactcgggaggctgatgtgggagaaactgctgacccangaagcacaagttgantgagctgagacatgcattgactctagcctggggacagagtgaactctgtcgcaaaaaaaaaaaaaaataaaaaaaaggggcgg

SEQ ID NO: 11455 - DNA, 618 bp, Homo sapiens
  misc_feature 413: n = A,T,C or G
tacggctgcgagaagacgacagaagggtacggctgggagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaaggatacggctgcgagaagacgacagaagggtacggcctgcgagaagacgacagaagggtacggctgcgagaagacgacagaaggggggcatggtggtgcgcacctgtaatcccagctactcgggaggctgtggcacgagaactgcttgaacccgggaggcagaggttgcagtgacctgagatggcgccactgtactccagtctgggagacagagcaggacttcatcntcaaaaaaaaaaaaaaaaaaaaaaaaaaagggggggcttttcctgttaccccacactgggaagatctttggggggttgggcacccccccctttaggggcgggaaaaaaggttttttgggaaattggggagtttgttttttttgccctctttacggcggaaaaacaagtaaaccacctttggtttttttttgttttggtggggggg

SEQ ID NO: 11456 - DNA, 640 bp, Homo sapiens
  misc_feature 539, 549, 568: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggattgatattcaggatctttaaaagcgactgatatctcattccacataaggtgcatttgtaacttagatgtgcagcaagtgctatcctctatttgtagatatataatgcctgcaatgtacaggaggtagccaacaaaagctctaatatgatatcacatctatgaagcacattatgttttctttaaaaagcagcttcacatgtattatttttatttaatctttctcacaatattatgggtcagnagaaaagagnatagaaccttgattaccanggacccttcaacagacctctttgcctacagatatgcacctttatttagaaatagacatattcttatttgtcg

SEQ ID NO: 11457 - DNA, 633 bp, Homo sapiens
  misc_feature 416, 439, 633: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaagggtacggctgcgagaagacgacagaagggtactgctgcgagaagacgacagaagggtactgctgcgagaagacgacagaagggtacggctgcgagaagacgacagaagggtactgctgcgagaagacgacagaagggtaccggctgcnagaagacgacagaagggtacggntgcgagaacacgacagaaaggcgctgtggctcatgcctgtatcccagcactttggaggctgatgcagtggagcacttgggtcatgagttcaaacagcctgcccacatggtgaaacctgcttactaaaattacaaaaaattagcggcgtggggtgcatgcctgtattcacttcttggaaggtggagggagtgatn

SEQ ID NO: 11458 - DNA, 611 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtgatggtgtgcgactgttattacatgtgctcgggaggcttatgcccgagaatactttgacccccgatgcccaggttgtttgagcccccatgatcctttgattccatctggcgacgaagcagacttgtttcaaataaaaaaaaaaaaaaaagggcggcgtttttcggttttcacttggaaaaatttgtgggggggggccccccttcaccgcggaaagggggttttgggattggaactttgttttttgccttttggcggaaa

SEQ ID NO: 11459 - DNA, 612 bp, Homo sapiens
tactgctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgctagaagacgacagaatggtaccgctgcgagaagaccacagaaggaaccggttgaagaagaccacagaaggtggggcaaaaaagacttttttcttttcttttctttctttttttttttttagaaggggggttatttttggccccgggtggagggaaaacatgattgggctcattgaactttgcccccggtaaggaatcttccccctacccccccaggggggctcggaaaaaaaaaataaaaaaaaaggggggt

SEQ ID NO: 11460 - DNA, 628 bp, Homo sapiens
tactgtctgcgatatagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgataagactacagaagggtacggctgcgagaagacgacagaagggtacggctgcgagaagacgacagaagggtacggctgcgagaagacgacagaagggtactgctgcgagaagacgacagatgggtacggctgcgagaagacgacagaagggtacggctgcgagaagacgacagaagggtacggctgcgagaagactacagaagggtacggctgcgagaagacgacagaagggtacggctgcgagagacgacagaagggtcggctgcgagaagactacagaagggtacggctgcgagaagataccgaagggtacggctgcgagaagactacaaaagggtacggctgcgagaagacgacagaggcggcttaagtgttcttatgtttcatctccaggggctgggatacagaacccgcacacttcagttttttttgtttttttagaacgtgtttgcg

SEQ ID NO: 11461 - DNA, 613 bp, Homo sapiens
  misc_feature 515: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtactgctgcgagaagacgacagaagggtacggctgcgagaagacgacagaagggtactgctgcgagaagacgacagaagggtacggctgcgagaagacgacagaagggtactgctgcgagaagacgacagaagggtacggctgcgagacgacgactaaagggtaccgctgcgagagacgacataagggacggctgcgagagagacatatgggacggctgcgagaagagacataatggtacggttggagaagacacataatgggatacctgangcagggagttcagaacagcttgccacatagtaaaccctgtcttctaaaatacaaattacgagggtgtgcgcaccctgtatccactcttggaggtagga

SEQ ID NO: 11462 - DNA, 360 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtactgctgcgagaagacgacagaagggtactgctgcgagatgacgacagaagggtacggctgg

SEQ ID NO: 11463 - DNA, 387 bp, Homo sapiens
  misc_feature 387: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggattagctgggcaaggtggtgggtgcctgtagtcccagctgctcgggaggctgaggcaggagaagggcatgaacctggggggcggagcctgcagtgagccaagatcacgccactgcan

SEQ ID NO: 11464 - DNA, 363 bp, Homo sapiens
gcctacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggctcagggttaaatggattaagggcggtgcaagatgtgctttgttaaacagatgcttgaaggca

SEQ ID NO: 11465 - DNA, 360 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagaccacagaagggtacggctgcgagaagacgacagaagggtggctcatgcctgtaatcccagcactttggaaggctgagacgggcggatcacctgaggtcaggaatttgagaccagcctggccaacatggtgaaaccccacccctactaaaaatacaaaaaaattagccgggtgtagtggcgcc

SEQ ID NO: 11466 - DNA, 370 bp, Homo sapiens
  misc_feature 370: n = A,T,C or G
cgcctacggctgggagaagacgacagaagggtacggctgcgagaagacgacagaaggatacggctgggagaagacgacagaaggatacggctgcgagaagacgacagaagggtacggctgcgagaagacgacagaagggtacggctgcgagaagacgacagaagggtacggctgcgagaagacgacagaagggctggctcatgcctgtaatcctagcactttgggaggccaaggtgggcggatcacctgaggtcaggagttcaagaccagcctgtctaacatggcgaaactccatctctactaaaaatataaaaacaagccaggcatggtggctcatgcctgtaatcccagctacttcggaggctgaggn

SEQ ID NO: 11467 - DNA, 424 bp, Homo sapiens
tacggctgcgagaagacgacagaagggtacggctggcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtggcgtgctcctgtagtcccagctacttatgaggctgaggcaggagaattgcttgtattcaggaggcagaggttgcagtgagtcgagatcgtgccactgcactgcattctgggcaacaaagcag

SEQ ID NO: 11468 - DNA, 387 bp, Homo sapiens
  misc_feature 387: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagactacagaagggtacggctgcgagaagactacagaagggtacggctgcgagaagactacagaagggtacggctgcgagaagactacagaagggtacggctgcgagaagactacagaagggtacggctgcgagaagactacagaagggtacggctgn

SEQ ID NO: 11469 - DNA, 365 bp, Homo sapiens
tacgtgttgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggttacggttgcgagaagacgacagaagggtggctcatgcctgtaatcccagcactttggaaggctgagacgggcggatcacctttaggcaggaatttgagaccagccttgccaacatgtggaaaccccaaccctactataaatacaaaaaaattagccggtggttgtgccgcacacg

SEQ ID NO: 11470 - DNA, 362 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtagccatgtgtggtggcaggcatctgtagtcccagctatttgggaggctgaggcaggagaatcgcttgaacctgggagacgaaggttgcagg

SEQ ID NO: 11471 - DNA, 367 bp, Homo sapiens
tacggttgtgagaagacgacagatgggtacggctgcgagaagacgacagaagggtgcggctgcgagaagacgacagaagggtacggctgcgagaagacgacagaagggtacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaaag

SEQ ID NO: 11472 - DNA, 344 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgaa

SEQ ID NO: 11473 - DNA, 364 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggttgcgagaagacgacagaagggttctgctgcgagaagacgacagaagggtactgctgcgagg

SEQ ID NO: 11474 - DNA, 362 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggcatggtgactcatgcctattatcccagcactttgggaggctgaggcgggcagatcacctgaggtcaggagttcgagaccagcctggccaacatggtgaaaccctgtctctactaaaa

SEQ ID NO: 11475 - DNA, 356 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagactacagaagggtacggctgcgagaagactacagaagggtacggctgcgagaagactacagaagggtacggctgcgagaagacgacagaagggtacggctgcgagaagacgacagaagggtacggctgcgagaagactacagaagggtacgg

SEQ ID NO: 11476 - DNA, 362 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacaacagaagggtacggctgcgagaagacgacagaagggtacggctgcgagaagacaacagaagggtacggctgcgagaagactacagaagggtacggctgcgagaagactacagaagggtacggctgcgagaagacaacagaagggtacggctgcgagaagactacagaagggtacggctgcgagaagacgacagaaaggtacggctgcgg

SEQ ID NO: 11477 - DNA, 376 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtgaatataaatcgttctattataaagacacatgcacctgtatgttcactgcagcactgttcacaatagtaaaaacacaggaacaacctaaatgcctgtcagtgatagactagataaagaaaatgtggtacgtatacaccatggaatactatgcagtcttaaaaaggaatgagagcatgtcctttacagggacatgaatggagctggaggccattatcttagtaaactaacacaggaacagg

SEQ ID NO: 11478 - DNA, 341 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagac

SEQ ID NO: 11479 - DNA, 361 bp, Homo sapiens
  misc_feature 332: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggagtgcagtggcgcaatctcggctcactgcaacctccacctcccgggttcaagggattctcccacctcagcctcccaagtagctgggactataggcatgtgccaccacgcctggctaatttttgtatttttagtagagacggngtttgccatgttggccagggtggtctcga

SEQ ID NO: 11480 - DNA, 354 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtggctcatgcctgtaatcccagcactttggaaggctgagacgggcggatcacctgaggtcaggaatttgagaccagcctggccaacatggtgaaaccccacccctactaaaaatacaaaaaaattagccgggtgtagt

SEQ ID NO: 11481 - DNA, 376 bp, Homo sapiens
tacggctgcgagaagacgacagaagggtacggctggcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtggcgtgctcctgtagtcccagctacttatgaggctgaggcaggagaattgcttgaatccaggaggcagaggttgc

SEQ ID NO: 11482 - DNA, 360 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacctaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaatacgacagaagggtacggctgcgagaagacgacagaggggtacggctgg

SEQ ID NO: 11483 - DNA, 373 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaaggatacggctgcgagaagacgacagaaggatacggctgcgagaagacgacagaaggatacggctgcgagaagacgacagaagggacctgaggtcgggagttcaagaccagcctgaccaacatggagaaaccccgtctctactaaaaataaaaaattagccgggcgtggtggtgcatgcctgtaatcccagctactggggaggctgaggcaggagaattgcttgaacccaggaggcggaggg

SEQ ID NO: 11484 - DNA, 361 bp, Homo sapiens
  misc_feature 361: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgcgaagacgacagaagggtacggctgcgagaagacgacagaagggtacggctgtgagaagacgacagaagggtacggctgtn

SEQ ID NO: 11485 - DNA, 387 bp, Homo sapiens
tacggctgcgagaatacgacagaagggggagatggggtttcaccatgttggccaggctggtttcaaactcctggcctcaagtgatccgcccgcctcggccttccaaagtgctaggattaacaggcgcgagccgctgcacccagcctgcattttatttttacataaagtgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaaacaaatttgactaattgtcaatgtgaaaataaaatagaaaaactgttgttggagttatttctaaacagaa

SEQ ID NO: 11486 - DNA, 356 bp, Homo sapiens
tctacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtac

SEQ ID NO: 11487 - DNA, 391 bp, Homo sapiens
tacggctgcgagaagacgacagaagggtacggctgcgagaagacgacagaagggtacggctgcgagaagacgacagaagggtacggctgcgagaagacgacagaagggtgtaggcatagctattttatcatattgaggtactacagctcttgaaagtagcaaagaagtaagaatgacacagttcatatcaaaaattaaagaagtatggatactttcgtggggatcaaaggaaactaaagaagcgcttaaaacaatcacaaatgtcgcagtgtaaaccatcatgaagaactaaataattgtttaatatagaaaccggccgggcgtggtggctcacgcctctaatcccagcactttgggaggctgaggcggacggatcacgaggtcaggagat

SEQ ID NO: 11488 - DNA, 354 bp, Homo sapiens
  misc_feature 354: n = A,T,C or G
tacggctgcgagaagacgacagaagggtacggctgcggaagacgacagaagggtacggctgcgagaagacgacagaagggtacggctgcgagaagacgacagaagggtacggctgcgagagacgacagaagggtacggctgcgagaagacgacagaagggtacggctgcgagaagacgacagaagggtacggctgcgagaagacgacagaagggtacggctgcgagaagacgacagaagggttaagaccatcctggccaacatggtgaaaccccgtctctaccaaaaatacaaaattagctaggcgtggtggtgcacgcctgtagccccagctactcaggaggctgaggcaggn

SEQ ID NO: 11489 - DNA, 352 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtgaatataaatcgttctattataaagacacatgcacctgtatgttcactgcagcactgttcacaatagtaaaaacacaggaacaacctaaatgcctgtcagtgataggactagataagaaaatgtggtacgtatacaccatgggatactatgcggcttaaaaaggaatgaaagcatgtctttacaggacatgattggagctggggccttatcttaat

SEQ ID NO: 11490 - DNA, 352 bp, Homo sapiens
tacggctgcgagaagacgacagaagggtacggctgcgagaagacgacagaagggtacggctgcgagaagacgacagaagggtacggctgcgagaagacgacagaaggggcagttccaagtaggtaatccttctgagaagtcccacctttctgagcggctgtgtttgaagaaagctagtgggaaaagttccaggattacatgtctggaaactacaagaggtagaaacatttgttgatttaccagtgtttttaacttcctgctgggctgaaaactgcttgtttcgtggaaaagcaaaacttgacagcaaacatctataatgaagagctcccaaacttttgaggaacaaacggaa

SEQ ID NO: 11491 - DNA, 350 bp, Homo sapiens
tacggctgcgagaagacgacagaagggtacggctgcgagaagacgacagaagggtacggctgcgagaagacgacagaagggtacggctgcgagaagacgacagaagggatatgaaaaaaaagattttcagcctaagcaatgtagtgagacctcatctctactaaaaataaaaattaaaattgtccagggtgatgggcacacctgtagtccagctacttcgaggctactggaggaacgtttgagcttggagggcgagctgcatgagctacatcgagccgagcactccagcctggtgacacaggcttgaaagaaaaaaaaatcccaattttcaaaggaaggtttgttgccaa

SEQ ID NO: 11492 - DNA, 388 bp, Homo sapiens
tacggctgcgagaagacgacagaagggtacggctgcgagaagacgacagaagggtacggctgcgagaagacgacagaagggtacggctgcgagaagacgacagaagggtaccccctcctcaaaaccaactgcgaaaatgtcctctttttatccctgccttaccccatcagctctggcctttttaaaaacatttgttgttctctagtgaagcctctatcaccttctctatctgagaactgaccaatggaaattcataactttatctccagaaatcccagaggcctaaaaaaattaagaggattaatgggaaacttgcaagaaagtgacaacctcgatagaagtgacacatctgatttaggatggaaaaaggttagtcaataaaaatcag

SEQ ID NO: 11493 - DNA, 377 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggagcttgaaaatcactgttctgcttggttttaagaaattcaaaggccaggcgcagtggctcacacctgtaatcccaacactttgggaagctgaggcaggtggatcacctgaggtcaggagttcgagaccaacctggccaacatggtgaaatcccatctctactaaaaatacgaaaattagcccggcgtgatggcgggcacctgtaatcccagctacctgggagactgaggtaggagaatcgct

SEQ ID NO: 11494 - DNA, 364 bp, Homo sapiens
  misc_feature 274: n = A,T,C or G
tacggctgcgagaagacgacagaagggtacggcggcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggtacggctgctagacgacgacagaagtgtcaggcatgctcataacctcaaattttttggntttaaaaaggcgccgttttttttgggttccccgcctggggattttctttggtttttgccccccccactttttagccgggaaaaaagtctt

SEQ ID NO: 11495 - DNA, 387 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtatcaaaaataccaaaaaaaaaaaaaaaaaaaaaaagggaaagaaaaaaaaatttccccggggggggggggtttcccctttttcccaaatttttcggggggggggggggggaaaaatttttaaccctgggggggggggggtccaggggcctaaaaatttgccctgggttttttgggggggcccaagggggggtttccaaaaaaaaaaaaaaaaaaaaaaaaggga

SEQ ID NO: 11496 - DNA, 387 bp, Homo sapiens
tacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggatttacgtgccatgattttattccaaccaaaaagatatttggaaaatatttaagaattattgctgattattgaaatctaaaacactaataccagtgaatattttgtataccctaatacttctctgaacacttacaagccaataattaaccattcagaaaaaaaaaaaaaaaaaaaaaaaaaaagggggggccgttttttccgtaaacccaaccttgaaaaaatcc

SEQ ID NO: 11497 - DNA, 368 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgtgagaagacgacagaagggacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgtaaatctcaggataaagt

SEQ ID NO: 11498 - DNA, 357 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggaaaatgaaccaaagaaacagaacagaaagtccagaaacaaactaaagcatagaagatcacatgatttatgaaagatggcagtgcagaacattgagaaaaaaatggttgcttcaaaaatggtgcttagtaatagagaatccaaatgtgggctaaaaatgaaaatgagg

SEQ ID NO: 11499 - DNA, 334 bp, Homo sapiens
  misc_feature 269, 273: n = A,T,C or G
tacggctgcgagaagacgacagaagggtacgtctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagatgacgacagaagggccccagcctgggcaacagagtgagatcgtgtctcacacccttttctatttgtntttnaagggcgcgcttttcttttggggtcccacccgtgtgatacttttggggtgtgtggcaccct

SEQ ID NO: 11500 - DNA, 360 bp, Homo sapiens
  misc_feature 214, 328: n = A,T,C or G
tacggctgcgagaagacgacagaagggtacggctgcgagaagacgacagaggggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaangggccttttcctccctgtcgccaccgagggcgcacgcgtgagacttctccgccgcttccgccgcagacgccgccgcgatgcgctacgtcgcctcctacctgctggctccctagnggcaacttctccccagggccaagacatcaagg

SEQ ID NO: 11501 - DNA, 346 bp, Homo sapiens
tacggctgcgagaagacgacagaagggtacggcggcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggcaggcatgctcataacaaaaaaaaaataaaagaaaaaaaaaggggggccgttttttccggaaacccaaactggaaaaaatccttggggggtttgggcccccc

SEQ ID NO: 11502 - DNA, 357 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggcatgagaacaactgtccccacccctccacctgactgtctaatctttgagcagcctggtctctgagtcaaaggaccaaggaatgagtgaatgctcacggcctgggtgggaggttaggttcctactgagggatgggtgggttcccacaaggcagggtcttgggaacttt

SEQ ID NO: 11503 - DNA, 370 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtgcatgcctatggtcccagctactagggaggctgaggtgggaggatcgcttgagactggggtggttgaggttgtagtgagccgtgattataccactgcactccagcctgggtgacagagcgagaccctgtcccaaaaaaagaaaaaaaaaat

SEQ ID NO: 11504 - DNA, 364 bp, Homo sapiens
tacggctgctagaagacgacagtagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaggggattcttgtcccccaggctggagtgcaatggtgtgatctcggctgactgcaacctctgcctcccaggttcaagcaattctccagcctcagcctcctgagtagcttgggatacaggggcctgccaccacacttggctaattttgtatttt

SEQ ID NO: 11505 - DNA, 354 bp, Homo sapiens
  misc_feature 292: n = A,T,C or G
tacggctgcgagaagacgacagaagggtatggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagagggggacggctgcgagaagacgacagaagggatttgatgatgatagacaaatttcacacgtgctgttgaaacggacttancaccctatttttgttgttttagggggcccgtttttttggttcccaacagggaagatcttttt

SEQ ID NO: 11506 - DNA, 360 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaagggtacggctgcgagatgacgacagaaggtacggctgcgagaagacgacagaagggaacggctgcgagatgacgacagaagggtagccatgtgtggtggcaggcatctgtaagcccagctttttgcgatgttgagccaggagatcccttgaccttgtagacaaagttgcgggcg

SEQ ID NO: 11507 - DNA, 364 bp, Homo sapiens
  misc_feature 236, 240: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggatacggctgcgagaagacgacagaagggatttgccaggctgtaatgcnatgncgtgattttggctcacttacacctctacctcctggcttcaaggatatctctgactcattctccctagtagctgtgactacaggctcccgccactatacctggctaagttgtgtgttttttgtag

SEQ ID NO: 11508 - DNA, 365 bp, Homo sapiens
  misc_feature 324: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggcaaccatattattattttacttattcaagaagatgaaaatgaatatacagttatgggagaggactctgaaattcatataaataggagcagacccactgatttcaatgancatataaacacactggatcagaccaattacagaagcatttg

SEQ ID NO: 11509 - DNA, 369 bp, Homo sapiens
  misc_feature 252, 253, 254, 255, 256, 257, 258: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggccccagcctgggcaacagagtgagatcgtgtctcannnnnnnaataaaaaaaagaaaaaagaggggggccctttttttgtggacccccccctgggaaaaatccttggggggttgggccccccccccctttaaggggcggggaaaaaatttttt

SEQ ID NO: 11510 - DNA, 394 bp, Homo sapiens
  misc_feature 315: n = A,T,C or G
tacggctgcgagaagacgacagaagggtacggctgcgagaagcgacagaaggatacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggagtctagagctgggccgggcgcggtggctcacgcctgtaatcccancactttggaggccgaggcgggtggatcatgaggtcaggagttcaagaccaatctggccaacatggtgaaaccccatctt

SEQ ID NO: 11511 - DNA, 324 bp, Homo sapiens
gcctacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggtacggctgcgagaagacgacagaagggtacggctgcgagaagacgacagaagggtacggctgcgagaagacgacagaagggtacggctgcgagaagacgacagaagggtacggctgcgagaagacgacagaag

SEQ ID NO: 11512 - DNA, 350 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacgggtgcgagaagacgacagaagggtacggctccgagaagacgacagaaggagggaggcttatgttgcacccagttgagatcctgccattgcactcccgctcgggcaagagagcaacaccctgtctctttattgttttgtatttaattattctaggtgggggttcttttttttgggatcccattatttatcatatatttgtgggtttgccctt

SEQ ID NO: 11513 - DNA, 362 bp, Homo sapiens
  misc_feature 295: n = A,T,C or G
tacggctgcgagaagacgacagaagggtatggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatttgaagaagaatagacaaatttcaacaagtgcagttgaaacagaactaanaaaaacattatttataaaaataaaagggggggcgttttttgctggaatcccaactgggtagaatctt

SEQ ID NO: 11514 - DNA, 355 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtctggttactctttaggtctatacatgtagatataaaattgtctctaagaggctgggcgccacacttgtaattccagcactttggaaggctgagacaggcagatcacttgaggtcaggagttcgagaccagcctggcc

SEQ ID NO: 11515 - DNA, 369 bp, Homo sapiens
  misc_feature 243, 245, 246, 247, 249, 255: n = A,T,C or G
tacggctgcgagaagacgacagtagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaggggattcttgtccccccagctggagaatantnnngnaatttntttagaaaggaaagtttgtttttcacagcgatggggtaatgcagcctaagccttctgactgtctgcgaatgcttgtgcctgccgccgcgctggccttattgttcgctattcagg

SEQ ID NO: 11516 - DNA, 387 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaaggaacagaaaataacttataaaagtgtataaaaattacatgccaggccgggcgcggtggctcacgcctgtaatcccagcactttgggaggccaaggcgggaagatcacgaggtcaggagatcaagaccttcctggctaacat

SEQ ID NO: 11517 - DNA, 364 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaaggggagtctccggcgggttgttgcctgggctggacgtgggtttgtctgctgcgcacgctctcgcgctctcgtttaatttcggaggccgccagcgggatggccacaagcagatttatactcgccaagccttggggacactacaggaccgctg

SEQ ID NO: 11518 - DNA, 384 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggacagacagcactgagatatacagaaagtaagaactttcaggctgggcgcggtggctcacgcctgtaatcccagcactttgggaggctgaggcgggtggatcacgaggtcaggagatcgagaccatcctggctaacacagtg

SEQ ID NO: 11519 - DNA, 365 bp, Homo sapiens
  misc_feature 365: n = A,T,C or G
tacggctgttagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagatgacgacagaagggtacggctgcgagatgacgacagaaggttacggctgccagaggagacagaagggaactgctgcgagatgacgacagaagggtactgcttcctagaggacgacaaagggtaccggttgtaagan

SEQ ID NO: 11520 - DNA, 360 bp, Homo sapiens
tacggctgcgagaagacgacagaagggtacggctgcgagaagacgacagaagggtacggctgcgagaagacgacagaagggtacggctgccagaagacgacagaagggtacggctgccagaagacgacagaagggtacggctgccagaagacgacagacgggtaccgctgcgagaagacgacagaagggtacggctgcgagaagacgacataagggtacggctgcgagaagacgacataagggtacggctgcgagaagacgacagaagggtacggctgcgagaagacgacagaatggcgtgaggatggtgtgaccccatatatgattttctttaaggatgggttagaaatggaaaaatgt

SEQ ID NO: 11521 - DNA, 356 bp, Homo sapiens
tacggttgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagtgtacggctgcgagaagacgacagatgggtacggctgcgagaagacgacagatggtgcaacatgctgaaccccggctctactgttaagatacaaaatgagctggtgtgttgcact

SEQ ID NO: 11522 - DNA, 362 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggcctt

SEQ ID NO: 11523 - DNA, 334 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggaagccgaggaagagcgttttggggacgggggctggtgaggctcacgttggagggcttcgcgtctgcttcggagaccgtaaggatattgatgaccatgagatccctgctcagaaccc

SEQ ID NO: 11524 - DNA, 351 bp, Homo sapiens
  misc_feature 3, 4: n = A,T,C or G
tanncttgcttgaagacgacagaagggtacggctgcgagaagacgacagaagggtgcgggtgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgactgaagggtacggctgcgagaagacgacagaagggtgcgggtgcgagaagacgacagaagggtacggctgctagaagacgacagaagggtacggctgctagaagacgacagaagggttcggctgcgagaagacgacagatggg

SEQ ID NO: 11525 - DNA, 386 bp, Homo sapiens
  misc_feature 290, 294: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaaacgacngaanggtacttttttttaaaactttaagagggggccgtttttttggtactccagactggtgcggtttcttggttgtttgggacaccccccctttta

SEQ ID NO: 11526 - DNA, 397 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgactgatgggtacggctgcgagaagacgacttaagggtacggctgcgagaagacgacttatgggtacggctgcgagaagaccacttatgggtacggctgcgagaagacgactttttgggacgctgcgaaaagacgactttttgggacgctgcgagaagaccactttaggggacgctgccacaagaccacctaatggtacgctgccaaagacgacataa

SEQ ID NO: 11527 - DNA, 368 bp, Homo sapiens
  misc_feature 368: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtccggctgcgagaagacgacagaagggtacggctgcgagaagacgacagaagggacggctgcgataagacgacagaagggtacggctgcgagaagacgacagatgggtacgtttgcgagaagacgacagaaggtacggttgtcataagacgacagataggaacggctgcaagacgactn

SEQ ID NO: 11528 - DNA, 355 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggagctaacctcacactcatcccattctaaactatgtgattcaacactgattttacatccaacaaagtgaaatcttgatagttgggtgtaaaaaggagagtaatggagatttc

SEQ ID NO: 11529 - DNA, 362 bp, Homo sapiens
tacgggtgcgagaagacgacagaagggtacggctgcgagaagacgacagaagggtacggcttgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggttagatctggtaagaactcactcactatcataagaag

SEQ ID NO: 11530 - DNA, 380 bp, Homo sapiens
tacggctgttagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagaccacagaagggtacggctgcgagaagacgacagaagggtacggctgcgagaagacgacagaagggtacggctgcgagaagacgacagaagggataggttaattagcctgcttgtggtacctttttcacaatgtacattcgtcgggggc

SEQ ID NO: 11531 - DNA, 344 bp, Homo sapiens
tacggctgcgagaagacgacagaagggtacggctgcgagaagacgacagaagggtacggctgcgagaagactacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggacaatcgagtagtactcccgattgaagcccccattcgtataataattacatcacaagacgtcttgcactcatg

SEQ ID NO: 11532 - DNA, 381 bp, Homo sapiens
  misc_feature 340: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatatgctggaaaaacnacatattggtacagtgtgggggggcgcttttggttatgtca

SEQ ID NO: 11533 - DNA, 357 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaacagctaaggactgcaaaaccccactctgcat

SEQ ID NO: 11534 - DNA, 392 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggatggctcaactaaatactaccgtatgtgccaccataattagccccatactccgtacactattcctgatcacccgctatggcaaaagaaaaaataaaacagccggccggtttctgctttttg

SEQ ID NO: 11535 - DNA, 366 bp, Homo sapiens
cggcctacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaagggtacggctgcg

SEQ ID NO: 11536 - DNA, 360 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggcattatatt

SEQ ID NO: 11537 - DNA, 372 bp, Homo sapiens
  misc_feature 186, 213: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagangggtacggctgcgagaagacgacagangggtacggctgcgagaagacgacagaagggtacggctgcgagaagacgacagaagggtacggctgcgagaagacgacagaagggttaataacctcattcacacgagaagacaccctcatggtcatacacctatccgccattctcttgctatccctcaac

SEQ ID NO: 11538 - DNA, 429 bp, Homo sapiens
  misc_feature 290, 293, 297, 310: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgctagaagacgacagaagggtacggctgcgggaagcgacngangggnccatttttttgangacacagacggggcggttttttttgtgactcaaaagggacgtttccttggggcttgggccgccccccttttgttggcggaaaaaaggcttttttttgaaatctggaacgttgggttttt

SEQ ID NO: 11539 - DNA, 384 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagactacagaagggtacggctgcgagaagacgacagaagggtacggctgcgagaagactacagaaaggtacggt

SEQ ID NO: 11540 - DNA, 391 bp, Homo sapiens
tactgctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggatacggctgcgagaagacgacagaagggtacggctgcgagaagacgacagaaggggcaattcaatatgaaaatcacctcggagctggtaaaaagaggcctaacccctgtctttagatttaca

SEQ ID NO: 11541 - DNA, 362 bp, Homo sapiens
  misc_feature 362: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacggcctacggctgcgagaagacgacagaagggtacggctgcgagaagacgacagaagggtacggctgcgagaagacgacagaagggtacggctgcgagaagacgacagatgggtacggctgcgagaagacgacagaagggtggccaatatggagaan

SEQ ID NO: 11542 - DNA, 390 bp, Homo sapiens
  misc_feature 327: n = A,T,C or G
tcgattcgaattcggcacgagcctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctggctgccatgccccagcctccagcccaggctgcatactatggctgtggcccagtgacacccacccagcctgcccccaggtggacatnccagccacctagacctttctggtgcctcaatgtccggggcaccagtgtgctcggcgcccccgg

SEQ ID NO: 11543 - DNA, 318 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgtgagaagacgacagaagggacttgggaggctgaggcacgagattcctttgaacccaagaggtgaggctatgttgagctgagatcacaccactgtactccagcctgatgacagagggaagactctgtttcaaaaaaccggagagaaatt

SEQ ID NO: 11544 - DNA, 309 bp, Homo sapiens
  misc_feature 252: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagatgggtacggctgcgagaagacgacagatgggtacggctgcgagaagacgacagataggtacggctgcgagaagacgacagatggtacggctgcnagaagacgacagaaggtacggctgcgagaagacgacagaagttacggctgcgagagg

SEQ ID NO: 11545 - DNA, 317 bp, Homo sapiens
  misc_feature 231: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagatgggtacggctgcgagaagacgacagaaggggggcgtagccatggcgggtaacgctactaccaaaccgtcgcagctgctgccggtagagcttgtggacanatgtataggatcacgaattcacatcgtgatgaagagggatagggaaatggtgtactcttctagaattggtggacttggcattatgg

SEQ ID NO: 11546 - DNA, 275 bp, Homo sapiens
tacggctgtgagaagacgacagaagggtacggctgcgagaagacgacagaagggtacggctgcgagaagacgacagaagggtacggctgcgagaagacgacagaaggatacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggcaccc

SEQ ID NO: 11547 - DNA, 366 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggggctttcttctttcttcctaacattttcatgtgagatccagaaaggacacattgtctctggccattcgaagaaagaaagaaagaaaaaaaaaaacggtttttaaagacagagagagaaaaaggctgaaatgggttcgctgggttctaaaaatccgcaaaccaaacaagcccaagttcttcttttgggacttgactcagctgggaagtctactctcctttataaataaaagc

SEQ ID NO: 11548 - DNA, 377 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggctgagggctgggaagtttcttggagaggcaggccccttagccgagccttgg

SEQ ID NO: 11549 - DNA, 361 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacaacagaagggtacggctgcgagaagacgacagaaggatacggctgcgagaagacgacagaagggtacggctgcgagaagactacagaaggatacggctgcgagaagacgacagaagggtacggctgcgagaagacgacagaagggtacggctgcgagaagacgacagaagggtacggctggagaagacgaccgaagggtacggctgcgagaagaccacagaagggtacggctgcga

SEQ ID NO: 11550 - DNA, 412 bp, Homo sapiens
ttcgaattcggcacgagctgggcttctccaacaccatgtactcaagactaggggagatcatcagcatggatgggtccatcactgtgaccctggcgacgcaccatgctattggtctcaatgggatcatctgggctggcactgaggagcaaaaagccaaatacttgcctaaactggcgtccggggagcacattgcagacttctgactcacggagccagccagtgggagcgatgcagcctcaatccggagcagagccacactaagcgaagacaagaagcactacatcctcaatggctccaaggcctggattactaatggaggactggccaatatttttactgtgtttgcaaaaactgaggtcggtgattctgatggatcagtgaacgacaaaatcacagcattcatagtagaaag

SEQ ID NO: 11551 - DNA, 433 bp, Homo sapiens
atcaagacagctacgcggatttatgcggatcccatcgattcgaagtcggcacgagattgccatgcaaaacaggctcccctgcatctacttaggtgattcgggaggagcatacttacctcgacaagcagatgtgtttcctgatcgagaccactttggccgtacattctataatcaggcaattatgtcttctaaaaatattgcacagatcgcagcggtcatgggctcctgcaccgcatgaggagcctatgtgcctgccatggctgatgaaaacatcattgtacgcaagcagggtaccattttcttggcaggaccccccttgggtaaagcggctactggggaagaagtatctgctgaggatcttggaggagctgatcttcattgcggacagcctgtagtaagtgaccactgagctttggatgatcatcatgccctt

SEQ ID NO: 11552 - DNA, 348 bp, Homo sapiens
  misc_feature 348: n = A,T,C or G
tacggctgcgagaagacgacagaagggaatgtccctttgcagatgctacaaaaaacatattttcaacctgctgaaccaaaaaaaaaatgcttaactctgtgagatgagtgcatagatcacaaagcagtttcaaatacagattctttttagtctttatctaggaatattcactttttccacataggcctcaattggctcacaaattttcctttacagattatccaaagagaatatttgcaacctgctgaaacaaataaaggtttactctgtgagataaatccacacatcacaaagcattttaacagaaagattatttttagggtttatatgggattatttggtttttcn

SEQ ID NO: 11553 - DNA, 376 bp, Homo sapiens
tacggttgttagaagacgacagaaggggatttgagagtctcctcccattttctcactgagtaccctgtgatcattacactctttctctgctgcatccctgctgtctcagtgcattggtctgttactgagcagtgggcatatgaatctgttgatcccataacactcttggtcccctgctaagggtttgggcttaatgtcttccagggacaggagatgatgtcttgagtacaatgcaaggagttgtataaagctgggagcattaaagggctgaacctcagtgatagagtataccagaaaaatagtttattcccaagatctgggaaacaaaaggggagcttgtcagtttctgcttggcctatgagaggacagagaacct

SEQ ID NO: 11554 - DNA, 361 bp, Homo sapiens
tacggctgcgagaagacgacagaagggggttttctagattgtacttatgcataagatagtttttaaagaaagcattccactgtgtaaatttttttttgtctttttttgaaactgtcctgctctgtcacccatcctggggtgcagtagtgtgatcatggctcgctgtagccacaacctctcaggctcaagtgatcctcttaccttagcctcctgcgtggctgggactgcagatgtttgccaccatgcccgccccattttttttcttttttttatagagatgagattttgctatgtcgcccagactggtctcgaactcctggcctcaagcaatcctcacgcctcagcctcccaaagtgttgat

SEQ ID NO: 11555 - DNA, 348 bp, Homo sapiens
tacggctgcgagaagacgacagaagggttattacccatgttctcttctccaagggaagctatcacatcttttatctttaagccaggcatggtggtatgcacctatagtcctagctactgggaaggctaaggcaggaggattgcttgagcccaggagttcaagggagcagtgagctatgagagcgccactgtactccaacctgagcaaaaaagatcttgtctcaaaataaataaataaacaaacaaacagaaaaattctgccccaaaccaagattactattaacacatgtagtatcacaacacacattaactctctcccattaattccccaggagagtaaatcttagtg

SEQ ID NO: 11556 - DNA, 405 bp, Homo sapiens
tcgattcgaattcggcacgaggtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctata

SEQ ID NO: 11557 - DNA, 381 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggcggcttaactaaatactaccgtatggacgcccataattacccccatactccgtacactattcctcatcacccgctatggaaaaaactataataacacgcccgcccgtct

SEQ ID NO: 11558 - DNA, 377 bp, Homo sapiens
ggcacgagcctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgcccccc

SEQ ID NO: 11559 - DNA, 236 bp, Homo sapiens
cgcgaataattcaccacctttctttctcagcttctataactatagggcgctgtatttctcatggcagaccctctgcttctttattgtgcacctttgagactagtgcctatgagcgttatttggtcccctgtttttttggtaggtcttatataaaacaaacattcctttgttctactgccgtgaagggcctccctcttcctttatctgaagtggtgaatatactacatatacattct

SEQ ID NO: 11560 - DNA, 363 bp, Homo sapiens
  misc_feature 291: n = A,T,C or G
ggcacgagaatgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggacccccctttgttaaaggcgcaactgggngaagaagtatctgctgaggatcttggaggtgctgatcttcattgcagaaagtctggagtaggtgaccactgg

SEQ ID NO: 11561 - DNA, 351 bp, Homo sapiens
  misc_feature 72, 74: n = A,T,C or G
tacggctgcgagaagacgacagaagggggatatgaaaaaggttcgttgttttttacttttggatataatggngnatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtagggtggttatggaattggaatttaaactcccaactaatgagcttaagctgcttggaatattaattatgtagtttttacattccattttaaaacaaaaacttagaaaagatgctggg

SEQ ID NO: 11562 - DNA, 375 bp, Homo sapiens
tctaccgctgcgagaagacgatagaagggggaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgatatagatcctagtgtgccagaagatgaaaaaataattgaaccaatagaggatatggtgactacagcttctacgtacctgtttgaagccacagaaaaaagatttttttttaaaaatgtatctatattaactcctgagaattggaaggaaaatcctcagtacaaaaggccggaacatgaaaaccataaacatgct

SEQ ID NO: 11563 - DNA, 349 bp, Homo sapiens
tacggctgcgagaagacgacagaaggggagcagctgttcaggcatgcacagagacccaggtgctttacgtactccggcactgggatttccaacaaacatgtttgcaactcaggcaaggcaagaggtctgcacatacccctaggaagtggtcagaatccagggagctgagcagcattgttctgcaggccacacttccacggcacctgaaaagataagacccactggcttggaattccagccagctaccagcaacagggtggagcttgcctgagaccagatggagccccagggggaagggtgggcaccatcgctgctgtttggtcaacagctgttccagcccataggcttt

SEQ ID NO: 11564 - DNA, 348 bp, Homo sapiens
cgttgctgtcgagcgggatggctccatggccagagcgagaccactggcagccattggcaaacactgtgtctagcgcatgctacttctgtgagaccagatacccaaattcgccgttgccactttaccacccgcctgaatcctgggattctagtatgcaataagagatgccctgtactgaagcaaaatttaataaagtttgtcacagagaaaaaaaaaaaaaaaaaacctccgggggccgttttctactaaaatccacccgtgatgaaacacattgtagagttgggacaacccccaactaaaaggcagggaaaaaatggctttattggtaaaattggagatcctatggtg

SEQ ID NO: 11565 - DNA, 369 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggataaccatgcacactactataaccaccctaaccctgacttccctaattccccccatccttaccaccctcgggtaccctaacagaaaaactcatacccccatatgtaaaaaacccctcacttttatatttggggggcgcctttttttttgtaac

SEQ ID NO: 11566 - DNA, 366 bp, Homo sapiens
tacggctgcgagaagacgacagaagggtacggctgcgagaagacgacagaggggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaag

SEQ ID NO: 11567 - DNA, 355 bp, Homo sapiens
ggcacgagagctgctgcagcagcggcactacaagccaaatcagatgagaaggcggcggttgcaggcaagaagcctgtggtaggtaagaaaggaaagattctgggtgcagttctccaatgacaggaaaaaaaacaaagagaatttgaagaatacgtcagagacaaatacattacaaccaaaattgacttcaaggcacttttgaaggagatcaaatttataacaaaataatttattgaaagtgaaagcttgtggaagatgttggaatcatccatcctgaaaattgaagtcttctgtttattaacagaacagctaagaagctaatctaagaatgaccagcacctgaaagatgtagacg

SEQ ID NO: 11568 - DNA, 386 bp, Homo sapiens
ggcacgaggagagaactagtctcgagagcagttctctcagagaactagtctcgagagcagtttttttttttttttttttagcccagggcttttataaccccaaacagttccttggctttggggtgggggaaacagtaagtcaaacaacttttgccacaataatgtttgtcaaagggacttgccttaacccccccacccccccccttttttttattgaaaccttgagcctactcttttaaccaatagccctggccgtacccctaaccgttaaatttatggggggccccctactcttgcccctaatgggaaccccccccctatcaatatcaaccattacccttccctttacccttatcatcttcccaattctaattctacggactacg

SEQ ID NO: 11569 - DNA, 362 bp, Homo sapiens
ggcacgagagctgctgcagcagcggcactacaagccaaatcagatgagaaggcggcggttgcaggcaagaagcctgtggtaggtaagaaaggaaagattctgggtgcagttctccaatgacaggaaaaaaaacaaagagaatttgaagaatacgtcagagacaaatacattacaaccaaaattgactttaaggcacttttgaaggagatcaaatttataacaaaataatttaatggaagggaaagccttgggaagatgttggaatcatccattcctgaaaatgaaagtcttctgtttatcaacagagcagctaagaagctaatctaagaatgaccagcacctgaaagatgtagacaacattg

SEQ ID NO: 11570 - DNA, 361 bp, Homo sapiens
  misc_feature 361: n = A,T,C or G
tacggctgcgagaagacgacagaagggtataagtctaataccaaattagaaactctagaaataaatatcagtgaaacttaaagcacagcaatataaagtatctaagctgaagcacagaaagaataaactatacaaagatgactggagtccatcatccaaaagctcctagatctgatacacaaatccattatagtctcaaaatacaaaatcagcatacacaaattagtagcactgctgtacaccaacaacgaccaagctgagaatcaaatcaagaactcatttccttttacaacagctgcaaaaaaataaaatactaaggaatatacttaaccaaggaagtgaaagacccccacaagaaaan

SEQ ID NO: 11571 - DNA, 386 bp, Homo sapiens
cgttgctgtcggggactcagaatagccaaaacaatcattgaaaaaaaaaaaaaaaaacaatgttgcaaaatttatactttttgatttcaaaacttactacaaaattaccctgatcaaaatagtatggtaggggtataggataaacatccggaataaaattcaaagtccaaaaataaccttatatatgcatagccagttgttttttgaggaggatgccaaaaccattctggggcaaaaaaatagttttttcaacaaagggggctgggaccactggatatccatatgtatgtgaataaattgggacccctacctttcttcatacccaaaaattacctcaaaaaatggatcaaagacttaattgtaggagtaaaacctccaaatttcta

SEQ ID NO: 11572 - DNA, 409 bp, Homo sapiens
ctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtg

SEQ ID NO: 11573 - DNA, 382 bp, Homo sapiens
  misc_feature 77: n = A,T,C or G
tacggctgcgagaagacgacagaagggtcgcgccattgcactccagcctgggagacaagagcaaaactccaactcanaaaaaaaaaaaaaaaaaccggggaaaaaatttttgggggtttttttttaaaaaccaaaaaaaatttttttccccaaaaaaaggggggggatttgaaatttttgaaaaaggggagggaaacccaaaaaaaaattttttccgggaaggaaatttcccttcaaaaaaccctggaaaaacccgggaccccccctcccttaaaggggacccccttgggggggaagggggtttgggtggaaaccctaaattaaagaaaagcccaaaatggccttttctttttttcccggggcaaaaaagggcatggccccc

SEQ ID NO: 11574 - DNA, 390 bp, Homo sapiens
gaattcggcacgaggagcctaaaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggaagcgctattgagcatcctccacaccaaggttgatgaaggaagggatcccagcagggtttctgctctggggctggcaggttgcctg

SEQ ID NO: 11575 - DNA, 318 bp, Homo sapiens
aggaggataacatcgagccggaggagacgagtcgcagaaccccggatccggcgaagtcggcgggcggctgtaggaacaaggcggagaagcgtctcccgggacctgacgagctgtttaggagcgtgactcgcccggcctttctctacaatccgctcaacaaacagatagactgggagaggcacgtcgtcaaggcgcctgaggagcctccaaaggaattcaaaatatggaagtcaaattatgtaccacctcctgagacctacaccactgagaagaagcctccgcctccagagcttgacatggcaataaaatgggctacat

SEQ ID NO: 11576 - DNA, 425 bp, Homo sapiens
  misc_feature 336, 399: n = A,T,C or G
tcgattcgaattcggcacgaggccagccaaagccccctgaaggagctggctgctttaaaggatttacttgggaggatgtcaaatggctttgccttctgcagacttcatttattttaatctttttatggctcctttctcttgctttaaaacaggattataagcacacagcaggtactgacacctgaagtcttactaaattcctgtcctcaggccatcctttttctcctgaaacctggactccaattttcaatgacgtttttgtttttctctttcaagcctaactatgggacagctttacgagaaggaaaaagatgaagatggattcttatatgtggnctacagcggagagacacttttggcttctgagggccaatgctggctaggtgcaccgtactgctngtgtatcttgaaatagccagcatttt

SEQ ID NO: 11577 - DNA, 161 bp, Homo sapiens
  misc_feature 12, 161: n = A,T,C or G
gaatgtttccangccacctcggaggagaatcagatcccctcgcacttgcctgcctgcccgtcgctccagcacgtcgccagcctgcggggcagagccatcatcctgctgtacgtgcaggccttccaggagggcatgccaccccctgggtgctgcacgggccn

SEQ ID NO: 11578 - DNA, 370 bp, Homo sapiens
  misc_feature 24, 25, 26: n = A,T,C or G
tacggctgcgagaagacgacagannncgctcccatttcttgctagctattgcaaatgagggaagaacattattcatctctcctcccctttttttttctgattcttttttcagtcagttttgctcctgggttcaagtagtattaccaccctttcacaagcaacagactctcacagggcaaaaaaaaaaaaaaaatttatggtttcacaaacagatttggacccttttttatttttaagaattggttagccccaaaaactaaaatggcaaaggggcccaacctatttctttcttggggaaaagggggccccttttttgagctgaagttccaaaaaagcagttattgttcaaaaaaaattgacctcacctcac

SEQ ID NO: 11579 - DNA, 233 bp, Homo sapiens
cagactcagcaccaccatcagcttcttcatggccgctcctgctgcaggcctccgggcctccggggattcttgagtcgggggaaggaacagctttgagacgaggaggcagaaagagttagaaatgcggggagccgtgaggagagaagacactcagatgcagtggcagagccaagcggaggacgcaggggccgcagagcccagggctgcagggactgccagacacacccccccag

SEQ ID NO: 11580 - DNA, 371 bp, Homo sapiens
  misc_feature 297: n = A,T,C or G
tacggctgcgagaagacgacagaagggtctcccatttcttgctagctattgcaaatgagggaagaacattattcatctctcctcccctttttttttctgattcttttttcagtcagttttgctcctgggttcaagtagtattaccaccctttcacaagcaacagactctcacagggcaaaaaaaaaaaaaaaatttaaggttccacagacagattgggggccttttttaattctaagaaatggctagccccaaaaactaaaattgcaatgggccacaccctatttccttcttgtggngaggaggcactcttttgagctgagttcaaaagagcgttattgtcaagaaaaatggactcaccaacacaaagccg

SEQ ID NO: 11581 - DNA, 364 bp, Homo sapiens
tacggctgcgagaagacgacagaaggggaaactgatagtggattattgtaaacttaaccaagtggtgactgcaaaattcacacatctctggtccctgctactgcatgcagctgttgatctgacgaatgcccttctctttatacctgtccataaggcccagcagaagcagtttgcatccagctggtaaggccggcaatgccccttggcggtctgggctgatgggtatatcagctctccagccctatgtcacagtttagttcacagtcatcttgatcacctttcccttccacagatatcatactggggctgggcacgtggctcactcctgtaatcctagcacttcaggaggccgaggcaggaggag

SEQ ID NO: 11582 - DNA, 397 bp, Homo sapiens
tcccatcgattcgaattcggcacgaggcccctcccccagcctcgctgccgccttgcagtttgatctcagactgctgtgctagcaatcagcgagactccgtgggcgtaggaccctacgagccaggtgtgggatgtaatctcatggtgagccatttttttaagccggtctgaaaagcgcaatattcgggtgggagtgacctgattttccagagctggtatacgatgcctctccagaatcaccttgttctttctggatctattcagaatctgaaactcctagaaaagaaaaatgcaagatgcatgaggtggaaaatgaagcacagagaagttcagtgatggacctcagatactaccagcagaaagcagaagagctaggatttcaacttaggatgtctggg

SEQ ID NO: 11583 - DNA, 391 bp, Homo sapiens
cccatcgattcgaattcggcacgaggccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctctctcaaggatgaggttttgaagattatgccagtgcagaagcagacccgtgccggccagcgcaccaggttcaaggcatttgttgctatcggg

SEQ ID NO: 11584 - DNA, 404 bp, Homo sapiens
  misc_feature 404: n = A,T,C or G
ggcacgagacaacctaaaagtggcttcagaggaaaagcaagaaaggctccaaagaagtgaaaataaacagccacaggattctcaaagttacggaaaaaagaaggatgcgatgtatggaaattttatgttgaagaaagacattgccatgctcaaagaggaattatatgcaataaaaaatgacagtctcagaaaggaaaagaaatatattcaggaaattaaaagcattacagaaataaatgctaactttgaaaagagtgtaagactcaatgaaaaaatgataacaaaaacagtggcccggtattcgcaacagcttaatgatctgaaagctgagaatgcaaggctgaattcagaattggagacgggagaacaccacaaggaagactagatgctgaagttgatccctn

SEQ ID NO: 11585 - DNA, 252 bp, Homo sapiens
ggatcccatcgattcgaatcagactcagcaccaccatcagcttcttcatggccgctcctgctgcaggcctccgggcctccggggattcttgagtcgggggaaggaacagctttgagacgaggaggcagaaagagttagaaatgcggggagccgtgaggagagaagacactcagatgcagtggcagagccaagcggaggacgcaggggccgcagagcccagggctgcagggactgccagacacacccccccag

SEQ ID NO: 11586 - DNA, 441 bp, Homo sapiens
  misc_feature 423: n = A,T,C or G
ctccgggcgagtacttcagcgttgggagccaggtgtcgtgccggacgtgccaggagcagcggctgcagggcgagggggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccncatatcaagtggaaaact

SEQ ID NO: 11587 - DNA, 366 bp, Homo sapiens
tacggctgcgagaagacgacagaagggaaactatgcgcacaaactagaaaacatacaagaaatgggataaatccttagacacatacaacctcccaagattgaaaaaggaagaaattgaatccttgaacagaccaataatgagacccataattaaattagtaataaaaagctaccaaccagaaaaaagcccaggaccagatgagttcacagcctaattctattctatcagatgtataaagaagaactgtaccatttctactaaaatattccaaagaatcacagcctaatctatcagaagataaagaagactgtaacattctactgagatattcaaaaaataagaggaggattcttcgagctcatcaa

SEQ ID NO: 11588 - DNA, 349 bp, Homo sapiens
  misc_feature 180, 201, 218, 286, 349: n = A,T,C or G
tacggctgcgcgaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggagctgagtgtcccgcggngcccgaagcgtttactttganaaaattagagtggtcanagcaggcccgagccgcctggataccgcagtaggtataatggataggaccgcggttttttttgtgggtntcggactgaggcctgattagagggacggccgggcattcgtatggcgcgtagagtgaattcttn

SEQ ID NO: 11589 - DNA, 400 bp, Homo sapiens
  misc_feature 347: n = A,T,C or G
ggcacgaggttcttccggttctttgtgccgccttcacccagtgaaggagcctgtatccaccctgcccagtcgctgttgggctgctgcggagcttccgctgccatcttcggatcctggcagggagcagggtctggcactcacaagggcgcacgactaggacttgtcgaatgaatcccttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcanctgggcggtggtcgggtcgtggggcggtagggcgggagcggaggaagggaaag

SEQ ID NO: 11590 - DNA, 377 bp, Homo sapiens
  misc_feature 21, 22, 23, 24, 25: n = A,T,C or G
tacggttgcgataagacgacnnnnncggataggaatgaagatcatttacattcagaagaagattgaaacccaatgcaaggaatctaaggaatacaataaaatgatacaggagataaaagatgaaacggccattttaaagaagaaccaaactgaagtgatagagctgaaaaactcacttccagaattttgtaataaaatcacaaatattaacagcagaatcaaccaagctgaagaaagaatctcagagctgaagacaaattctctgaaataactcaagcagacaaaaatagagaagaatcaaaaaagaagaatgagcaaaacctcttagaaatatgggtgtatgtgaagagaccaaatttatgacttataagcctgct

SEQ ID NO: 11591 - DNA, 375 bp, Homo sapiens
  misc_feature 375: n = A,T,C or G
tacggctgcgagaagacgacagaaggggataggaatgaagatcatttacattcagaagaaaattgaaacccaatgcaaggaatctaaggaatacaataaaatgatacaggagataaaagatgaaacggccattttaaagaagaaccaaactgaagtgatagagctgaaaaactcacttccagaattttgtaataaaatcacaaatattaacagcagaatcaaccaagctgaagaaagaatctcagagctgaagacaaattctctgaaataactcaagcagacaaaaatagagaaaaatcaaaaaagaagaatgaacaaaacctcttagaaatatgggtgtatgtaaagagaccaaatttatgacttataagcctn

SEQ ID NO: 11592 - DNA, 377 bp, Homo sapiens
  misc_feature 340: n = A,T,C or G
gcaggatcccatcgattcggaaagacacagatggcaatagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgcctactccatcacctnctgctgactgggctggattgaggcatccgacctatga

SEQ ID NO: 11593 - DNA, 411 bp, Homo sapiens
  misc_feature 365: n = A,T,C or G
ggcacgagggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggagttaagcgggaggacgcgcgggacctgtgagccctcccggaggtggaccccctttccagcacctctgcgagagatccggagacctgtgggcagctggcggaggggagactcagcagacggaccctcgtccgtgcctgccttccanaatggagccaggcttccaactttcgctggcttacgacatagggacg

SEQ ID NO: 11594 - DNA, 401 bp, Homo sapiens
  misc_feature 401: n = A,T,C or G
tacgtctgcgagaagacgacagaacgttcagttccatgacaagatagatcagatccttgagagcctggaccgcatcgtggaacgtctgaggcagccaccctctatctctgcagaggtcgtgaagatcaaggaacagatcagtgaaaataagaatgcgtcagtagacatggaaaagctacagccgttgtatgaaactcttaaacagaggggagaggaaatgattgctagatctggggggactgataaagacatatctgccagagctgctcaggataagcttgaccaaatgagtttcatttgggagaacatacacacactggtggaagagagggaagccaaactactggatgtgatggagctagcagagaagctctggtgtgatcacatgtcattgatagttn

SEQ ID NO: 11595 - DNA, 389 bp, Homo sapiens
  misc_feature 302: n = A,T,C or G
attcggacgagcagactcctcaatctgagtgagagtttagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggngtcaggaagaaagtttggtggattagaagatagaaataggtggtcctaagaatgtgatggccacaagggaagagagaccccagtcag

SEQ ID NO: 11596 - DNA, 370 bp, Homo sapiens
  misc_feature 282, 363, 364: n = A,T,C or G
tacggctgcgagaagacgacagaagggaacaaaacaattatcagccaagaattttgtatccagtcctatgtttgccctccttaaacaaaacaattatcagccaagaattttgtatccagcaaaactaggcttcataaatgaaggaaagataatctttcagacaaacaaatgctgagagaatttgccactaccaagccaacactataagaaatgctaaaaggagctctaaatcttgaaacgaatcctcgaaatacacaaaaatagaatgttcttaaggcatanatctcacaggatctattataacacacacaccacaccacacactgaaaaaaaacaccacgcatttatgtaacaaataccacnnatgata

SEQ ID NO: 11597 - DNA, 328 bp, Homo sapiens
  misc_feature 314: n = A,T,C or G
tacggctgcgagaagacgacagaagggtacggctgcgagaagacgacagaagggtacggctgcgagaagacgacagaaggggaaaagaagataatttaacattagatattgctaaaccgaaaagacagctttttgaggcatctcaggctcatctcagcctgttgcctggagctgatattcttactggagccgctgatggcctttctaacactaatcctttaaaagtgattaaaaccataggtggatcaacaaattgcaaatttaatttgggttggggctgtttatgctgttatttttagtctacagatgccgcngcgcctggtagaga

SEQ ID NO: 11598 - DNA, 356 bp, Homo sapiens
tacggctgcgagaagacgacagaagggaaactatgcgcacaatctataaaacatacaagaaatgggataaatccttagacacatacaacctcccaagattgaaaaaggaagaaattgaatccttgaacagaccaataatgagacccatagttaaattagtaatatatagctaccaaccagaaaaaagcccatgaccagatgagttcacagcctaattctattctatcagatgtataaagaagaacttggaccatttctactaaaattattccaaaaaattcacagactacttctaccagatgtatagagaagaactgggaccattcctactggaattattccacaaattgaggagg

SEQ ID NO: 11599 - DNA, 404 bp, Homo sapiens
  misc_feature 372: n = A,T,C or G
ttcgaattcggcacgaggggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttcttgatcacattaatggaaagaaacatcagagaaaccttggcatgtctatgcgtgtggaacgtccacccctgaataangtgaagaaacgtttgagggcacaacaagaaaa

SEQ ID NO: 11600 - DNA, 393 bp, Homo sapiens
cgttgctgtcggtgcaatctgagtacgatccctgttctaggcatgacaggtgattggctctagtaaaaactgatgcagtgacattattcttagtgttttcaaaggagagaaagctgaagaattcgtggccgcaggagttttttttttttttttttttgtaaaaaaattttttttttgccccccgggttgaagggaggggcccaatttgggttaaatggaaccccccccctccgggttgccccctttttcctgccccaaccctttgaatttttgggaaaaaggggccccccccccccccccggtttattttttgtttttttaaaaaaaagggggttttctttgtttacccgggggggttttaaatcccgggccctgggaacccccccccttacc

SEQ ID NO: 11601 - DNA, 223 bp, Homo sapiens
  misc_feature 23, 223: n = A,T,C or G
ggcacgaggctacgcgccacggnctgaagctgagaaaactttcagttatccgtggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacn

SEQ ID NO: 11602 - DNA, 357 bp, Homo sapiens
  misc_feature 357: n = A,T,C or G
tacggctgcgagaagacgacagaagggggctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggatcttcttgacttagcagctgaagactgatgctgcccgattgccttggaagcccccctagaccatcacagatgn

SEQ ID NO: 11603 - DNA, 367 bp, Homo sapiens
ggcacgaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagcccggc

SEQ ID NO: 11604 - DNA, 391 bp, Homo sapiens
  misc_feature 52, 53, 54: n = A,T,C or G
ggcacgagctgacacgggcactgttggatgagcaggaggcacgtgatgagcnnnggcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcatggccgtgatgaggctggtgatagaggcggaggcagctggccaagcagctgagagatgcaaaggtggagcgggatgaggagcggaagcagcgcactctggcc

SEQ ID NO: 11605 - DNA, 384 bp, Homo sapiens
ggcacgagcagcagtggacctgccccaaggccacacgtgcctggtcaggctggcttctgatgttcagtcccctgggccgggacagattttttttaacgtcttgaaacttaaactctgtgcttgtaggatactgtaacctttttggcttttttttttttttttttttaaacccccccccccagggggtgggaatgggccccaggaataatccttttttggtggttgggggttgggggggccctgaaccaaaagggcaattttttttttttttttttgcccccccggggggggggggggggggggtttaaaacccacgttttcccttggccttttatttccaaaccctctttgcccccagtttatgggtgagaacctttttgccgt

SEQ ID NO: 11606 - DNA, 387 bp, Homo sapiens
  misc_feature 51, 52, 53: n = A,T,C or G
ggcacgagatcaagtatgcccgctttgaataaaaacatgcttattttgccnnntcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcaa

SEQ ID NO: 11607 - DNA, 370 bp, Homo sapiens
  misc_feature 370: n = A,T,C or G
ggcacgaggcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtgggtcctgaggtcacgcatttctgccgcggn

SEQ ID NO: 11608 - DNA, 399 bp, Homo sapiens
catcgattcgaattcggcacgaggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccatagatggaaggggctgtgagggaggcttccccagcgccccttgca

SEQ ID NO: 11609 - DNA, 389 bp, Homo sapiens
cgttgctgtcggggcaatctgagtacgatccctgttccaggcatgacaggtgattggctctagtaaaaactgatgcagtgacattattcttagtgttttcaaaggagagaaagctgaagaattcgtggccgcaggagtttttttttttttttttttttgaaaaaaattttttttttgccccccgggcgggggggagggggcgaattttgggttaatggaaccctccccccccgggtttaccccatttttctggcttaaccttttggagaagtgggaataaagggcccccccccccaccccggcttattttttggttttttaagaaaaaagggggtttccttggttaacccagaagggtctaaatctctggccctggggacccccccccc

SEQ ID NO: 11610 - DNA, 368 bp, Homo sapiens
  misc_feature 18, 21: n = A,T,C or G
tacggctgcgagaagacnacnaaagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgc

SEQ ID NO: 11611 - DNA, 397 bp, Homo sapiens
cacggtttcactatggtctggtcttgaactccttacctcaagtgatccacccgctgcagcctcccaaagtgctgggattacaggcgtgagccactgctcctgctcccggcccattttttaaattattattttgagacagggtctcactctgttgcccaggctggtggaacacagtggtgtaatcatagctcactacaccctagaactcctgggctcagcctccagggggaggatcctccagcttcagcctcccaagtagctgggacagatgcatgccactacgcccagctaatgtggcttttttgtggtttttttttgatagaggtggggtctccctgtgttgtctaggctgccaggctagtcttgaactattggcctcacacagtcctcccacctt

SEQ ID NO: 11612 - DNA, 400 bp, Homo sapiens
ggcacgaggtggcacagttgtgccagagggccagactttggcagcgtgtaaggtctgaggacaggggcaccggaggccgaggatgagaggccagtgcctgtttccaggcagccagggcctcagaaactccggccggagcactcacccgtcggtggaggccgttaccagggccaccttatttgcgagcgggtcccggcgggtcatcccggagctggccatccgcaccgaattccaagcccgggcacagaggcctagcagccccgccttgtgcatggatcagaccagcaagtgccacttcggataaaccctttggactcctaactccaatcaggtgtctgctttgttgaggactcacagacacagtctcctttcttcaagatctttacaatgcaagacctca

SEQ ID NO: 11613 - DNA, 403 bp, Homo sapiens
  misc_feature 350, 403: n = A,T,C or G
ggcacgaggttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcanatagagcttgtcaacatcactgaacctttaagaaaagccttgagatcagtatn

SEQ ID NO: 11614 - DNA, 409 bp, Homo sapiens
ggcacgaggttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattggtcaaatagagctgtcaacatcactgaaaccttaagaaaagcctgagatcaggtattctacagg

SEQ ID NO: 11615 - DNA, 393 bp, Homo sapiens
ggcacgaggttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctg

SEQ ID NO: 11616 - DNA, 387 bp, Homo sapiens
ggcacgaggttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaa

SEQ ID NO: 11617 - DNA, 397 bp, Homo sapiens
ggcacgagaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacag

SEQ ID NO: 11618 - DNA, 412 bp, Homo sapiens
ggcacgaggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggtcgcctgcgcttccagctgccgccgggagggcgctgcgccctggcgcgcgtctttggagagctggcggtgcacggcgcagagcacggcgtggc

SEQ ID NO: 11619 - DNA, 402 bp, Homo sapiens
  misc_feature 402: n = A,T,C or G
ggcacgagggcagttccccctgtggtccctatctaagccctcagcagatatctctgggtccgcttgcctctccttagacatgggcttctgattctgcccagggtctcaaggtagtctgaggcaaggaccagagcttccgtcgcacctgtgttcattcaggttcttgttataagggtcaccagctgatgctggagaagtcactaccatagcagaggctcttcttgggaatggacaggaggcgaaggccctggtccgttagtctggggatgttggaaagggtctcttgccttgcagcatgtcggtgcctcaggccatggagtggctaattgaacacgcagaagacccgaccatagacacgcctcttcctggccaagctcccccagaggccgagggggccacagn

SEQ ID NO: 11620 - DNA, 366 bp, Homo sapiens
tacggctgcgagaagacgacagaagggagatctaagaaggtctttctttacttaacatatctgatattaaagatttcttttcattattctccactttttcttattttagattgctagaaaagacataatcatggattatgttgacattttctttttaaatttttgtttaactttttttttttttttttggaaacaaagcctccctttgtgcccaaggcggggggacggggccacaatttgggtggttggcgccctggcccccttggcctaattggacccccccttctaaccccccaaggtacttggaacaacaaactgggccacccaggtggggcaaattttttaagggtttttttgaaaaaaggg

SEQ ID NO: 11621 - DNA, 399 bp, Homo sapiens
cccatcgattcgaattcggcacgagtctctctctctctctctctctctctctctctctctctctctctctctctctgtgtctctctctgtgtgtgtgtgtatcactctctcttttgttcatatacacacacatagaggggcacacacaggacacatgcgcgcgtttgtgtttggggtgcgcacgtcacgggcccacacggagtatctcagggggtgtctgtatatatagaccctgcggggcatagacacacacatatatatgtgtgtccgccacatatatggggggggggagagattttggatatgaccccacacactgtggggtgcgcacacacacagagtgtggcgcattctctgtgtgagatatcgggacacacagggagggcgcgtgttccacat

SEQ ID NO: 11622 - DNA, 394 bp, Homo sapiens
  misc_feature 298, 354, 394: n = A,T,C or G
acgaggttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatggtgttgccacgataacaaaggaccaaagagcccgggaaggaaagcagntctccagtgctgatgaagcgctttaaaggacccatcattaagaagttggagagganggaacccttactattcccgcgcagggtatgggatgatggn

SEQ ID NO: 11623 - DNA, 347 bp, Homo sapiens
  misc_feature 347: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggaactggagcctcatctctcaatttatgcaaaaatcaactctaggtgaatcaaggatttaaatctaagacatgaaactataaaagttctagaaaataacatcagaaaaattcttgtagacattggcttaagcaaagatttcatgacaaagaaccaaaan

SEQ ID NO: 11624 - DNA, 354 bp, Homo sapiens
  misc_feature 322, 354: n = A,T,C or G
ggcacgagagtcagagtaaccacagctgtacatccatgccatcttctccagccaccccagccagtggaaccaagacttcacttcagttctctcgctgttatgacaaaccctggttggtaaacagtaaagctggcacccctatcagggacagccattctcctgacctccagctgcccacccccgaggttatcccatcatcaggtagcaagttgaaacgaccaaaccaacttttcattctaagtcgacatccctttgctggggataccagcaataagtctttcccggccttcacaggtggccaaactaaatcggcagaccctanaagtcttgcaggtcgccctggaagccggctgn

SEQ ID NO: 11625 - DNA, 379 bp, Homo sapiens
attcgaattcggcacgaggcacctgacaggctggcggttgggcagcccataaaagttaatgccacatagcatgcagatgagtggcccctgttcaggccggagcagcagtgatgttcagcaacccctccagtgaatggggtcacagagtgagggggcactgaatgtggaagggcactcagggtcacaaagttcagggcagaacaaaccctcaggtgacaggagggagcagattgcaggtgtggaatttgctggagtttggtgtcttcgtcaaattccttttgattactgttccgcaaaacagcagtcttcgtctgtggatgcagtgactggaaatttccatctgcaaagcatctctgtagcccagatttgggaagcttaa

SEQ ID NO: 11626 - DNA, 406 bp, Homo sapiens
  misc_feature 370: n = A,T,C or G
ggcacgaggttctgggaggtcctgggtactcggggtcaaaggtcgagtcaggttgccgcaggcaggcaggttttaggacgtagccacactgcccattgactaggaagcgcccggcattgaggtccatctcgtagcctggcgtctggaagttcaaggccaccagctgacagcccgagttccacatctcctggggactgtagttggctgagttcatccgcagccccagcgggtacacgcgggtcagctggcgggcattgtgcctgacaaagctgttccctgcctcccgaatgagtttcttggctttgcgctcgctgagggagctgacctggcaaggttgtggggcgttgggggcagggtgcagggtccgcangcgggtggcgtggcagtacacagccagggccgacag

SEQ ID NO: 11627 - DNA, 410 bp, Homo sapiens
cgttgctgtcgggaaggagaggaggatgaaggagaagatgactaaatagaacactgatggattccaaccttcctttttttaaattttctccagtccctgggagcaagttgcagtcttttttttttttttcccttttgggcccaacccccctggttttgggggcctttttttttacccccggggtccaaatttattgggggggaaaacccttggcccaaaacacaggggaaaaaaggttttccccctttttggtcaaaggaaatttttaacccttcctggcgggacaaaaacgggtggggaacccccccccccgcccttgggggaaaaaaaaaaaacccggcccctttctttttctggaaaccggggggggctaagccccctggaaaaaggccaaaaaatttaactttttt

SEQ ID NO: 11628 - DNA, 380 bp, Homo sapiens
  misc_feature 380: n = A,T,C or G
tacggctgcgagaagacgacagaagggggatatgaaaaagtttcgttgttttttacttttaaatataatggtgtatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtagggtggttatggaattggaatttaaactcccaactaatgagcttaagctgcttggaatattaattatgtagtttttacattccattttaaaacaaaaacttagaaaagatgctggcattctgagggcctgcattaggccacatan

SEQ ID NO: 11629 - DNA, 356 bp, Homo sapiens
  misc_feature 6, 8: n = A,T,C or G
taaaantnctgagaagacgacagaagggggaggagctcaagcagctcttaccacatgatacaagagccggctggtggaagagtggggaccagaaagagaatttgctgaagaggagaaggaaaaaaaaaaccccaaaaaaaaaaattaaaaaattccccccccccaaaaaaccctgcccgtaaggggggagaaaaacaaggcctttttaaaagggcaatcacaacaatttttgttgccaggatccctttgttttggttgaaaggatttttgtggccaactggctggattataggggggagttcccccaccccaggatccaaggggcacagcggggcccccaattgtccgtcttgtgc

SEQ ID NO: 11630 - DNA, 374 bp, Homo sapiens
cgttgctgtcggaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggtgtccccacctc

SEQ ID NO: 11631 - DNA, 401 bp, Homo sapiens
gtgcggagcagttgatagaacacctgggcgctctacatgtgctgagccagctgaccccgcagacagtgatggaaatagacgggctcctgggaaacaagccgcattccaagaagtagtctgtcgcgggcgcagggacccaacccggtgtcgctgcacccgcccgagccccgctcctcgcagccgcctctcccgctccggatccctccacgcagcggccggagccagactagccccgcccaccaacgagtcccggcttcgagtagtgatacgcatgaacaaagccatatccttttgcagtggggtcgagagagaaagtagcacgcccgccccctgctgcgtctttctaggcccttcttgcaaatcccgggcatgagctactcgccgtcggctctctgccactt

SEQ ID NO: 11632 - DNA, 637 bp, Homo sapiens
  misc_feature 563, 613, 637: n = A,T,C or G
tactgttgcgagaagacgacagaagggatcgcgccactgcactccagcttgggtgacagggggagactgtcttgaaaaaaaaaatgactccacataaacaacctaactttacacctcaagccaagaaaagaagagaaactaaactcaaagcagaataaagaagataataacgatcagaacacaaacacatgaaatagagactagaaaaataataggggaaaaaagaatgaaaccaagagtttgtttttttggaaagatatacaaaatgaacaaaactttagctgcacacacacacaaaaacgggaaaacgcacataagtaaataagttcagaaatggaagagtagaaattataactgatgccacagaaatgcaaaggatcataagaggctactctgaacaatttataccaagaaattgaataacctagaataaatggatacatttatagatatatacaacatatcaagactgattcatgaagaagtagataaatttgaagggatcaataatgactaattggataaatcagctttcaaaaacttctcaacaaacgaaagcccangactagacgacttcactagtgaattgttggagcatttaaatattaacaancaatgctctcaaatccttcaaaan

SEQ ID NO: 11633 - DNA, 382 bp, Homo sapiens
ggcacgaggacaattcatgacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatgg

SEQ ID NO: 11634 - DNA, 454 bp, Homo sapiens
  misc_feature 442: n = A,T,C or G
aattcggcacgaggccacccacatagtataccccttgctgcaaggatgggtgatgtatgtctcgctcacctcgtttctcatctccttgatgttcctgttgtcttacttgtttggattttacaaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgcctttccagggaagcatttccaggagatctcatggttcttgtgccctttccacctctcagtggcccgcatgctaccanaatagagtgggt

SEQ ID NO: 11635 - DNA, 393 bp, Homo sapiens
  misc_feature 58, 59: n = A,T,C or G
ggcacgagctctctctctctctctctctctctctctctctctctctctctctctctannagtgtctggctctatctctctcttgcccggactcacccatatggagacctaaaactaggtcaaactacatatacatttacatagatacacttaagcctgtgtggggaggaacaggggtcccccgaggaactgaggcagcgggaggcggctgaacccctggtggggcgggtgcttcctgtgtggatgacacaaaactatgagagtgacgaaatggtgacaggtagctgggacctaagctatcttaccatgaagggtgactcgcttattgtatatttgtgcatgaagtggaactaataagcacaatagaggacgtgaactactatctagggttggg

SEQ ID NO: 11636 - DNA, 374 bp, Homo sapiens
tacggctgcgagaagacgacagaagggggaggagctcaagcagctcttaccacatgatacaagagccggctggtggaagagtggggaccagaaagagaatttgctgaagaggagaaggaaaaaaaaaaccccaaaaaaaaaaattaaaaaatcccccccccccaaaaaaccttgcccttaagggggaagaaaaaccaggccttttaaaaaaggcaataacaacactttttgttgccagaatccctttgttttggttgaaaggatttttgtggccaatttcttgaattataggggggagttccccccccccaggatccaaggggcaaagcggggcccccgattgtccgtcttgtccgcgtgccgccttcccaagg

SEQ ID NO: 11637 - DNA, 375 bp, Homo sapiens
ggcacgagagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagcagtatgcttggtaaaagtcttcgccgttctctagtctcaataaaccagaggcacaatgtactgtgaaaagctgcagggacctctgccctggaaagccaggtattgtccaaggttctccccatgtgatagtctgaaatatagcctcatgggatgagaggctgtgccccagcccgacacccgtaaagggtctgtgctgaggt

SEQ ID NO: 11638 - DNA, 395 bp, Homo sapiens
  misc_feature 166: n = A,T,C or G
ggcacgaggttcccgcccgggactaagccggggagcgcatcccggctactgcgggtcctgggtcttcacctgcggagccttacggcagctgagcggtgggagggacctgagccgcggcgctaggatgggaaacagtgcgctccgcgctcatgtggaaacggcgcanaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaa

SEQ ID NO: 11639 - DNA, 381 bp, Homo sapiens
cgttgctgtcggacaagattattggaaatttgttataatgaatgaaacattttgtcatataagattcatatttacttcttatacatttgataaagtaaggcatggttgcgggtaatctggtttatttttgttccacaagttaaataaatcataaaacttgaaaaaaaaaaaaaaaaaaaccccagtgcccttttttgcgtgaaatccaaacggaaaaaaaaacctgagtatgttggaaacaccccgatttgaagggcagggaaaaaattgtttttttgggaaaattgggaaggttttggtttttttggaacccataatagccggcataaaacaggtaaacgacaccaagggcttgattttattgttccgggtgcggggggg

SEQ ID NO: 11640 - DNA, 401 bp, Homo sapiens
  misc_feature 50, 57, 62, 308: n = A,T,C or G
tattgcggtgctgtcgctcactctagaacttccaggtccggtattgcaangggcgangaacnacggcggaaggggaacctctgccttctgggttcaagcgaacctactgcctcagcctcccgagtagctgggattacaggtgcctgccaccatgcctggctaattttcgtatttatagtagaggcagggtttcaccatgttagccaggatgatctcaatctcctgacctcatgatccacccgcctcggcctcccaaagtgctgcattatcttatctgatttttttcttgccttattaagacataattntctgccttctgaaatgagtgagggaagatcataagggaaatccttcccatccatctgtttactacgataggtgacaataattcactgatcaca

SEQ ID NO: 11641 - DNA, 356 bp, Homo sapiens
ggcacgaggcttcctccacctccagggttcaagcgattctcctgcctcagcctcccgagtagctggcattacaggcacctgccaccacacccggctaaattttgtatttttagtaaagaaggggtttcaccatgttggtgaggcttgtctcaaactgacttcaagtgatccacttgcttcggcctcccaaagtgctgggattacaggcgtgagccatcacgcccagccgagggtatcttttataccaacaaattatatgactgaggtgtaatggacaaatcctatgcacaaagtgagggtatctgaatatgtgggccggagccaaaaatttttagctacttttacacttaagtcag

SEQ ID NO: 11642 - DNA, 355 bp, Homo sapiens
ggcacgagattaaattcttgcccttccacagaaccagctggttttaagtctctccccatagtcctcaatatagtcaacctagtttcctgcaaccactcaccagcttgcatgtacttttctaactgctctctcctctgttctacctcagcaggagtcagagagaaaagcttctttggggggaatgcaggaagcacattggccccatactccttccgaagctatttagagaaagagatacaacccttcacataaacacagaaaatgagatgaggcaatctacatatgctcataatgttctcttgggtgcccctccctaccctcagtcccttgttccctgtctaccctggacatctga

SEQ ID NO: 11643 - DNA, 606 bp, Homo sapiens
  misc_feature 529, 556: n = A,T,C or G
tacggctgcgagaagacgacagaagggcccacactgaccatatataaactggaatttctgctccatctttatatgcctattaaaaatctcttccaattctctcccattcatccaactgcatagtcctttgttctggaaaccatgggcaaaactgctttactgtactaaagagtaataacaaattctaagtactaactttcactccccatctttgtatgtcctcgggtgtcttttgatgatttgtcctctgctttcatatgctctagccttccttcaccgggtctttgtcaccctatgttgggcgccaagaatgttggggtgatcaaacccaacacttggtcatgggggtgatgaagtcccgcagagtcaaaggaatgagaaaaagacagtttgagagagaaagtggacccgagacatcacgagtatggagctgcaaagccccagctctggagcccacctagttgtgctgtcaacaaagaacagtgggagatgtggggtgaaagaatgtgttcagtgatgagacatatgnccctgctcactgctcacactcagtttntccacacattccctatgacagaataaaaggatgctgtctcccatctcgta

SEQ ID NO: 11644 - DNA, 400 bp, Homo sapiens
  misc_feature 307, 362: n = A,T,C or G
gaattcggcacgagctgggccgtttctcttttttttccggaccccgcagtggcgcctaaagtctgcaaggaggaggtcgcctctgtgctgtgagtccaggaatctaaggcgagtgctgagggagaaaatgtagttgatggggcagagcagaaggggctgtaggtgggttggagggggaggggaacgggcagccaggcctggaccctggggagtgactcacccggagccgaagaccatctcagctttccctagcccagaaagggtgggactggctttatttctgcctgccatcacctcaaaatgccgngggacaaatcttacatattattattggtatttatttatggattttattttttttnggacagtctttgtctgtcacccgactggagtgcagtgg

SEQ ID NO: 11645 - DNA, 375 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtcacccaccacattaacaacataaaaccctcattcacacgagaaaacaccctcatgttcatacacctatcccccattctcctcctatccctcaaccccgacatcattaccgggtttttctcataaaaaaaaa

SEQ ID NO: 11646 - DNA, 374 bp, Homo sapiens
tacggctgcgagaagacgacagaagggcaagaacctgggtgccgagagggcaagggcttggatgctgctgtggggcctgcgcagagtctgctctcatcagagaggagcgaccagctgtttccagcatttgttccctccagttccagcactcacctgctcacacgctccctctcgcgaggagtggccagcagcgggctgagtgaaatgcgccactccagttcccacctacaaagcatgtcaaggtcaagggaacaatcccgtctcaatttgttgcagtagatattgctcttggttttgagtatcggtatgaaggaatggacttaaacagaggaatgtgttttcttccgttgctatttgtgttcttattgatgctc

SEQ ID NO: 11647 - DNA, 360 bp, Homo sapiens
tacggctgcgagaagacgacagaagggtacggctgcgagaagacgacagaagggtacggctgcgagaagacgacagaaggggaaaagaagataatttaacattagatattgctaaaccgaaaagacagctttttgaggcatctcaggctcatctcagcctgttgcctggagctgatattcttactggagccgctgatggcctttctaacactaatcctttaaagtggattaaaaccataggtggatcaacaattgcaaattttattttggtttgtgtctgtttatgctgtttatttttagtctacagatgccgacggcgccttggtagagaagccagacacagcgaacgaaatagcaatg

SEQ ID NO: 11648 - DNA, 404 bp, Homo sapiens
  misc_feature 353: n = A,T,C or G
ggcacgaggtttccgcggcgccgccacagccagtgtgaatagagaccccggaggcgcgtcctagccctcatctggggaagcgcacctgcatacagacgggtgcaccggggaggaggcgatctgccgcgtgttcctgcaagcagaaaaggagttaactagtgtcacatttgaagacgagcactgaggatgaggaaccaactgaagaatatgaaaatgttggaaatgcagcatctaagtggccaaaagtggaggatcctatccctgaatctaagtttcagatgaactcccataatgaatgatgaatttgtgatgagggataacctggaagtggtattcacacattatgctacaantaaaggttctaccgtggagaggattttgacacattcagtaactaatggaac

SEQ ID NO: 11649 - DNA, 426 bp, Homo sapiens
  misc_feature 163, 319, 389: n = A,T,C or G
ggcacgagccagctcatggcagtgttcggatccctgtccctctacgcccttggcctcctgctgccgtggcgctggctggctgtggccggggaggcgcctgtgctcatcatgatcctgctgctcagcttcatgcccaactcgcacggcttcctgctctctcggngcagggacgaagaggccctgcgggcgctggcctggctgcgtgggacggacgtcgatgtccactgggagttcgagcagatccaggacaacgtccggagacagagcagccgagtatcgtgggctgaggcacgggccccccacgtgtgccggcccatcnaccggggccttgctgatgcgcctcctgagcagctgacgggcatcacgcccattcctgtctacctgcagtncatcttcgacagaaccgctgtctgctgcccccaggac

SEQ ID NO: 11650 - DNA, 366 bp, Homo sapiens
  misc_feature 230, 329: n = A,T,C or G
tacggctgcgagaagacgacagaagggcaagaacctgggtgccgagagggcaagggcttggatgctgctgtggggcctgcgcagagtctgctctcatcagagaggagcgaccagctgtttccagcatttgttccctccagttccagcactcacctgctcacacgctccctctcgcgaggagtggccagcagcgggctgagtgaaatgcgccactccagttcccacctacnaagcatgtcaagggcaaggaacaatcccgtctcaaattgtgcaagagatattgctcttggttttgagaatcgtatgaaggatggacctaacagagaatngggtttcttcgtgctaattggggccttaatgagctca

SEQ ID NO: 11651 - DNA, 379 bp, Homo sapiens
  misc_feature 71: n = A,T,C or G
tacggctgcgagaagacgacagaagggcagagagtgtaattccatctggtgaaggtcctgggtctacttgnatccgccttcttaccatgttcttgtttcttagggagaaaatcctccacctccgggtttcataatgcatggaaatgttaatccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcatttgcaaatcaataagtaagaaccattgtgcctaggattccttgagtcctgctaccaagagacatgttttt

SEQ ID NO: 11652 - DNA, 360 bp, Homo sapiens
tacggctgcgagaagacgacagaagggcagagattgtaattccatctggtgaagttcctggttctacttgtatccgccttcttaccatgttcttgtttcttagggagaaaatcctccacctccgggtttcataatgcatggaaatgttaatccaaatgctgctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgg

SEQ ID NO: 11653 - DNA, 382 bp, Homo sapiens
ggcacgagccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccccacgtgtgccggcccatcaccgtggccttgctgatgcgcctcctgcagcagctgacgggcatcacgcccatcctggtctacc

SEQ ID NO: 11654 - DNA, 367 bp, Homo sapiens
  misc_feature 311: n = A,T,C or G
tcggcacgagcaaacaagaaaacgagtcaggctacgagaggagaccactggaaatggagcagcagcaggcctatcgtccagaaatgaagacagagatgaagcttctcaactcaagccagacaggcagcaattccagagtcgaaagaggccttatgaagaaaaccggggacgggggtactttgagcaccgagaggataggaggggccgctctcctcagcctcctctgcccccgccagatcccgtggtgctggggatggggtcatcccagggctggctccctccaggccactggctcccctctgaagggcttncttcccctccataggggcaggcagttttttctggaatccaaacagcaacaatgacc

SEQ ID NO: 11655 - DNA, 388 bp, Homo sapiens
ggcacgaggggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaaca

SEQ ID NO: 11656 - DNA, 163 bp, Homo sapiens
agcagacgagtgctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgacta

SEQ ID NO: 11657 - DNA, 403 bp, Homo sapiens
gattcgaattcggcacgaggtgacggcggcgtgcagccccacggccgggctgtagcgcgtgagctccaggaacacagcgcggctcctgcgcagagggtgcggggtctggctggactaaaggcaaaactaaagcccagaagacagaccagtgcaccggatgcccgtaccgcgtgatggccaggaaggcccggctgtgcagctcctgcttgatggcgctttgcagacggagccagtgaccaccgaggctgtgccactgcatcgggccaccatgctgatatgcccggtcccagagctgctagagaagaggtacagaggcagcgaagacacgttgagggggaggacgagaccaactgcgagacgccgagtcccgggctctcaggacgctctcccgtacctgcgccct

SEQ ID NO: 11658 - DNA, 408 bp, Homo sapiens
ggcacgagatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaacca

SEQ ID NO: 11659 - DNA, 450 bp, Homo sapiens
  misc_feature 361, 400, 416: n = A,T,C or G
tacggctgcgagaagacgacagaaggggaagaaggaaaaagtgagaaaatcaaagaatttcagtttctacaggtaaggagctttgaagttgccactctatcctaacagtacacaaaaatctgaacaaactgaaaaatcaacaactcttcttacatctataagagaagtgagatcacaggacaaacagtgtctcccaaaattggagtgacagacaaatacagagaatcacaacatatcagagcagaaacctccatggaaaccagtgctgggataggaaaacctgacccgtaattgacaaatttctggaggctctgtgtggacaagtgtaagagttaaaaactccaggaggacctagttttanatggaccctcacacttgagaattgtacctggaggagctngactaggttctcacangtaaatatggagaaaaactcccttgtgttccagc

SEQ ID NO: 11660 - DNA, 473 bp, Homo sapiens
  misc_feature 461: n = A,T,C or G
tttggccgaagcggcctacggctgcgagaagacgacagaagggacctatcagattaacagcagatttctcaccagaaacccagcaagctaaaagggattagggtcccatctttagccttcttaaaacaattaccagccaagaattttgtatccagcgaaactaagagcttcataactgaaggaaagatacaatctttttcagacaaacaaatgctgagagaatttgccattaccaagccagcactacaagaactgctaaaaggagctctaaatcttgaaaaaatcctcaaaatacaccgaaatagaacctccttaaagcataatctcacaggacctataaaacaataacacaatgaagaaaacaaaaaaggtattcaggcaacaactagcacaatgaatagaatagtacttcacatctcagtactaacattgaatgtaaatggcctaaatgctccacttanaaaatacagaat

SEQ ID NO: 11661 - DNA, 386 bp, Homo sapiens
cgaattcggcacgaggttctgagcaactggaggctgctggggctgtggtggcggctggtggtgctgtgtgtgatgcatctgctgcagctgctggggcagagcctgggagggcggaggctgtggctgctgcatcggaggctgctgaattggtggctgggcctgcaaagcctgctgctgctgctgctgctgctgctgctgctgctgttgctgttgttggagctgcagctgtgctattcgctgcagctgctagtgctgctgctgtatctggtgctgattttgatgatgcaatttaattaaatgctgctgctgctgctgctgctagctgagctagtgctgctgctgcactactgctaggaactgctgctgcatgcactctgctgagcatg

SEQ ID NO: 11662 - DNA, 357 bp, Homo sapiens
ggcacgaggcccggacacggacaggattgacagattgatagctctttctcgattccgtgggtggtggtgcatggccgttcttagttggtggagcgatttgtctggttaattccgataacgaacgagactccggcgtgagcctgaaaagctgctgggagaaccagctccgaaacagagtgcccggaagagattgtgacacctatggaaatttaatgaattgataaagggatcgattcgattcaatgtgagaatgttagtttatttaataaatagtgctggtatagttgtcgatctagaagaaactcaatcctctggttttcggtatacacaaaattggttctggatttattataggtt

SEQ ID NO: 11663 - DNA, 380 bp, Homo sapiens
ggcacgaggtgacgcgcagtcgctcccccaggcagcctaagcggcggcagctgctgcggcgactgcaaaggccgatttggagtgctggagcgaagaagagcaaaagctgcgttctgcgcgcgcccgactccgctgcccgccccgccaggcctccgggaggtgggggctgttatgctcataccaagaaagtccattgcccacaggcagcccctgagagttcatgctgggatcgtgcatgaccagcacggccagggtggagatgtacattgccaccatagctcgtcccggtcaagaaaagttggcctgtcttgttcttcggaaagaggcggaataaatcttgaaaggcctgaaaattgctctgtgcgagctcattgtgattt

SEQ ID NO: 11664 - DNA, 389 bp, Homo sapiens
  misc_feature 304, 331, 366, 372: n = A,T,C or G
ggcacgaggctggccttggcagatgttttctcagaggattcatcctcctctctctgtcagctggacatcaggtacatgaggggaggggcaagacaagggatggggctacagagatatagaccaggaattcactgcttcctggatatctaatccatctcaccctaccagttccaactgcatcaagccagatgggcttctggagttcgccaagcggctggagccgctgggccgtggagcctttggtcacctgcgcctcttccaaaactgggctgaccaggatgcaggcacaagcaaggaagccatncggcggctcgggctaccctgcatgggntaggcgctcattggactcattccaagccctcgcangatatngtaacaacaatgggagg

SEQ ID NO: 11665 - DNA, 228 bp, Homo sapiens
ggcacgagccaaggttaaccatttatgtttgtcaggaatcactgcagttgagggagcagcaacaacagcagcagcaacagcagcagaagcatgaggatggagactcaaatgtttaccatgctatctatctagaagaactaacagctgttgaattgacagaaaaaattgctcagcttttcagcatttccccttgccagatcagccagatttacaagcaggggccaacac

SEQ ID NO: 11666 - DNA, 396 bp, Homo sapiens
ggcacgaggtcgggtgcacctggctggtccccgatcctccggtgccctccccaccggacccgggggcctgggaggtggggggcgaggggctccaggggttagggaggggctctcgattctcagtccgcagaggctgggaggatgagctgtcggagttcccggccagggaagagaagggattgttgccaaactgttcccgggcagcactgaacatgggctcctggatgtccgtgtacatgcggcggagggcattataccctccagggatgctctcaaggttgctcagggcccggtcctggttccgcatcatctcttgcatcatggctggattccgagcaagctccattgtctgcctcatgagttcagggttattgagcatgtggctgatctcagggt

SEQ ID NO: 11667 - DNA, 390 bp, Homo sapiens
  misc_feature 156, 157, 158, 161, 168: n = A,T,C or G
ggcacgaggaggcacgaagccatccacacggtagccaaggccggccgggtcccctcgggtgctatgaagatgccgaccatggtgcccctgagcctcctgagcgtgccccagctgagcggagccggcgggggaggggtaggtgttttaagttttttnnnttnttttttngttttctggttttcattgtgttttttgtttatcttatctatctcctagttttttttatgggttattttttttatgtttggtatttccatggtttttattgttttttgttttcttttaaagtctttgttattattatgcgctttgtgctgtttctaaattgctctttttgcctgctttatgttcatgtatttgatttttgttagattttattgttttttattg

SEQ ID NO: 11668 - DNA, 375 bp, Homo sapiens
  misc_feature 375: n = A,T,C or G
ggcacgaggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagn

SEQ ID NO: 11669 - DNA, 378 bp, Homo sapiens
  misc_feature 297, 303, 378: n = A,T,C or G
cgttgctgtcggccgaagatggcggaggtgcaggtcctggtgcttgatggtcgaggccatctcctgggccgcctggcggccatcgtggctaaacaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttggcggngctggnatactgttcatttctcacactttcccctcttcctagtgaagtacctgggtgttcttcgcaaacggattaacaccn

SEQ ID NO: 11670 - DNA, 431 bp, Homo sapiens
  misc_feature 306, 352, 359: n = A,T,C or G
gattcgaattcggcacgaggcaggttacatgcaaatattctgctatgtatgataaatcatacttagattacttataatatctaatacaatgaaaatgctatgtaaatagttgttatactgtattgtttagggaataatgacaataaaggtctgtacatgttcattacaggtgcaaaaccatccattttttttccctcatatttttgatctgcagttggttgaatcctcaatgaagaaccgatggatataggggccaactgtattcggttactctgaggtatagaaaagggcaaataaatgatcagntatttttctttacccagttttaatgacttggtttcatacccaattnccatggngactaaatttggttttagtaccattatgaattcatgggaagaaataatggtgatggtgtcagttgaagctgt

SEQ ID NO: 11671 - DNA, 389 bp, Homo sapiens
ggcacgagggaagaggaggtgcagcccagactcttcctagcctttctaaaccaaagttctttgccattcctacaagcccagccttgctgctggttttttcctttcctttgggtatttgcactattttgggagcatgttttctatgtgggatccactttttttgtacaggtgtaagttgggggttcttaggcttgcctgttaatgcccttgttgattctcttttcttcctcttttcttatcatgtcatgccaaccattgatttcattggaggattacaattctcccccttgagtgcataggatcgttctggaataacacttccttctaaattatttttgtattttggctaatgatcaactttgttagtatgaccagattttccgtgtgtg

SEQ ID NO: 11672 - DNA, 370 bp, Homo sapiens
tacggctgctagaagacgacagaaggggacacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctatggcatcacatctccgggaatctttgctagcagtcaaccggggcaaggaaatatataaatgataaatccaagtgtgggaacagcagtaatgaactttaaagaagaagcaaagcactagggtgatccagag

SEQ ID NO: 11673 - DNA, 406 bp, Homo sapiens
ggcacgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtg

SEQ ID NO: 11674 - DNA, 352 bp, Homo sapiens
ggcacgagggacgccgtgccgttactcgtagtcaggcggcggcgcaggcggcggcggcggcatagcgcacagcgcgccttagcagcagcagcagcagcagcagcatcggaggtacccccgccgtcgcagcccccgcgctggtgcagccaccctcgctccctctggtcttcctccctttgctcgcaccatgggtgagaaactggacgaaaaacaaaatggcggaatccaggagacccttctccttattgagaaagagagggaagggcaccatcacaacaaaggacctggaaacggacatgaggtcactgggtcaaaacccaacagaagctgaatggcaggatatgatcaatga

SEQ ID NO: 11675 - DNA, 352 bp, Homo sapiens
gcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatga

SEQ ID NO: 11676 - DNA, 370 bp, Homo sapiens
ggcacgaggggtttggcggtttgaaggcatgggttggggcggacgctgggctgacctgtagcctggagccccggggccgagggagctggcctgccaccgtggcggaggaaagctagtgccagccctaccagatacctccctcggacctctaacgggctctcagccagcgccccagggtacttcgagaggcagcagggccctggggacaagggcttaactggcatgggctgagccccttgtgctggccatcatgccgaagcatccagaccctgcgagtgcttagcggagatctgggccagcttcccactggcattcgagaatttgtagagcacagggcccgcctggtgcaaccagagggcgatcccatttg

SEQ ID NO: 11677 - DNA, 397 bp, Homo sapiens
  misc_feature 159, 160, 161, 165, 172, 179: n = A,T,C or G
ggcacgagctcgttctttacacagagttcactgacttgaagtatactcagttaaaatcggggctggaggtgcagacggtgtctgaccggaggatgtggccgtgcccgccgagcactcttgatctgagctgacctgtgtgtgtggggggggggggggggnnncccnccacctnacttaanacaccttctttttctttcttgggtcagcccctgctgttggccgcgatttacctaaacatcaagtgggggcggggcccccccaaggggcatttgtctgtttaagaacgaatatctttgaggggggggacagaatcttttatttacaacctccctctttttttttagaatgaaaaggaggaaagagccgggtgggacacccaacaagtttgctccccctt

SEQ ID NO: 11678 - DNA, 395 bp, Homo sapiens
attcgaattcggcacgaggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgccagcttgcagccgggacccaggctacacccctacgtcaagtgcaggacagcggcgcaccgcag

SEQ ID NO: 11679 - DNA, 626 bp, Homo sapiens
  misc_feature 422, 506, 510, 547: n = A,T,C or G
tacgtttgcgagaagacgacagaaggggcttatgacagtcagtgcccatatgcaccattgtgggacttgaggaaaggcttgccagcttaattcctctgtttccagtgcccaagcacactatccaggttcctggttattgcagtgccccatctgccaccattggcacctgagcactcctcccagggcctaaggataggcccacctagcctgctgcttccaccacagctggcacccactcacacgcaccaaccatgggcctcgggactggcccatccagtttatcacggcaactaccaatatcggtgtggacagcatgaaagccagagggttatgcaactactgttactgccattgcccatgccacacctgcaaccaaggggaccaaggacctagccacccagccagcccactgctgccactgntgccactcaagcaagctgcttagtgactcaataacctgtccacctgtagccactaaaaatggtgctggtgtatgctgccctggngcanaaggacaggcacactcagccagccactgtcacctcangggctcagggactgcgcaccttacgttctgtcccagcaaactttatcatagctcactaacaatgactctagccactgag

SEQ ID NO: 11680 - DNA, 399 bp, Homo sapiens
ggcacgaggggaccacagcactggtttgtaccgatactctgcacatggaccagaaaaagtgtgtgggaccttaaactcaccttctttacttgtatcaaatgatagactggtatactggtctcccatccctttgcttggggcaggaaatggcttaaataaataacttaaccttactaaaaaaaaaaaaaaaatggctctctgccctataaaactatagggagtcggtttgcggaacccccaacccaaaataaaccttcgttgagcgggcacaacccccacctaatacggaggtaaaaagagcctttttttcgaaaattggggagcctatcccttttttgtaacccttaataggcggcgaagaacacgttatcaccacggttggctctctgtaatggtgag

SEQ ID NO: 11681 - DNA, 373 bp, Homo sapiens
cgttgctgtcgaagagtgctgcagctgccgcatctggatccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcac

SEQ ID NO: 11682 - DNA, 371 bp, Homo sapiens
gattcgaattcggcacgagagaaggcttgtggtaggcctggcctgggaaacgaagatcatgccaagggcctggggccgccttgaccaagacagccactgcgaatgagcgaaagagcaggggcccaggggatacatggacacacagcaaatgccccttgccagccccgctacctggccagggccgcctgcagctcctactccttcttggccagctgcatattgagctctgcgatctgcgcctggaggtcagcgatctgctcgtggaagtcgctggcagtaccctccaactttcgttttagcttcttcagcttctggtggctctttttcttccttttatagccgcactgcaaaaaccaaggtgctctttagga

SEQ ID NO: 11683 - DNA, 373 bp, Homo sapiens
tacggctgcgagaagacgacagaaggggacacaggttggagcagagaaagaggaatcatagaggtgccaaaggaacacagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctatggcatcacatctccgggaatctttgctagcagtcaaccgggtcaaggaaatatataaatgataaatccaagtgtgggaacagcagtaatgaactttaaagaagaagcttaggcactaggggtgatccagatt

SEQ ID NO: 11684 - DNA, 399 bp, Homo sapiens
ggcaccagccggggtcgccgcagcccgggaggagtgtctggtctccggcctgcctgtgctgtccccgcgccctgtccactggactcccgagacccttggaacccaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagct

SEQ ID NO: 11685 - DNA, 352 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtgccgctgctagacgacgacagaagggtgcccctcattatcttacttattagactaccatttactatctcacttctaggaatactactatattgctcacaccgcatattcttcctactgtgcctagaaggaataatactatcgctgctcattatatctactctaataaccctcagcgctcactccctattagccaatagtgcgcctattgccatact

SEQ ID NO: 11686 - DNA, 380 bp, Homo sapiens
  misc_feature 380: n = A,T,C or G
ggcacgaggtaaatcgagataatttatcagaatgaatttctgtcgtctgttgctgtttaggtggctttattttcacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtccn

SEQ ID NO: 11687 - DNA, 229 bp, Homo sapiens
atggaccaatatacactgtggtaaactacatttacccaacacccgcgtttatttatgtgtaatgatccgtagaggtgatggaagcacccacaccaccctggagcactctgattgtgccttcatggtagacaatgaggccatctatgacatctgtcgtagaaacctcgatatcgagcgcccaacctacactaaccttaaccgccttattagccagattgtgtcctccatc

SEQ ID NO: 11688 - DNA, 389 bp, Homo sapiens
ttcgaattcggcacgagaagaaatggcttccctctttgcggtagctattactgtacctccttctgttcctaggcgtgctcctgttccccctgcccctcctttacctggtgactctggcactattattccaccaccacctgctcctggaggtggaggtggaggtaactatggccaagatcaatcctccatgagtagtggaggtggcagcggtggcgggtatggcaatcaaaaccagagtggtggaggtgggagcggtggctatggacagcaggaccgtggaggccgcgcaagggtggcagtgttgccgcggcgcagccgcggtgtggttacaaccgcagcatggtgggttgaacccaaaagcgtgaagtggccccgaagcaaaagtggtt

SEQ ID NO: 11689 - DNA, 389 bp, Homo sapiens
  misc_feature 303, 306, 389: n = A,T,C or G
cgattcgaattcggcacgaggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggnggngctgagtctgattgctgcagcctgggcagaggagcagaataagttgtgcatggcggaccctgcgacaagaatctcacccctan

SEQ ID NO: 11690 - DNA, 224 bp, Homo sapiens
ggcacgagggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaat

SEQ ID NO: 11691 - DNA, 391 bp, Homo sapiens
ggcacgaggagagaactagtctcgagagcagttctctcagagaactagtctcgagagcagtttttttttttttttttttagttcagggcttttattaacccaaacagtaacttgtcttcgggtttgttgaaacagtaagtcaaacaacttttgccacaataatgtttgtcaaagggacttgccttaaaccccccaccccccccctagtttttatggaaaccattagcctactctttcaaccaatagccctggccgtacccctaaccgttaacattactgggggccacctactcttgcccctaattggaagcccccccctaccaatatcaaccattaaccttccctctacccttataattttcacaattctaattctacggactatcctaaa

SEQ ID NO: 11692 - DNA, 389 bp, Homo sapiens
ggcacgagatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttaaccctgggttgctgtagggcatgtgcccccccttcttacctctgagtcctgaggccctgaggaagggt

SEQ ID NO: 11693 - DNA, 226 bp, Homo sapiens
ggcacgagggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatgg

SEQ ID NO: 11694 - DNA, 178 bp, Homo sapiens
cgcagaggaggtatcattctgactctgttgacatcccgaagtaatgctcagcgccaggaaatctctgcagcttttaagactctgtttggcagggatcttctggatgacctgaaatcacaactaactggaaaatccgaaaaattaattgcggctctgatgaaactctctcggctctatg

SEQ ID NO: 11695 - DNA, 375 bp, Homo sapiens
cgttgctgtcgagagaagcagcaccgcatggtgtggcaggagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgcggtggctcacgcctgtaatcccagcactttgggaggtcgaggcgggtggatggcctgaggtcagg

SEQ ID NO: 11696 - DNA, 352 bp, Homo sapiens
ggcacgaggtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagg

SEQ ID NO: 11697 - DNA, 431 bp, Homo sapiens
ggcacgagggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccgatgcacacaccgcaccccaccactgtactctgaaattggcgagtgagtggagagccagctctgcggagt

SEQ ID NO: 11698 - DNA, 372 bp, Homo sapiens
  misc_feature 372: n = A,T,C or G
gattcgaattcggcacgagctagcacgtcatctaagaattcatactgggcagaaaccttacaaatgtaatgtgtgtggcaaggtcttcaatgacagtggaaacctttcaaatcataagagaattcatactggagagaagccgtttcaatgtaacgaatgcggcaaggttttcagttactactcatgcctagcacgtcatcggaaaattcataccggagagaaaccttacaaatgtaatgattgtggcaaagcctatactcagcgttcaagcctcactaaacatctgataattcatactggagagaaaccttatcattgtattgattttggaggggcatttatccaaagttcaaaacttgcaagatatcacan

SEQ ID NO: 11699 - DNA, 367 bp, Homo sapiens
cggcacgaggctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattctcacacagctctaggggcctgctcctctaactcacagtgggttttgtgaggctctgtggcccagaggcagacctgcatatctgagcaaaaatagcaaagcctctctcagccactggcctgatctacactggaagccactttgctgcacccccgctcccaaccctcttgcctggtagaagagcttaagataccctaattactcatt

SEQ ID NO: 11700 - DNA, 400 bp, Homo sapiens
  misc_feature 396: n = A,T,C or G
atcgattcgaattcggcacgaggaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactggcaacatgacgtactcttctccttccgcccaggctgggcctgtgccgaggcgggtgtgaccctcaatctccccatttgtgggcggcatctctgattgcatggggcaaacacccgccagaaatactatgaaccccctgaagaccctgggtaagagggcactanaact

SEQ ID NO: 11701 - DNA, 246 bp, Homo sapiens
  misc_feature 46, 47: n = A,T,C or G
gacacccatcgattcgaattccgcacgatgatataccgagagcatnnccagcaaggggacagaacttcagtggcgggtggagccccaaacccaagatttccaacccgacaacaacctctttggctttcacctggccttcagctctgccccagcccaggggtaggtgaggcccatcctttttctgcctatgggcctggctctgggcctcctctccccatggctcagcgagcactgagctggccctag

SEQ ID NO: 11702 - DNA, 381 bp, Homo sapiens
  misc_feature 151, 152, 153, 154, 155, 156, 157: n = A,T,C or G
ggcacgaggcggggcgcagccttgcgaagccctaacgcagcgctggggaggggggcggcctaaaggggggcggtggtcgagcctttcaagcggagatggaatggggcccgggctcagactggtcacggggggaggtgtggagtttttatgnnnnnnnacaaatacatgtgtatattccttttaaagaagttttattcaacgtggtctgattttgaggtttatcaatagctatctatatatggtaggtgcctctacagtttttatttaatatggggattgcatagtgaccagcacactggacttcgaggtggttcaaacaaaacagaggggagcagttgctattatcctttcgccaggagctattttcgttctgcgcatatt

SEQ ID NO: 11703 - DNA, 393 bp, Homo sapiens
ggcacgagccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaa

SEQ ID NO: 11704 - DNA, 385 bp, Homo sapiens
ggcacgagggtggacccaggcaaggtgtccaggcatgtcagacagccacgttgtgccctggcccttgggggcaggtggggcacaggccttaccccaaccccagggccagcctctacgtgcgtgcttcccgtctctgattcgcaggcgaccgggtcatcaacaccaactgctcggcggtgcgcactcgtcaggccctctgctgcaagatgtccgtggagtatgacaaggtcattgagtccgggcgcaagtggttttgccacgtggatgatgacaattatgtgaacgcaaggagcctcctgcacctgctctgcagcttctcacccagccaggacgtctacctggggcggaccagcctggaccaccccattgaggccaccgagagggt

SEQ ID NO: 11705 - DNA, 374 bp, Homo sapiens
  misc_feature 374: n = A,T,C or G
ggcacgaggcaggttacatgcaaatattctgctatgtatgataaatcatacttagattacttataatatctaatacaatgaaaatgctatgtaaatagttgttatactgtattgtttagggaataatgacaataaaggtctgtacatgttcattacaggtgcaaaaccatccattttttttccctcatatttttgatctgcagttggttgaatcctcaatgaggaaccgatggatataggggccaactgtattcggttactctgaggtatagaaaaggcaaaataaatgatcagttatttttctttaccagtttttaatgacttggtttcataccaatttccaatggtgactaattttgtttttagtaccattn

SEQ ID NO: 11706 - DNA, 226 bp, Homo sapiens
ggcacgaggttaattaggcaccggagtgcaccttcgggggatgtgtgggaggtttacactcccacctgacacaccatgcgctaattcaaggaatttcttaacttcttgcttctttctataaagagaaacagttggtaacttttgtgaattaggctgtaactactttataactaacatgtcctgcctattatctgtcagctgccaagtactctggtgaagaaccact

SEQ ID NO: 11707 - DNA, 389 bp, Homo sapiens
ttcgaattcggcacgagcctccggtagcctctcccacctaacctctgcatcccccagcctcatgtcctgccccatccctatcctgcctgatccctggatctccctcagatcccctcttctcagacagcgccaggccggggtggggccgggtgggggccgagccccacagctgcccccctcccctccctttttgtataatttaataaagaaatggtcgcgcttcaaaaaaaaaaaaaaaaaacgggttttggccccttaaaaactatgggggggggtttaccgaaaacccaaactggaaaaaaaccttgggggggttgggccaacccccacctaaagggcggggaaaaaagggcttttttgggaaaattggggagcctttggtttatttg

SEQ ID NO: 11708 - DNA, 391 bp, Homo sapiens
  misc_feature 391: n = A,T,C or G
atcgattcgaattcggcacgaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactagtgaaaatttacctaaaaccttggttatcaaatacatctccagtacattccgttctttttttttttgaaacagtttcgttttgtcgcccaggctggagtgcaggggcgcaatctgggttaattgcaacctccacttccggggttaacgcctttttcttgcttaagcctcccgagtagttggaattacgggcgcccgccaccacgcccggctaan

SEQ ID NO: 11709 - DNA, 406 bp, Homo sapiens
ggcacgagaacagactactcaaacctcattaatggtggacgcccctccccccaccaagctccagcatcccaggtcgacctcagactgctatgctggcggtgaaaatttcaagccagtggatcttatcttgctagactccataggggtgggatccgctgagcaagaccatttggctccctggcatcagccccctttccaggagagtgaagggttctgtctcgctggcattccaggcagtacgaaaaaaaattcctgcagctagctcgatgtctggccaaacggccacctagttttgtggatgaaacccgggcccctggtggtgtaggcacctgagggaatctcctggactgtgggttgcgaagaccgtgcaaaaagcgtagtttctgggctgagtagcacagtacct

SEQ ID NO: 11710 - DNA, 369 bp, Homo sapiens
tacggctgcgagaagacgacagaaggggggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaat

SEQ ID NO: 11711 - DNA, 393 bp, Homo sapiens
ggcacgagtagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatg

SEQ ID NO: 11712 - DNA, 407 bp, Homo sapiens
cctgtgtgtgcttaaaggaggttacaaattctgtgctgatctcttagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcg

SEQ ID NO: 11713 - DNA, 484 bp, Homo sapiens
atataagacaagctccttgttctttatgcaggatccgatcgagtcgaattcggcacgaggttggacccaggcaaggtgttcaggtttgtcagacagccacgttgtgccctggcccttgtgggcaggtggggcacagggcttagcccaaccccagagccagcctctacgtgcgtgcttcccgtctctgattcgcaggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgcaaggagcctcctgcacctgctctccagcttctcacccagccaggacgtctacctggggcggcccagcctggaccaccccattgaggccaccgagagggtccagggtggcagaactgtgagtgtcggagcagacgccattcgagcaag

SEQ ID NO: 11714 - DNA, 402 bp, Homo sapiens
  misc_feature 402: n = A,T,C or G
ggcacgagcttcccccattgatgttttaatcttgacaacggatggatgttatgctatggttggccaggttcatggcggcttgatgggaattattcagagagctatggtcaaggcttgtcctcatgtctggtttgaacgctcagaaatgaaggatcgacacctggttactaagagactaaaagaacatattgctgataagaagaaactacccatactaatttttcctgaaggaacttgcatcaacaatacttcagtcatgatgtttaaaaaggggagctttgaaattggaggaaccatacatccagttgcaattaagtataaccctcagttcggtgatgcattttggaacagtagtaaatacaacatggtgagctacctgcttctaatgatgaccagctgggn

SEQ ID NO: 11715 - DNA, 345 bp, Homo sapiens
tacggctgcgagaagacgacagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaactttgccctcgacctgaaaatgataacatcttttcagatttggggcaaaaggcaacctatcttaccgtggtcaaagatgatttatcaacctaacagcgaaccttggtaaggaatacttattcactctaaacagaacaggccagattggtgggaggatgacccacag

SEQ ID NO: 11716 - DNA, 397 bp, Homo sapiens
ggcacgaggtgatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggaatcttccggccgctgcttcctgccgcctcactcagccaggtggagagcaccaatctgaaccagcaatgcctgcagcccagcccctcctctgaacactcagctattactgcgctttccctcct

SEQ ID NO: 11717 - DNA, 425 bp, Homo sapiens
gagcccattgatgactcttggaatgccgctactgcgggtttccgtcgagatccaatctcagcacgacgacgactgctcactttggcgacgtcttttgcatcagcttctatgacagtgtggcgacgctcctgctgcgaatgatgaccacctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaagacacgttcaaggaggagcagcagaagctgtacagcaagatgatcgtggggaaccacaaggacaggagccgctcctgagcctgcctccaactggcttgggccaaccgggcgggggcg

SEQ ID NO: 11718 - DNA, 351 bp, Homo sapiens
tacggctccgagaagacgacagaagggctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgtcatctcaggacccaaggtggacattgaaggccctgatgttaatattgaaggaccagagggaaagttgaaag

SEQ ID NO: 11719 - DNA, 351 bp, Homo sapiens
tacggctgcgagaagacgacagaagggggctggatgaatctgatgcggaaatggagcccagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgtgattctgtatcttgggaaaagagtccttttatgacacattccatactgtggctgacatgatgtatttctgccagatgctggcagttgtggaaactatcaatgcagcaattggagtcactacgtcaccggtgctgccttctt

SEQ ID NO: 11720 - DNA, 387 bp, Homo sapiens
  misc_feature 387: n = A,T,C or G
ggcacgaggaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatgcagcggctgcacagtcctgatgggaggaagtcaggaacccctacagcccgggcccctacccagaccccaacccagaccatcatcctgn

SEQ ID NO: 11721 - DNA, 431 bp, Homo sapiens
  misc_feature 17, 18, 19, 34: n = A,T,C or G
gacggtattgagcttcnnngagtatcccatcgancccaattcggcacgagctgccccgagtccggaaagatttcttccttgatgacgtgttcccagacaccgctgtgatcggggagcctgtgctcaatgccgaggcctggctgcaaggctctaatgggcagccctggcttctcagcctgcagcctactgacatgagcccagtgagccaagccccccgagaggcttttgctcgtcgggccccatcctcagcgcagtacctggaagaaaagtctgaccaccttttgaccgaggagctgctgaatgccatggtggcaaaactggggaaccgtgaggacccactcccccacgactcctttgaaggcgtggacgaggacgagtgggccaagtacctggcccagatcattgtgatgggcgtgcaggtggtggacatg

SEQ ID NO: 11722 - DNA, 368 bp, Homo sapiens
tacggctgcgagaagacgacagaagggctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgtcatctcaggacccaaggtggacattgaaggccctgatgttaatattgaaggaccagagggaaagttgaaagggcctaagttaaagatg

SEQ ID NO: 11723 - DNA, 363 bp, Homo sapiens
tacggctgcgataagactacagaaggggaaaatttataagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccattcactgggcg

SEQ ID NO: 11724 - DNA, 387 bp, Homo sapiens
cgttgctgtcgctcagatctgatggacttttacatgttcccacgaccgtcttcaccccgcgggagtatggctgtgtggggctggccgaggaggaggcagtggctcgccacgggcaggagcatgttgaggtctatcacgcccattataaaccactggagttcacggtggctggacgagatgcatcccaaggttatgtaaagatggtgtgcctgagggagcccccacagctggggctgggcctgcatttacttggccccaacgcaggcgaagttactcaaggatttgctctggggatcaagtgtggggcttcctatgcgcaggtgatgcggaccgtgggtatccatcccacatgctctgaggaggtagtcaagctgcgcatctccatcg

SEQ ID NO: 11725 - DNA, 376 bp, Homo sapiens
  misc_feature 376: n = A,T,C or G
attcgaattcggcacgagggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaaacaagaccgagatcgcccacagcgtgctctacctggccagccctctggcttcn

SEQ ID NO: 11726 - DNA, 382 bp, Homo sapiens
cggccctcccccaacctcgttgccgccttgcagtttgatctcagactgctgtgctagcaatcagcgagattccgtgggcgtaggaccctctgagccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattggccagttctccaacatcacctacgcaggagcctttgccaggtggaaagacaccttttaaaaa

SEQ ID NO: 11727 - DNA, 358 bp, Homo sapiens
tacggctgcgagaagacgacagaagggggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggtt

SEQ ID NO: 11728 - DNA, 379 bp, Homo sapiens
cgttgctgtcggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgag

SEQ ID NO: 11729 - DNA, 405 bp, Homo sapiens
  misc_feature 395: n = A,T,C or G
ggcacgaggatggacatcgataccagcggcaccttcaatgtgtctcgtgtgctctatgagaagttcttccgggaccacggaggggtgatcgtgaacatcactgccaccctggggaaccgggggcaggcgctccaggtgcatgcaggctccgccaaggccgctgtggacgcgatgacgcggcacttggctgtggagtggggtccccaaaacatccgcgtcaacagcctcgcccctggccccatcagtggcacagaggggctccggcgactgggtggccctcaggccagcctgagcaccaaggtcactgccagcccgctgcagaggctggggaacaagaccgagatcgcccacagcgtgctctacctggccagccctctggcttcctacgtgacggnggccgtgctg

SEQ ID NO: 11730 - DNA, 380 bp, Homo sapiens
  misc_feature 348: n = A,T,C or G
catcgattcgaattcggcacgagcggcgctgtggctttcagcttggatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccacattgatccctttccaagaggtcgacatcaacggggagcacctctgcagcatgagtttgcagagtcaccccggcggcaggacgggggngcaagctcctctacagcaccttgcagatcttg

SEQ ID NO: 11731 - DNA, 396 bp, Homo sapiens
cggcacgagcacacgccgcacctccgtgggctgcttcggctcctcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggcatggatgtgatcaactcagccaggacccgccagcagatgctgcatgcccagactttcacaggcactctttttgacccaggagatgcagcagcttgtggggatcgcagacagcccctgacac

SEQ ID NO: 11732 - DNA, 400 bp, Homo sapiens
ggcacgagccaagatggaaggaactgtgagccttctggtctttcgccaggaagacgccttccacccaagggaactgaaagcagaagatgaggatattgttcttacacctgatggcaccagggaatttctgacatttgaagtcccacttagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctg

SEQ ID NO: 11733 - DNA, 385 bp, Homo sapiens
  misc_feature 369: n = A,T,C or G
cgttgctgtcggaaagcagctatatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctccanactcaagctgagtagg

SEQ ID NO: 11734 - DNA, 451 bp, Homo sapiens
tcttttggccgaagcggcctacggctgcgagaagacgacagaagggcaccgtttagaaaaaacaatttttgaaaaagagattttttttccctgcaggtagttgagttggaacaacatgttctaccgtggatttgtacttgctccttttgctctttttgtgtgagtgtgtgagagtgtgcgtgtgtgtgtgcgtgagatttttgcttgcaggataacatagctactttggcattgctgcatatttgacctttgagagatataatagtagattcgcacaggggctggtttattatgttcttagcaacacgcgcttttctagtgccttgaagatacatttgtatttatgtgggtgaaagacaaaagatacaaacctttttacaatatagagaaggatttatctttattgataatgtttcttttaaaaaactggatctctcatcttttaggcgcg

SEQ ID NO: 11735 - DNA, 349 bp, Homo sapiens
  misc_feature 3, 349: n = A,T,C or G
tancgctgcgagaagacgacagaagggtgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctcn

SEQ ID NO: 11736 - DNA, 378 bp, Homo sapiens
attcggcgcgaggcagcgtttatgcagatacccatttgtttggaggttttttttaaatggattgtggatcttattgaggaacgagccatctattttgatggagactttggtcagattgctcgatatggtgagattccagctgaattaagggcggcggccactgaccaccggcaggagctaattgaatgtgttgccaattcagatgaacagcttggggagatgtttctggaagaaaaaaatcccctcgatttctgatttaaagctagcaattcgaagagctactctgaaaagatcatttactcctgtatttttgggaagcgccttgaagaacaaaggagttcagcctcttttagatgctgttttagaataccttccaag

SEQ ID NO: 11737 - DNA, 408 bp, Homo sapiens
atcgattcgctcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaattt

SEQ ID NO: 11738 - DNA, 386 bp, Homo sapiens
tacggctgcgagaagacgacagaaggggaaaatttagaagaccttgaaataatcattcaactgaagaaaaggaaaaaatacaggaaaactaaagttccagttgtaaaggaaccagaacctgaaatcattacggaacctgtggatgtgcctacgtttctgaaggctgctctggagaataaactgccagtagtagaaaaattcttgtcagacaagaacaatccagatgtttgtgatgagtataaacggacagctcttcatagagcatgcttggaaggacatttggcaattgtggagaagttaatggaagctggagcccagatcgaattccgtgatatgcttgaatccacagccatccactgggcaagccgtggaggaaaccttgatgt

SEQ ID NO: 11739 - DNA, 402 bp, Homo sapiens
  misc_feature 402: n = A,T,C or G
ggcacgagaggacaaagagaggccggatcaaaccaacccctccgccaactggctgcacgctcgctcttcccggaaaaagcgctgtccctacaccaaataccagacgctggagctagagaaggagtttctcttcaatatgtacctcaccaaggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttan

SEQ ID NO: 11740 - DNA, 398 bp, Homo sapiens
  misc_feature 398: n = A,T,C or G
ggcacgagaggacaaagagaggccggatcaaaccaacccctccgccaactggctgcacgctcgctcttcccggaaaaagcgctgtccctacaccaaataccagacgctggagctagagaaggagtttctcttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtccn

SEQ ID NO: 11741 - DNA, 367 bp, Homo sapiens
cgttgctgtcggtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaacca

SEQ ID NO: 11742 - DNA, 370 bp, Homo sapiens
  misc_feature 21, 25: n = A,T,C or G
tacggctgcgagaagatacanaagnagaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgt

SEQ ID NO: 11743 - DNA, 447 bp, Homo sapiens
  misc_feature 344, 357, 411, 412: n = A,T,C or G
tacggctgcgagaagacgacagaaggggttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcaaacggtgggcgtgggacgcgcgcgcttcaccacctatgaggttcgcatgcggacaaacctacctatctccaagctaaaggagtcctgcgtacggcggcgctacagtgactntgagtggccgaanaatgagctggagagagatagcaagattgtagaccaccactggctgggaaagccnntgagcgggcagctccttttcgaggagatgaaagga

SEQ ID NO: 11744 - DNA, 389 bp, Homo sapiens
  misc_feature 389: n = A,T,C or G
ggcacgaggttcgttgggcggcgctggtttttcgctcgtcgactgcggctcttcctcgggcagcggaagcggcgcggcggtcggagaagtggcctaaaacttcggcgttgggtgaaagaaaatggcccgaaccaagcagactgctcgtacgtctcccggtgggaaagccccccgcaaacagctggccacgaaagccgccaggaaatgcgctccctctaccggcggggtgaagaagcctcatcgctacatgcccgggaccgtggcgctttgagagattcgtcgttatcagaagtcgaccgagctgctcatccggaagctgcccttccagaggttggtgagggagatcgcgcaggatttcaaaaccgacctgaggtttcagagcgcagccn

SEQ ID NO: 11745 - DNA, 361 bp, Homo sapiens
tacggctgcgagaagacgacagaagggtgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaag

SEQ ID NO: 11746 - DNA, 385 bp, Homo sapiens
  misc_feature 385: n = A,T,C or G
tacggctgcgagaagacgacagaagggggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccacttcggaagatggaggaaccctaggggttttctcacctaaaaagaccccacatcttggtaacctcaatgan

SEQ ID NO: 11747 - DNA, 420 bp, Homo sapiens
ggcacgagggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagt

SEQ ID NO: 11748 - DNA, 436 bp, Homo sapiens
  misc_feature 436: n = A,T,C or G
ttcggcacgagggaaagcgtgggaccttttccccgaggctgacaaagtccgcaccatgctggttaggaagatccaggaagagtcactgaggacttctgaagccaagtaccaagagaagcagcggaagcgtgaggctgaggagcggcgccgcttccccctggagcagcgactaaaggagcacatcattggccaggagagcgccatcgccacagtgggtgctgcgatccggaggaaggagaatggctggtacgatgaagaacaccctctggtcttccttcttcttgggatcatctggaataggaaaaacagagctggccaagcagacagccaaatatatgcacaaagatgctaaaaagggcttcatcaggctggacatgtccgagttccaggagcgacacgaggtggccaagtttattgggtctccaccaggctacgn

SEQ ID NO: 11749 - DNA, 401 bp, Homo sapiens
  misc_feature 305, 351: n = A,T,C or G
tacggctgcgagaagacgacagaaggggtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtaaangcttaaataaaatggtgctgatataagcctggctgatgcgctcggncatgatagtcttactatgtagaattggtgacatctggacatctaccttgt

SEQ ID NO: 11750 - DNA, 390 bp, Homo sapiens
  misc_feature 390: n = A,T,C or G
ggcacgagggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcn

SEQ ID NO: 11751 - DNA, 432 bp, Homo sapiens
  misc_feature 379, 380, 432: n = A,T,C or G
cacgagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggattttgagacatttttaaagaaggctctgtgaaactttcgacaagaacatccagtnngtgaacagaagaagaaaaccagaaaagccttaatctacagcactgggaccan

SEQ ID NO: 11752 - DNA, 386 bp, Homo sapiens
tacggctgcgagaagacgacagaaggggagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataa

SEQ ID NO: 11753 - DNA, 380 bp, Homo sapiens
ggcacgagcctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggag

SEQ ID NO: 11754 - DNA, 412 bp, Homo sapiens
ggcacgagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcc

SEQ ID NO: 11755 - DNA, 406 bp, Homo sapiens
  misc_feature 406: n = A,T,C or G
gcacgagaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattggtttttcagagcaaattgcaggtattgtaccaaaaggtactcatacatgggagaagtttgttcacctggaacactagagagcattctggn

SEQ ID NO: 11756 - DNA, 399 bp, Homo sapiens
ggcacgagcacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgg

SEQ ID NO: 11757 - DNA, 399 bp, Homo sapiens
ggcacgagggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatct

SEQ ID NO: 11758 - DNA, 371 bp, Homo sapiens
tacggctgcgagaagacgacagaaggggtcccactgagcatgcagacctgcagggaagaactgcacttcacgatgccgcaatggcagattgtccttctagcatacagctgctttgtgaccatggggcctctgtgaatgccaaagatgtagacgggcggacaccacttgttctggctactcagatgagtaggccaacaatatgtcaactgctgatagatagaggagcggatgttaattccagagacaaacaaaacagaactgccctcatgctaagttgcgaatatggttgcagagatgcagtacaagtcttaattaaaaatggtgctgatataagcttgctggatgcgcttggccatgatagttcttactat

SEQ ID NO: 11759 - DNA, 368 bp, Homo sapiens
cgttgctgtcggtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcggaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaat

SEQ ID NO: 11760 - DNA, 383 bp, Homo sapiens
  misc_feature 383: n = A,T,C or G
tacggctgcgagaagacgacagaaggggcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctagagaaagccgatttgactn

SEQ ID NO: 11761 - DNA, 395 bp, Homo sapiens
  misc_feature 395: n = A,T,C or G
cgatgctgtcgggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaaan

SEQ ID NO: 11762 - DNA, 380 bp, Homo sapiens
cgttgctgtcgctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcat

SEQ ID NO: 11763 - DNA, 372 bp, Homo sapiens
  misc_feature 24, 25, 26: n = A,T,C or G
tacggctgcgagaagacgacagannnggcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaag

SEQ ID NO: 11764 - DNA, 445 bp, Homo sapiens
gtcaattgggcacgagggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacg

SEQ ID NO: 11765 - DNA, 400 bp, Homo sapiens
atcgattcgtcggactctgccaaatattacctgactgacattgaccgcatcgccacaccatcattcgtgcctacccaacaagatgtgcttcgcgtccgagtgcccaccaccggcatcattgagtatccatttgacttggaaaacatcatctttcggatggtggatgttggtggccaacgatcggaaagacggaagtggattcactgctttgagagtgtcacctccattattttcttggttgctctgagtgaatatgaccaggtcctggctgagtgtgacaacgagaatcgcatggaagagagcaaagccttatttaaaaccatcatcacctacccctggtttctgaattcgtctgtgattttattcttgaacaagaaggatcttttggaagagaaaatca

SEQ ID NO: 11766 - DNA, 695 bp, Homo sapiens
  misc_feature 526, 661, 695: n = A,T,C or G
cccatcgattcgaattcggcacgaggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagnggtgtgtattactgcttcgtggtctaagccaagaccttccgggaacattgaggctaacccaacctaatctctttgaaggaccttagggtggttgactctaacttgttttaggggggcccaaaagactgctctcgnggttgggatgctgctgcttctcatttctctctgn

SEQ ID NO: 11767 - DNA, 412 bp, Homo sapiens
  misc_feature 412: n = A,T,C or G
ggcacgaggggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcan

SEQ ID NO: 11768 - DNA, 390 bp, Homo sapiens
cgttgctgtcggcaattctcctgcctcagcctcccgagtagctgggacgacaggcacacgccagtatgcccagctaattttttgtatttttagtagagatggagctttgccaggttgctcagacaattcacctacctcggcctcccaaagtgctggggttataggcatgagccacctcatccagccataagttgttaggtttaaagtcttaaataatgtggagtttaagagtactatattaattagagtttatgaatactacagtaatacaagccttcactcctgtaatgtttttgtgtcttctcaagtgtgacttttgtaagccttcaagacattgaagtttaatttgaaataggtttgatatacttaggcttttcacccaatccctta

SEQ ID NO: 11769 - DNA, 395 bp, Homo sapiens
ggcacgaggagagagagagagagagagagtgagtgagagtgtgagagagagagagagagagagagagagagagagagagagagagagagagagagagagagagagagagagagagagagagagagagagagagagagagagagagagagagagagagagagagagagagagagagagagagatttctctctgtctcccgcgcgctctctctctctctatatataaaccctctctctctcttccagccccccccggggggggcgctcgcccccccccacctctcttttttttttgaatgtctgggttgcccccctgttctctctgtggcgcccccccccctcaggggtgcgcgcgcacacacctctctctttttcttgcgctctctctctgtgttg

SEQ ID NO: 11770 - DNA, 395 bp, Homo sapiens
cgctgctgtcgagagcccttcctccctttccacatggtaagcactgagcccaatttcttctcaccccacagatggtccctcagagcagagatgtctaatgaaaggttcagagtcagatcactaactttccatcttccactttttccagtggtggccatgttcccccggttgccttcacaaaaaccttgtgaataatacaagccatatggactctgatttacagtttagaagatgagcagaggtgggtgtgagttgcccagtcatgttgctagttgttgaagaaactacgattgttctcaggtcttgggctcctggcccatagaccagtggctctgtgttctgatggggtattggggaggatttttacaaatgcacggtcctgagattgttcctgg

SEQ ID NO: 11771 - DNA, 405 bp, Homo sapiens
  misc_feature 17, 405: n = A,T,C or G
cgttgctgtcggggggntattttgtgatgctgctgtctctaaccaccaagtatgtgctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgataccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaan

SEQ ID NO: 11772 - DNA, 406 bp, Homo sapiens
  misc_feature 291: n = A,T,C or G
ggcacgagggagcaaaggctttttggagtttgaggctgcatctgctggagcaaagggaaaccgtgggcttttccggccaaatactcttgagctctgtgaccctgctcctgtcaccccaatttctccaagccagagggagctttctcagagccccttggtggatctgtcctacacctgctgctgacgagagcggacttccagctctaacagaccagtgctgctaccctcatatgcaagtcctggctaggaagagtgagtgctgcctatcttatgaccgccctgcctattggntgactgcattctaggatgagtttctttagagggagctcgaattcctcctggtattatccccctgcccccttagccaggcgtatattcgatgtccccacgttatgtctttacacac

SEQ ID NO: 11773 - DNA, 408 bp, Homo sapiens
cgttgctgtcggattctcataaggagcatgcaacctagatctcttgcacatgcggatcacagcaggattcgagctcctttgagaatctaatgccatggctgatctaacaggaaactgagctcaggcaggaatgcttggcaccgccccccaccgccccccaccttctatgcagcccggtcgtggcctggggactggggacccctgctctagtcagtaataaggtacttatgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaaac

SEQ ID NO: 11774 - DNA, 396 bp, Homo sapiens
ggcacgaggccatattggccaggctggtctcgaactcctgacctcaagtgatccacccacctcggcctcccagagtgctgggattacaggcatgagccaccgcacctggccagatctttgtatgtcttaagtgtttcaaagttataagcatttttctggggggatgtccattttggagggatccattttgatcctttgtactctataatgtgaactttcccctgttccaacacttaaaagagaattattagcacataatctaaaagatggaattttttttttcttgagacagagtctcgctctgtcgccaggctggagtgcagtggcgcgatcttggctcactgcaacctctgcctcctgggtttaagcgattctcctgcctcagcctctggagta

SEQ ID NO: 11775 - DNA, 402 bp, Homo sapiens
ggcacgagacaataatgttctgaatccttcctgttcatgctgctttcttaattcatttctccatgtcatcaagaggttggataacttatttctaagctcaaggttaaaaatcatgtcacctttttttttttttcccccaccccaaccctaaaaaaattggcaatggggaaagaaccaggaccctaaggggggggcgaaaaaaagccaccccaacccttgggcctttcaaaaaaccccgttttccattttttttatccttaacccctcccccaaacttaacaaaaggggggggggcctggatggcaaaaaaaaaccgtgaaaaaaagcctaaggcgcggaaaccggaccattaatggccgggttaaacctaaccggggcccttttaagttggttttaacagcg

SEQ ID NO: 11776 - DNA, 394 bp, Homo sapiens
  misc_feature 394: n = A,T,C or G
tgattttcgaggcaaatgggtaatcctcatcctgtttctaatgtccagggtgctgtcagcctaacttccttctatagtgagatagatatgttcagagccttcaagctggtgtggacactgacccgctgaaccagtcctgcagagttaggaacaccagcaattttttttgagacagtttcgatctgttgccaagcgggagcgcattggcccaatctcgcctcactgcaagctctgcctcccgggttcgagtagtttgcctgcctcagcctcccgagtagctgggactacaggtgcctgccaccatgcctggctaatttttgtatgtttaagaaagacagggtttcaccatgttggccaggatggcctcaaacttctgatctcaagtgatccaccn

SEQ ID NO: 11777 - DNA, 402 bp, Homo sapiens
ggcacgagggaagattaatttatccttgtgcagccctgagatcaggaaggaggacaggccaggagatgtttctactccaggcaccactaaggactctatttcaaaggcagatcctgctccttagtctttttagatctgaatctaatcctgaatccacaaaattatcctatgaattctggtttatcaacgcacatgattcctggcaccattgcatagcttcaaggtaaaagagagccttgtttccattattttgctatggtggcttttgggaagacagagagcattcttttgaaagcgggaaacttaaggaaaagttggccaagtacacaggaaagttctaccacaccttaatatagagaacaaaatagatgcttctcatttggggaaagtagctaagaggac

SEQ ID NO: 11778 - DNA, 159 bp, Homo sapiens
gacacatcaattgtcaataaatcaaggcacactgcactggacattgctgtattttggggttataagcgtatagctaatttactaactactgctaaaggtgggaagaagccttggttcctagcgaatgaaggggaagaatgtgacaattattttagcaag

SEQ ID NO: 11779 - DNA, 403 bp, Homo sapiens
cgttgctgtcgcaaagatctgaaccagctgattaccatcttggtcacttgagaactcaggtctgtccaataaacaccctaatccaaggtggtgttaaatacatatatatatatttttactttacgtttatttattttgaaaaatttcaaacctatagaaaaattgaggcagtaccatagtcttagtccattttccattacttagaatatccaaaagtgagtaatttataaagaaaattaatttatttcttacagctatggaggccaaggtcgaggggacatatctggtcagcgctttgccatgttggtcaggctggtctcgaactcctgacctcaaggcctgccttggcctcccaaagtgctgggattacaggcataagccaccgtgcccagccacctctgag

SEQ ID NO: 11780 - DNA, 402 bp, Homo sapiens
ggcacgagggcctttgcaaccactgatgggaggaacagagagcagcatttcagaaccaggttctccttcgaggaacagagaaaatgaaaccagcagacagaatttgtcagatggaatttcactcttgttgcccaggctggagtgcaatgtcgcgatcttggctcactgcaacctccacctcccgggttcaagcgattctcctgccccagcctcccgagtagctgggattacaagcacctgccaccatgccagagtaatttttgtatttttagtagagatgggttttcgccatgttggccagactggtctcaaacccctgacctcagatgattcatccacctcggcctcccaaagtgctgggattacaggcatgagccaccaggcctggcccattctgtcttc

SEQ ID NO: 11781 - DNA, 440 bp, Homo sapiens
cgttgctgtcggaactttaattaagtgacattaacctgagataaaaatttctattgactagaaatcccagtctatttcagatctccccctccaatctcctatatgtagaagtgtgacttttgcacttgatatttttcccttatggtgggagttcattttcctctcagagtaatgtcatctgttttcttaaaggcccttcttagataccgaaatttacaaaccattaaataaattgagagcctgaaaaagttgtacttgtgacaaagcctctcactgacacctacagaacagcctcctctgctattgagtcacttgaccgggatctgtatctcctcacaaagctactatccaggcctattttagggctctgggacctctgctgagatcactcgttaatatagtcatgtctcatgtgccagcagcagttaaattctatccct

SEQ ID NO: 11782 - DNA, 413 bp, Homo sapiens
  misc_feature 413: n = A,T,C or G
ggcacgaggtggcttcgcctttgacctttatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttggaaacggagtctcgctttgtcacccaggctggagtgcaggggcgcgatctcggttaattgaaacctctgcctccggggttcaaacgattttcctgcctcaccctcccaagaagctgggattataggcccccaccaccatgcctggctgattttttatttttagaaaagatggggtttcaccgggtgggccaggctggtctcgaactcctgacctcgggatcan

SEQ ID NO: 11783 - DNA, 408 bp, Homo sapiens
cactccttggctatctcaatccatttccctggatcctgaatcaataggaacgtgttacaatgtttgctcattcttgcctgcttttaagtattttgaataagctaggcaattaaaaaaaattttttaagagtgcttcataagatgaatggaaggttaagttgctgactaatattcttggatccagaatattagtccttcactttatggtcttgtacatagcttaagctaaccaactcttttttctcatatgagagtaatatataaattttgagttataggaggcatgaatattttcattacattttccgtaagtccttttagaagagtgtcttctatttcagacattgttgacctgaaaatctcttaaaatctgtctgccatcctgtggtagtgatggcctcacacagg

SEQ ID NO: 11784 - DNA, 389 bp, Homo sapiens
  misc_feature 389: n = A,T,C or G
gtttggagggcaaggccggttgattccttgtcgctaggagctcaagaccagcctgggcaatatagcaagatttcatctctacaaaagaaagaaaacattggctgtgcatggtggctcattcctatagttcaggctactgaggagcctgatgtaggaggatcacgtgaccccagtagtttgaggctgcagtgagctatgatcctaacactgttctccagcctgggtgacacaccatgttgacatctcttcgaaaaaggaatctacagacatcagtgtgtgcacaagcatggcttgtgaatttggaagtgtgtatgtgcgtagctgtgctcaagaatgtgttgatgattataccttctcagaatgaaggtaattatttttttctttttttn

SEQ ID NO: 11785 - DNA, 398 bp, Homo sapiens
ggcacgaggtttaaagttttaaaaaaacttccaagattatggataagccggatttctctcatgcttatgattagggagttaggatttaaagatgcaaagcagaaggactgaaaggaatagccagtgaatatgtttcagtgggggaggtgtgaaagcttttctaatataaatcgttgctatggcctgtgactgcttattctttatcaatgagaactcaccaaactagttcttttcttgatctgaggaaccacacagctcacatgagaatatactactgggactagggtgacttcactccctttcacctgaggcctatcttggccttttagcaccttgactatctatgaaaagactgggtctttgttttcccatgtataaaaatgatgtgttggataatt

SEQ ID NO: 11786 - DNA, 410 bp, Homo sapiens
  misc_feature 410: n = A,T,C or G
cgttgctgtcgaaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgttaaaaatgcaaattctcaggctctccn

SEQ ID NO: 11787 - DNA, 387 bp, Homo sapiens
  misc_feature 387: n = A,T,C or G
cgttgctgtcggattctttaatattcttactttcataaatagtgttgtagtgaaggtaattgattcatgaggaatattttccacatgtttttctgcattgggggaacatgttcatatagcacattattaagactgctggccaggcgcggtggctcacgcctgtaatcccagcaccctggaaggccaaagcaagtggatcactttaggtcaggaattcaagaccagcctggccaacatggtgaaaccccacctctactaaaaatacaaaaattatccgggggtggtgactcatgtacctgtaattccagctacttgggaggctgagacatgataatcacttgtacccagggagcggaggttgcagtgagctgagatcctgtcactgtn

SEQ ID NO: 11788 - DNA, 405 bp, Homo sapiens
ggcacgaggagagagagagagagagagagtgagttagagagagagagagagagagagagagagagagagagagagagagagagagagagagagagagagagagagagagagagagagagagagagagagagagagagagacccccctctttctctcgcccccctgtgtttttttttttgtgtcaccccccccccccctctatgtgtggctctatgtgttttttaccccccccccccccccctcttttgtgtctctcacacaaaatgtgtgctcttttctctctctctcacccacatataagatatttatgttccctctcttttctttctctcgcgcgccccccgcgcgctttttctctctctcctctctcgcgcgccacatctctctctctctccccgcgggggc

SEQ ID NO: 11789 - DNA, 403 bp, Homo sapiens
cgttgctgtcgcctactggtactttgtatttaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcataaggcattgtctgtggaaagtaaggcagtaattaagcagcagcttgaaagtgtctccaatg

SEQ ID NO: 11790 - DNA, 401 bp, Homo sapiens
atcggcacgagattttatatgaccataatgtttgtgtgtgttttgcaccttcagccccttgttattggtccgtatattacctgtaagcagatactgtattttattttagcctatttgacagaacacatcactcagaaaaagtgaagtttcagagcaaacagtgaagaaatcagtgtgattgtagacaaaaagtcagtttacagaacggagcagcggggagaggaagggaaaagcttcatagtttggtgcttatcacatcaagagattggtaaatttttgatgaaagacaggctaatggggctctgaaatggaacaactcctttaaacgtgcagccttttgaatttttcctcacaaccaagaagttgacctctgagctgtcaggtgaccactgtgtgcaaag

SEQ ID NO: 11791 - DNA, 385 bp, Homo sapiens
gcacgaggtgacgtggtcatagctcactgcagcctcaacctcctgggctcaagtgaccctcctgcctcagcctcccaaagttctgagatgataggcatgagccattgtgcctagcctattttgatttttttcttaaagtcaaggtcttgctctgttgcccaggctgatcttggacttgcgagccaccatgcctggctgggttttttacaaatagaatctcactgatagcctgcaggagacagatgcagcgcctgcttccgtatcagtccaaggagccctcgtgtttgccacctttacctttgaacctccccctgcctccctgcctgtgtccgcttttgcagctcaatgcggccatgacaaggagagaaaagacactggaaggccc

SEQ ID NO: 11792 - DNA, 404 bp, Homo sapiens
ccggtgctggcggatcttctctaatattttatttgccacaggctttattttgaatatgctgctagattttatttagggggctgtgcattatgaaggcttctttatagaggcccaataagaatgcctttttataaagcctgtgcatttaggtaggttgaagctaggaggattttctttataatgctcttttgcatgtaaagcacaaagtatgtttcagtttaaatgcacttcttccgggtaatttttatggggaagacaagtgagtcacaaacattctgttgaagggaaatctaaccagatgcttgaaagagcacagcccaaataaaacaaggactgactaggtgtaatgaaataacctgtgattaaaaagaagagctgcagctttgacagtgcttatttaaaga

SEQ ID NO: 11793 - DNA, 401 bp, Homo sapiens
ggcacgaggaggtacaaaacttgggatcaaatggaatcttgattcactaaccaatttaagagctgacttctaattttaggaactttgggttatgaacgcttccattttatacctgtgtctagttagtttctgcctatctatccgagaagcttttatcaagggtacaccatgtgccagccactgaagtagatataaatacaaggatgtgtaaggtatggatgatggtatacgaactggcatcttactggatttgtccgctctgttaaagatactgatccgaaaactttttaaagccctagagagggctttaaggcaatgtagcatcatatatagaggcatcaacctgttcatatctttctatttaacagaactgtgctcctgggcacaagggtgtgcacaaa

SEQ ID NO: 11794 - DNA, 397 bp, Homo sapiens
ttattccgttgctgtcggcttcaggtatcaaggttagctttgggaaccagactacagatgagacagctgaaagcaaagaggctgaggcggagcacagaccaaaaaagagtctcaggggagaagaagggaagctagtaagcaacttatagggggcagtgtaagaaatgtcacatgttacatcgctcacacagagaagcagaatttatcaattttcaaagggaaaatgtctctgtctactgacaaggatttaatttttgctttttttttttttgaaaagggggcatattttgtttcccagggcgggagtaatgggataaaatttggtttatttgaagctccccctcccgggttaaaaccattttttgggtttaaacctccaagtagctgggaataacgg

SEQ ID NO: 11795 - DNA, 465 bp, Homo sapiens
  misc_feature 20, 21, 24, 25, 26: n = A,T,C or G
gggaccgaagaatcaccgannttnnnataggatcccagtccgttgttgtcgctggagtgcagcggcactatctcagtttactgcaacctacgccttctgggtgcacgtgaggctcttgccttagcctctttgtagctgggactacaggcacgtgccaccatgcctggctaatttttgtattttttaaatagagacggggtttcactgtgttggccaggctggtctcgaacacctgacctcaggtgatccattcgtcttggcctctcgaagtgctgggattccaggcgtgagccactgcggccagcacatttccacttttagatcctactccataccacaggtttcatttaagaagaaagagctagataaatgtgctcttctggttaccccaccctgacagagtgcatttttacacggctagcaggggttgagactgcagcctggcctgccagccattggaggtgg

SEQ ID NO: 11796 - DNA, 388 bp, Homo sapiens
cgttgctgtcggtgtaagacaatcagatatggtgaggcctgtgttaaactgggcatcttgttgccatatagaagagatcttctcttcttacggatttatttctcttttttcgtgctttgtagcaaacataagacatttttagcacacctctcttttaatagtactattcttgtgtggcaagtactattcttgtgtgacaagagaactactgagccacagagtgacgatcaaaagctaggcgtggaataaaggtgtacaaaccagctttgtgaccttgtgcaatcactgcacctgcctggcctcaactttctcattgataacataagaatagcaatgatgctttctttatagggctgaggtgacgattaagagttaatacagaacttag

SEQ ID NO: 11797 - DNA, 429 bp, Homo sapiens
ggcacgagcgccggccccagtccccatgggctgaaggcaggttgagttcttccccaggtctgcgagcctcgaaggcttctttcagacagcagaccccttacaagcgcaaggctgctttctgacaaagaatcaagtgttcctttcaaccagccaagggactggtgttctcgctgaccctttgacagctccagccggtccctccgttcgaggtccctgacttcctgcaacagactgagatggccttctgagcttttccagggctgacgaccaccttcttgataccttcccctctctcgatctgaatccgtgcccaccagatggggccgtctagttgcaggaaaacaagctcagggctcccactgattctacatgatgggaatccaggctttcggagatgaggactgggaggtctccccaccacacaagcct

SEQ ID NO: 11798 - DNA, 433 bp, Homo sapiens
  misc_feature 433: n = A,T,C or G
cgttgctgtcgggagctgctcccaccttcctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccn

SEQ ID NO: 11799 - DNA, 422 bp, Homo sapiens
cctagcggcgcccgggtggctgcagccgctggcccgaaaatgctgctcgggcgagcaggggtcaggcgggaaaagaggactccaaatccattctctgctcgcccccagggcaatgctgccaggagagggagtgggttcccccgcaggctatcccaccgatggggctgagagcttaactcggggttttatttgaattggagacattgttccctcttcgctcctctaccccataaaattccctacaaatgcaaaaattccagatagaagaagccgtccctgaaagtaagttctgaaggattcctttcatgcggtgaaggaacaacaacaatattcaacttcaccttggtgtgtgagggtcgacgtgctttacaacactatccctgtagaaagattactgaaatgtattggaagaagtagtggag

SEQ ID NO: 11800 - DNA, 418 bp, Homo sapiens
gtgagccgagattgcgccactgcagtccgcagtccggcctgggcgacagagcgagactccgtctcaaaaaaaaaaaaaaccttgccggggggataaaaaacccggggcctttggcccagtttgggaagttttatgggggaagaatgtttaaactaaagccctttagggtggcggggctttttaataatcccgttttttacaacctgggcaaaaaaataaaacccccttttttaaaaaaagaatttggccaaaacaaggggccttaacccttgaatcccaaccttttgggggggtggaccggaaccattggagtaaagaatggggaaacaggccttgacaaaaaagcgaagacccattttttcaaaaaccaaaaaggtaaaaaaaaattgggtacgggggcccagccctggaaacccaa

SEQ ID NO: 11801 - DNA, 417 bp, Homo sapiens
cgttgctgtcggaacatggttttggctatggcttgactcatgggctttcagtgcttttttccatttgttgaaagtaacatttctctctctctctctttctattttttctttttcaaaagcaaacattgggtggggaaggggtcaaagctactttttgcgctattgggttttttggccacccttcccttttccaatggaaggccaggtaaaaaaaaccgcgggaggggcggctcatttttttaattttaaaaaaagggggccccagggtggcaaggcaataaaattggaaatgacccttttgagaactttcgtttttgcttaaaaaacagcgggttgatgagaactcaaaaacctaaaaaagattttagtcaaagggagggctctttttctcaccggacctttaaaaaaaaaatggcg

SEQ ID NO: 11802 - DNA, 393 bp, Homo sapiens
ggcacgaggtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtaaaaacttgccatgtatggccgggcgcggtggctcacgcctgtaatcccagcgctttgggaggccaaggtgggcggatc

SEQ ID NO: 11803 - DNA, 185 bp, Homo sapiens
  misc_feature 180: n = A,T,C or G
cgctctcattgattagtggaacggaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtttgattactcangagtt

SEQ ID NO: 11804 - DNA, 392 bp, Homo sapiens
cgttgctgtcggctgaaggctcatgaagctgaaatgtgggaagttcactttcgcgccatccagcccagaacatctttttacctgctctgaagatggatccctctggcactgggatgcttccacagatgtacctgaaaagtcgtcactctttcaccaaggtaaaactttttaatgaatactgttatgtgtactttttttttttttttttaaaacaaagtctccttttatcccccaggctgaaaggcaggggcccaatttcggttaattgaaacctccgcctccggggttaaagcaattttggggcctcaccctcccaagaagccgggactattatttttgcccccccggcccgggctaatttttttgttttttaaggggaaagggggtcccct

SEQ ID NO: 11805 - DNA, 413 bp, Homo sapiens
  misc_feature 413: n = A,T,C or G
taaggcccacagcacatatagagtgactgcgatattctattttcatggcagggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagan

SEQ ID NO: 11806 - DNA, 387 bp, Homo sapiens
ggcacgagccagccttgaacttctgggatcaagtgatcttcctgccttagccttctgagtagctgggaccacaggctcatgccaccacacctggctctaacctgaaattttcaatatgatcataataaccccagcgtgtgttaacctacagattgctccttaaaactcaattgctttagcagcttttaagatcctccccatcccttactactcaccttttaggctgtatatcattccagccctaagctccagagagcctggttcaaatggacactacagttttttccatgcgtatttaatgctcacagaacaaaccccaatagaccacaaccttcactcagactaacacagcattctacttgcctggcaggttcacagatcataaat

SEQ ID NO: 11807 - DNA, 422 bp, Homo sapiens
tgcacgaggagagagagagagagagagagagagatagagagagagagagagagagagagagagagagagagagagagagagagacagagagagagagagagagagagagagagagagagagagagagagagcgagcgagagagagagagagagagagagagagagagtgagcccccccccccccccgcacccatgtgcgcctgtgtgtttttttgttgtcgggcccctgtcccccccccgatctgttcttttctatccatccacatgcttgtgtgtgtatcctaacccccagagtcttgacttccagagctcacttttccttattgcttgtgtgggcgcacgcctttttttcttccttatgtctagacccacgctctctctccttgtattccctgcgttgggctgaggacaccccgcaccct

SEQ ID NO: 11808 - DNA, 410 bp, Homo sapiens
ggcacgaggtgaccttgccatgcatcatatctcgaggcacgagatatcacagtgtcctgctgaggatagtcatttggatatcttatttaaagtggtgtctgtcaagctttcccaccgtaggttgctctatttcctttgaaatgaacaagtaattgtggggcgattttttcggactatattcatatgttttgactcatcaaattgtcacctcctagattgggcatgcattgatgattcttacccaagtcaagtattattacaatggttgtcagatggcaatcttctaatttcatttgtgcatctgcgcccatcaattggcattctacgaaaatatggagccgtcgtgagcttgcatcaccttgtgcaagagctatggctatgctgagcttctccacatatttacaactatg

SEQ ID NO: 11809 - DNA, 402 bp, Homo sapiens
ggcacgagatatctctacaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcactt

SEQ ID NO: 11810 - DNA, 412 bp, Homo sapiens
ggcacgagccgtgttaggcttcgctggcgtaaagtccccgggagctttgcccctcacggagaacgttagttgaccctgatggggacccgtagggtaaaggttttgtttttgtttttttttacggaaaaggttgtggttaggccccttggaaagttgcgacaaaactcgagttagacaaggaaggtcggaactaagtggccacagcaacaatgcaccagcaagcagggagcgtgataggaagagctaaagaggaatcgggaaaccctggagatgggtttcaccatgtttcccagccttgtctcaaactcctgacctcaagtgatccgccgtcttgggtcttcgaaagtgctgggacagcaggagtgagccaccgcatctggcccggaaagtgttttggagcgtagaaaaatgg

SEQ ID NO: 11811 - DNA, 399 bp, Homo sapiens
  misc_feature 319: n = A,T,C or G
cgttgctgtcggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtggggtgtgcaanctgccctgtccttctgctcataacctgacaaaatgccaaactagcaagcaggatagctgataccacggctatgagggagt

SEQ ID NO: 11812 - DNA, 394 bp, Homo sapiens
  misc_feature 394: n = A,T,C or G
ggcacgagagagagcttacgaggtttgatgtactttgactacttgactcattctttaataatcttcaccttgccttgcgccaaaactgattaaagggaaaagacttatacacatagaagcacataaaataaatgtacgcattaaggagccgcacgatgataagggaaggaaaatattaatattatgaagccgggttccagtcgcattgcttgatgtgagccatatatttagctctcagcctcctggttggcacagcaaaaaggcaaacgtgaatcacatagtgtagacgaagaataaaacacttcttgctcatggggtccatccagaggctcacaatgtttacagatgtgtctgactcataatgtgagtgctggctcctaagatccacaaaggn

SEQ ID NO: 11813 - DNA, 162 bp, Homo sapiens
atgttaaatggccagttaaccactgggagagcatccggacagacgtttcgccaagatgggtggaatggccagttaaccactgggagagcatccggacagacgtttcgccaagatgggttggatggccagttaaccactgggagagcatccggacagacgttt

SEQ ID NO: 11814 - DNA, 396 bp, Homo sapiens
ggcacgagccaatgagctactcctgacactaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaaccc

SEQ ID NO: 11815 - DNA, 409 bp, Homo sapiens
ggcacgagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagctattatcatagatgaaggtatgctataggcatgattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcgagcatccattcctcactccacg

SEQ ID NO: 11816 - DNA, 433 bp, Homo sapiens
  misc_feature 304, 433: n = A,T,C or G
ggcacgaggggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttaaaaaacagggagttgaagcccaccctatttaaaaacccccccatttggagaattacaagggttttgtcctgaattggagggtgggcaagcccaagccactcgggctaactggtttttgtctcggnggctattccaagaacaaaaggaggaagttggcccattaccgggggtgtccctggatgttgtttgggggcgcgtgcctttcaaaaaccccgcccaaaaacaacccgggaagggggagggccccgcttccn

SEQ ID NO: 11817 - DNA, 399 bp, Homo sapiens
  misc_feature 399: n = A,T,C or G
ggcacgaggaaggcctaccgacttactttatcattgagggcttactgatacaatgaaatgagtttcatgactttttttttttttaacccctttttgaaaaaaagggggctgggttaaaacccaaaaatatccttgttgcttttgaaaagaaggcattgaaacaaacttttttgtagccagggttaaaaaaacggacccggttgggcccttcttggtaaggggggacttcagggccccgggaaggccggtttgggggtaacctgagggggacacaggccctggggggggcgggtttttttaactggttacccgggcccataggcagactttttaaaaaaaggtccttgaagggggatgtgcaaagacatgcgggcccgcctaaaagcgcggattaaaaan

SEQ ID NO: 11818 - DNA, 417 bp, Homo sapiens
ctgctcccactgtctttttttgtttttttgttacaacccttaaaaaacgggcttgccattctcaccccaagcttcatggtacacaagccgcagcagccagactgtagcttgccaacacttgctagaccattgctcttcatgttcaaactgccagtcaggagcacaaggaccaggaagtggcctgacttggccaggaccactcagcccattacagttaggaggagcggccagatctcagccccatccacttgggaagtcaggagaggcagtgaacacatcacctgaaagtcagaggtcttgcgaaatcaccaccaaagcatgtatttgtacaggtaatagtgctgagagttcaacagaggacagggagaaggtgacctgtgaagactgtgcagggagggaggacagccactcagggag

SEQ ID NO: 11819 - DNA, 401 bp, Homo sapiens
ggcctcagaagctctgggtgtgccagaggacccccagaactaacaagggagggcgagtgggtctccattccccgagaagccaggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggagccctatccctggcaacccctccacgtagcgtaccccagcacctgccaccggctttgccatttctttgagcttgaagttaactctcttagagtctaactgtggttcatttctgcacaggtacaatagatgactttatttgtttagaa

SEQ ID NO: 11820 - DNA, 407 bp, Homo sapiens
tttcagttcactttatttactatgacacatactttcagagtcctagatgtgctgtcatcgagtcccaggtcacatcgtcacactcatcagccctctgcggccagtgtccccacctcctgccatgtttccctagtagcttggtctttatccagaactgtgaggctgctgtggggtgcagcgtccttaggagggtcctgctggagcagtggccctaagtgagtctggactgtgtgaggcaccccagccctccacggcaaggccggggcctgggggtgctggtgcctgtgtgcagcctgaaggctgccctcttgctgccttcagcgagtgggaagctggtcagaggggtgggcactcctctgggctccgccacctcctggcacaccccatttggtctctgtccactcctg

SEQ ID NO: 11821 - DNA, 407 bp, Homo sapiens
ggcacgagcatttatatatatactatatatttcatatatgtatttcaggaatttatagaccagacattcatatatagatgcggaggtatatatgagcgcgtgtgtatatacacatatatatttatacgtatatacgtatatacatatacacacatatatacgtatatatgtaaacgtatatatacacgtaaataaatatatttatatatacgtatatacgtatacacatatacacatatatacgtatatatgtatatatacgtgtatatgtatgtatatatgtatgtatatatacgtacacacacacacacacacacacacacacacacacacacacacacacacacacacacacacacacacacacacagagagagatacagagagatatacagagagtttagaaa

SEQ ID NO: 11822 - DNA, 389 bp, Homo sapiens
cgttgctgtcgggttttgccaatcactaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgattcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattat

SEQ ID NO: 11823 - DNA, 390 bp, Homo sapiens
ggcacgagcccatctctactaaaaatttatttttagccgggcatggcggtgcatgactgcaagcccagttacacgggaggctgatgcaggagaattgctcgaacccacgatgcggacgttgcagagagtctagatcgccatatatatatattcgtatatatgtatatatacacacatatatattcgtatatgcatatatacacacatatattcatatataggcatatatacatatattcatatgttctcataatatacgaatacacctatatgctcctatatgtatatataacatacatatattgatatatgtataaataatattcataaatgtatatatgcatatatactcatatatgcacacatacatattcgtatatgcgtatgcac

SEQ ID NO: 11824 - DNA, 390 bp, Homo sapiens
ggcacgagagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaactagcccacccctgcactctctctcattgccgctgccactatcacctgtctctctgccagctgatgtgccctgttgccccccaccccatcccgcacagaaccatccctgcattccacaggggactcggg

SEQ ID NO: 11825 - DNA, 396 bp, Homo sapiens
tgcacgagcggcgactcacccggattgatatgccgtgatctggctatatggtggggcgcgggcggtgccgctgcgacgagctggtgctgttctcacatgtttcctttcaatgggcttttggtgtatgatgtaggcgaaccaagaacaggaggaggtgattacagtgcgtgttcactacccccgagtgcataatgagggctcctggaactcttatgtggattataagatattcctccataccaacagcaaagcctttactgccaagacttcctgtgtgcggcgccgctaccgttagttcgtgcggctgataaagcaactacagagaaatgctggattggtgcctgttcctgaacttgctgcgaagacaatcttcttcggcacctcagatgatgtcat

SEQ ID NO: 11826 - DNA, 407 bp, Homo sapiens
  misc_feature 153: n = A,T,C or G
cttccatagcttggccacctatttgtctcagaatacctcatctgtgttcttggataccatctcacatgtccacctcttgctgttcctggtcaccaatgaagttatgcctctgcaggacagcatcagcttgctgctggaggccgtgcggaccanaaatgaggagctcgcccagacatggaagaggtctgagcagtgggccaccatcgagcagctgtgcagcacagttggcgggcagctcccaggtctccatgagtacggggccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggc

SEQ ID NO: 11827 - DNA, 399 bp, Homo sapiens
  misc_feature 399: n = A,T,C or G
caagccagtcaacccgcagaagtgaatatgtactaccagaacacttaccagacaatgccttacgggtcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagn

SEQ ID NO: 11828 - DNA, 407 bp, Homo sapiens
gaagattcacagtggacaatgtttaaggagattttagagggcattcagtaagggtgtcacctgtctaagcttttctaaggatagcagtcaaatccttaatgcttcttttgaccagacaattagaattcatggtttaaaatctggtaaaaccctgaaggaatttcgtggccattcctcctttgataacgaaacaacatttacacaagatggacattacattattagtgcatcctctgatggcactgtaaagatctggaatatgaagaccacagaatgttcaaatacctttaaatccctgggcagcaccgcagggacagatattaccgtcaacagagtgattctacttcctaaaaaccctgagcactttgtggtgtgcaacagatcaaacacggtggtcatcatgaaca

SEQ ID NO: 11829 - DNA, 408 bp, Homo sapiens
ggcacgagacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatg

SEQ ID NO: 11830 - DNA, 392 bp, Homo sapiens
cggccgcgaataaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaa

SEQ ID NO: 11831 - DNA, 401 bp, Homo sapiens
  misc_feature 401: n = A,T,C or G
ggcacgaggtctacagcctgacccagctgcccgctatcgcaatgtgttggaggccctctggaggattataagaacggagggcctatggaggcccatgagggggctgaacgtcacagcaacaggcgcagggcctgcccacgccctttattttgcctgctacgaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgn

SEQ ID NO: 11832 - DNA, 383 bp, Homo sapiens
cgttgctgtcgggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctggtttttttttctaatggagcaaggactaaggaaaacctttggtgaagacaatcatttctctctgttgatggggatacttttcacaccgtttatttaaatgctttctcaataggtccagagccagtgttcttgttcaacctgaaagtaatggctctgggttggg

SEQ ID NO: 11833 - DNA, 384 bp, Homo sapiens
  misc_feature 17: n = A,T,C or G
cgttgctgtcgcctggnttttttttgcctcctccctttcccagcaccatttattttgggttctgagaaacagcttcctcccattacaggcaccaattcaattaggcaggagatagtgctgaaggtttttgtttccatcagcttctgctgtgtaaatagtagctctgtttgaaaaactttgagaagttgttgtgatgtgcctctttctgggttccgatcccttctcagcctggtgatgccatggcattcaaatcaatttgtttctcttcccctcccctaccctacatccatcatacaaaatgggggtggttgcactaatcagagatctgcttttttccccccacagatattggtaaattattaaaaaaccataaattttcttcta

SEQ ID NO: 11834 - DNA, 385 bp, Homo sapiens
  misc_feature 162, 166, 171, 174, 183, 184, 212, 213: n = A,T,C or G
ggcacgaggggaccctgctcgcccagatggctcctggacatttgcccagcgtcctactgagcaggaactgagggcccgtaaagcagcacggccagggggacgtgaacgggctcgcctggcaactgcccaggacaaggcccgctccaacaaagggctcctggncagnatttnttnttttttttnntttttttttttttttttttttttttttnnttttattaatatttttttttatcttctatatctacccctattcccccttttttttaggcaaaaaaagtgttaaacccccctcttttggttctggataaaaaagaaaaatgccccgacatagggttctcctccctaatagaaaaaaaagcccttttggggggcaaaaaaggtg

SEQ ID NO: 11835 - DNA, 383 bp, Homo sapiens
ggcacgaggacctgcgcctgtgccttttataggttcctgcccggcatatgatgcacatctcgacaaacgagatgaagcacggtgcgtgccgataaaatggaacagatgtggactgataagcggctgatcctgtatgtgtggggctccaacgactttctgaggcgaggtcctatggactagcgtcgccccttgcactcttgatggctcacaacgggcttgccttctcttactactaaccattatatgctatttgctgtccctgcctagactttgctccactgagtggttcatttgaggccaaccctcccttgtgcgaggagctcatggatgccatggtctctcactttgagagactgcttgagagctcaccggagcccctgtct

SEQ ID NO: 11836 - DNA, 384 bp, Homo sapiens
ggcacgagaagagccagctgatatcctcggcgaacatgtctctcctgagtccagaggaccaacaccctcaacctggtagcttctttctggcttgtcagagctctcagaaggtacctataggagcccaagccccagctacatcctccacttattctgcctgattcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactt

SEQ ID NO: 11837 - DNA, 385 bp, Homo sapiens
  misc_feature 385: n = A,T,C or G
cgttgctgtcgagcttagcaaatctgggtattggttttgcctgtttttaaaccccctttggagtctagtaaggttaaccactctggttagttcagcgttctaacaggtgactttacattggaggaagatgttcagaaggcgtggaagacacatcttcgagcagccccagcttctgatgattttgttcatctgggttgcagacccaatctgtgtcccagggactgggactggccttcattaccttattgacatgcttctcccggacacacacacacacatcacatttgcagccatctcaatttagtagaggaattacacataaccaaaacactccccaaatgtgtgctggagaacagctcggagggatgggacggcctgtcgtttn

SEQ ID NO: 11838 - DNA, 378 bp, Homo sapiens
ggcacgagcaggcggcagaggttgcagtgagccaggatcgcgccactgcactccagcctcagcaatagagtgagactgtctcaaaaaaaaaaaaaaaaaaaccccgccaatttttaaacaaccccgaaaaaattttttcggggcccttttttttaaaaaacaagggggttttttcttttggtatcccaaaaacccactgggggcaaggtttgggggggggaattttttagggcccatataaaattccttagggttttgggaaagggcaatcccggggcaataacccttttttgtaaagggctaaaccctttttttttttaggcccttttttttttgaaaaaggggttattcttggccccccggttaaaaaccctggga

SEQ ID NO: 11839 - DNA, 379 bp, Homo sapiens
cgctgctgtcggctcttacaggaaagggcaccaggctgcggggtcattgaggacaaagttgacagtttagattagcaggcactcaccatgggccctccccctccctcagcatgaaaccagcaggagaaaatcctcaactcttggcttctccttggggagacaaaagagttggaatgtgtgtccagtgtttcaccttttcagtgggctgagggactggcttctgtcttgcttgtcttggaaagctgacaggggctggtgcattccaggtgcccaggagccactgagaacagaagacttgttgctgctctagaggacctatggtagggcagacagaggatgatacagctcagcagcttgtccctacgtgtggcatgaaagg

SEQ ID NO: 11840 - DNA, 381 bp, Homo sapiens
ggcacgagggggcaatgctaaatattgcggcagttttatgcattgctaccatttatgttcgttataagcaagttcatgctctgagtcctgaagagaacgttatcatcaaattaaacaaggctggccttgtacttggaatactgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgc

SEQ ID NO: 11841 - DNA, 373 bp, Homo sapiens
cgttgctgtcgggtcaaccctttctttatgcgagccaaaggattcttggctccaagcctggtcctggctgttagtttggaactcatgcacccagatgctaactcgccctcagaatgcagaggggatgaaacactgaccggacaattcaatctgtatatggagacggggtttcaccgtattagccaagatggtctcgatctcctgacttcgtgatccgcccgccttggcctcccaaagtgctgggattacaggcgtgagccacctcgcccggcccatgttctagattttttattctggtttagcaggatccaaactgcctgtcctgaagagactctctttctcttccatacaacggctggcctctaccaagtta

SEQ ID NO: 11842 - DNA, 370 bp, Homo sapiens
ggcacgagtacagaagaacaatgcgaggcgagctcaggcgcgctgatggtggtttccgatacaactccccactcaaagaaccccggagagctcttgattccatctctcagtagggtcctgaagtccatgctgtctgaagacacagggtctccccctgcgtctgtgccaggacagagggactgccaccagccaagctgcaatccttttaaacgctaaaaacggccgggcttggtggctcatgcctgtagtcccagcagtttgggtggatgaggcgggtggatcccctgtggtcgggagttcaagatcagcctgaccaacacgaataaaccccttctctactaaaaatacaaaattaggccgggcacagtgg

SEQ ID NO: 11843 - DNA, 374 bp, Homo sapiens
ggcacgaggagagagagaactagtctcgagagcagatctctctctccggcacgaggagagagagagaactagtctcgagagcagtttttttttttttttttttcccagcaccgtgagggcttactggagcacattttgccccacaaaaaggaaatagcccttctaatccccgcctgcaaaacacaaaacggcaaccctccccgggaaaacttttgagaaaccccgccggggcaccaaagacctagggggaagatctgggtcaaaggttaaaaattccgtaagaaagggcctataggagctgtgagaactttttttgcccacgaataaccatttttaacaaacagccctaacccctaggggagagctggacgggg

SEQ ID NO: 11844 - DNA, 370 bp, Homo sapiens
  misc_feature 170, 176: n = A,T,C or G
cgttgctgtcggtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtctnacatgntacttggtagcacatccacctgtatcactaatccccatctggttttgggggatgcgctggcaccatttccccaaaatttacgtgtaagtatcacaaagagggtctctacaatctttagatttcctttcgacaagattgcaggcgattcctctcggagaccttccccccggcattttggaccctatgagagggcg

SEQ ID NO: 11845 - DNA, 150 bp, Homo sapiens
  misc_feature 10: n = A,T,C or G
atgtttaaancatgggtccggagccttttactctcccgaactcctggaggccctaacgctgcgctttgaggctcccgattctcggaatcgctgggaccggcctttattcactttggtgggcctataagagccgttgcccctggcggtgat

SEQ ID NO: 11846 - DNA, 354 bp, Homo sapiens
ttgcttatactctcactggaaccaatgcatggaacaggtggtgcagacctccagctgataatgcattgaagaacaggcatcatatgctaaatgagtgaagctagagatctattcgacaccataaggacctgcatgaaacaaaatagcatcaccacttgcatacgtaacatgatcaacccacaggcctatatgttggaagtgctgtccggggctgttactgtctcttctggttataaagcagacatgtggccatcttttccgcagggttagagtgggctcctttctttttggaatccttttcttctcctttggtagcagctccctgcctccagggcttccgccaccagcgtctct

SEQ ID NO: 11847 - DNA, 336 bp, Homo sapiens
tacgctgctttaagacgacagaagggctgatctttcatctatttgagaaaacgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggatcaccaccacccatactccaaccctgttcccagtcactggtacctatagggtgagagtgaggttgctcatcaacgagctctccaagtcataagctgctgctctcccactcacgatgcttggtgattcagggacgttttccc

SEQ ID NO: 11848 - DNA, 448 bp, Homo sapiens
tttttgcaggatcccacacatatggagtcttaaattagttttgggtgtcattttgatgcctagagtcatagaagagtgattaggagcttgtggggtataaaaataacttgagaattggctgaaagcaactagggaagatgggggtagtagtatgtgtaaacatttgaggcagtagagatgtgggacccaaatactgttccccttttactcaaattctgagatgagttgacatgttctgtgtagggctagagagtagaaaaatggccagtaggtggtagccacagagaagcagtgcgtacaaacaagtaagtatgcaaaatttgtacatacggtttcaggaataactagaatacccataaaatatccacctgccttataaactagaacatcattgataacttggaagcccttgcatacctctccatgatctcatttgtcttcacagctt

SEQ ID NO: 11849 - DNA, 463 bp, Homo sapiens
tgctcgatctgcacgatcccaacgatgcgaaatcggcacgagcagaaacccggttcccagcgtcggcggcccggcttccgctgcccgtgagctaaggacgggccgctccctctagccagctccgaatcctgatccacgcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaaac

SEQ ID NO: 11850 - DNA, 460 bp, Homo sapiens
  misc_feature 25, 26, 460: n = A,T,C or G
tacatttagcccagcgacttgttgnnaagcccatccaatcgattcggcacgaggaaatcaattggagaacggtttttatttaatacagttgcacaggtgttaaaaaaacttgctttatttgacgaatggaattccttggctgtttatgtttcaatggataacacagtggtcattgaagatatcaaaaaaatgtgccgtgtccttcccttgagagctgacacatctggtgacaggcctcccgattctttaactgctttctaccacagtaaaggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagn

SEQ ID NO: 11851 - DNA, 436 bp, Homo sapiens
  misc_feature 348: n = A,T,C or G
cacacttgcttgctcgtttggccgaatcggcctaccggtcgtcagaatacgacagaagggaccacagtccacctaaggggtgcctacagcccacttgagtttttcaaactgagtaatcctaaactgttcatcccaccctgctttgccttttccatgaaaatgacagtaagggctgtggcctggactttaccctcattactgcttctgcttcctgaccaaaaccctatgcatctcttaagtctggcgtggtgtgttgtggcatgccgtcttcttccaggaaatgcaagtaatacacatttttcagtgatattggcctttctatgttgtcacttactaataactccatanattaaatcttgggtgcattttagaacatgctgtacctttgattggtttgctttaggctagtgagttgagttctgtgcttacactgaaa

SEQ ID NO: 11852 - DNA, 440 bp, Homo sapiens
cgttgctgtcgggaatagagtaattttttttcccattccacttggaagctgtgtacctcaagtgtgtgcacatttacaaatgggtgaaacataacttatgttagtccaagcttgatttgacttcagttctgcttcaacgttttagtagatagggcactgaactggatgctgaaagcgtgggatctctttctgttgcttcacttccaacagtgtggtttcaggtaatacgacatgtttgttacttggtttgctgatctatgtgttggaaacaatgctcaccacaggaggattgactacatagcctgctttcatagcttgtgtgtatttatccagtgccctaatagttgatactgccagtgatttactcctgtggagtaaaggtaagcatggtttaatttcttgagtattatatggtacgttggagctaggtatttaagaat

SEQ ID NO: 11853 - DNA, 444 bp, Homo sapiens
  misc_feature 269: n = A,T,C or G
ctcgctctttgtgcaggatcccatcgactctcaacatgagaaagcttttattttctattcttttcaattttttcacattctaaaattttggctgggcggatcttgatttttaaaacatttgtcctttgttttctaaagagggtcgttggtttgcttagtttttaaaaaaattgacgaatgatgttttttaacgaacatgttcatcttgctaatttttgtttgtttttttgagacggagtctcgctctgtcacccaggctggagtgcagnggcaccatcttgtctcactgcaagctccgcctccccacttgaactgattctcctgcctcagccacctgagtagctgagattataggtgcctgcccccatgcccagctaatttttgtatttttagtacagacagggattcaccatgttggccacgctggtcttgaactcctgagcg

SEQ ID NO: 11854 - DNA, 426 bp, Homo sapiens
  misc_feature 397: n = A,T,C or G
tgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccaaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcanaatatttcaggtaagtgaaagtggtgctt

SEQ ID NO: 11855 - DNA, 424 bp, Homo sapiens
ggcacgaggaatcaagggaataaaagcttattctgatattatagagcatataacagccatgtagatatgcatggtatagagaaatcagttctatgatggatgtaccaccaaagttgccgagcattatatagagatgcttttgatatgagccctaaaataaattgggatagagagggagttggtgaatttgagataatttttcaaagaacataccatatggcgacgcaaacggtagatatcaatcagtgataagctatattttgagtcttacaattgtttttacaattacccctgttttgagtatatatcttggcaaatcattctaataaatatttgctgataactgcgcggaatacatacatggtacgtagaaatttggaagaatcactacatattttcaggtatcattctctgtgcaaatacc

SEQ ID NO: 11856 - DNA, 431 bp, Homo sapiens
  misc_feature 384: n = A,T,C or G
cgttgctgtcggacaggaggcaggtgtgtatgggtgaaattattttgacaccctagagttaaccgggccttagagtcagtacattggttcaagtaacaaatatcaaagcagaactcttagtgtggcaaacaataaataattgtctcctagattcttatacaagtcactgtccgtccccaattggtagctcttagaatggctcgagttgcattcattgtcacagcaagacacaatggttttgatagcaaagcagtagagaaactaaatgtagagaggcagagagaactgtattaagtctgaggacctggtggttgtcatgggcagcaggaagtgtgaaggagagggttttccctccgatgaaaggaaggctagggcttgattcangggagcaagtgggatgggccctgctggtccctggctgtgcctatatt

SEQ ID NO: 11857 - DNA, 425 bp, Homo sapiens
  misc_feature 425: n = A,T,C or G
cggtgctgtcgaaaaaaaaccacgtttctttgttgagctgtgtcttgaaggcaaaagaaaaaaaatttctacaggagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattctgcactatttn

SEQ ID NO: 11858 - DNA, 426 bp, Homo sapiens
cgttgctgtcggtttaaatttagaccttttgagttaactcttctaatagtttgtgctccaagagagcccagcacacccttccatgaatggtgtcttttcaaagataactgtttttgaatgttcattgaaaaaattgtagagtagtcactcatcattttttcagttacactcaaataacaactattagtagacgtgttatttttataaagaatgaacagatgaggccaggaacagtggctcatgcctgtaatcccaacactttgggaggctgaggtgggcggatcatctgaggtcaggagtttgagaccagcatgaccaacatggaaaaactccgtctctactaaaaatacaaaattagttgggcgtggtggtgcatgcctgtaattccagctactcaggaggctgaggcaggagaatcgcttgaac

SEQ ID NO: 11859 - DNA, 425 bp, Homo sapiens
  misc_feature 425: n = A,T,C or G
ggcacgaggatggatcaaaagttatgattacacactgtaatctaaatgaatttaaggaatggcagtacttctagaacctgcacagatttactcatattccttcaggaaagtgtttaaatcgctcagaggtcctgcatcaagcattcatctccaattgtgactccagtacaacgactcataaatgggaaatgaataacatccatagtgtttagagagaaaaaaatagaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttacacn

SEQ ID NO: 11860 - DNA, 435 bp, Homo sapiens
cgttgctgtcgagagcttcaaacaagaagggaaatggaagaaagaacaataactatagaaatccctgaagttctgaagaagcagctggaggatgattgttactacattaacaggaggaaacggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttccttgacctggaaaagaaaacacctgtgcataacagatcatctt

SEQ ID NO: 11861 - DNA, 444 bp, Homo sapiens
  misc_feature 444: n = A,T,C or G
ccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatggtaattaagccaaaagacagattaagaaacgagcgaaccaagccgcaccttgaattcaccatttaattggagaagccacagaatttattcagccgaacattgtgatatccagtggatttgtgggagggcttttgcn

SEQ ID NO: 11862 - DNA, 426 bp, Homo sapiens
  misc_feature 28, 29: n = A,T,C or G
ataacgctacttgttctttttgcaggtnnttgcgattcaattcggcaccaggccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcatgggc

SEQ ID NO: 11863 - DNA, 413 bp, Homo sapiens
ggcacgagcccacacaacgagcccattgactccaaagggcagcacagcagatggactgctattatcccagtggtacagatggggaaactgaggcccgggaaggcagacttgcttgcctaatgtcacataaggagaaagtggctgtgctaggattggaacccaggctgtcaggttctgagcccttccctttctgtctgtgggcctactgtgtgctcccaaaaagctgtggccaaattaaggaggtggcatgtctgattcatctgtggcggggcctgggatatatagtaactctcaacaatggtgttcattagtccgggcatggaggctcacgcctgtaattccagcactttgggaggccgaggcgagtggatcacctgaggtcaggagttcgagaccagcctggccaacatgga

SEQ ID NO: 11864 - DNA, 405 bp, Homo sapiens
ggctggtgagacacgatcccctcctaagaaaatgttggtgctcagacaggtaaccactgctgctactgtttttatttgtttgtttgttcaattttatttaagatttgtttttgttgtactaggattttaaaaaatgtaatatattgcaggatttataaccaggttcactgactgcttgcttgctttctttttttttttttttttcctccttaaaaaaccaaaacaaagttcttttaaaaatacttttaggccccttggaagctggatttttgaaatgtttcagaaggggacaaaaatcggtgggggaaattttttagtttcccaggttaaattaaaaaggtttttaatttggtttgggattttggggggggatttttttccctttatccaaaggccttttggccg

SEQ ID NO: 11865 - DNA, 405 bp, Homo sapiens
ttaagaaggacctgatatgtaagcgctggtcatttttcttctggggtttactgatcagggtggagattttaacttcatttagtaattactctaggagattttaccttgacttatatttttcatgacgtttcatgatttgctgctggtttcaaatgaaactacaaatctggcatgttttactgtgaacacttttgttatttgttttgtacccttttttgtcttgtttttctgttttagctgccttctgaaaaaagagttgttccctctgtttctgtcctcagatgatgtccctccccctacctgtaacctttctttgacataattgttcatatcaatgaaggtgctgaccagctcaatacacagttaagcacaagatctaaagctcttgaaatgcccgagaaagaa

SEQ ID NO: 11866 - DNA, 404 bp, Homo sapiens
ttttttcgatggaatcttgctctggctaattttcgtatttttagtagagacaaggtttcatcatgttggccagggtggtctcaaactcctgacctctggtgatccacctgcctcggcttcccaaagtgctgaggcaggcggatcacctgacgtcaggagttcgagaccaccctggccagcatgatggatccaagccgggaggctgaggcaggataattccttgaacccaggagtcagaggttgcagtgagctgggcaacacagcaagacttcatctcttataaaaaaaaaagacccccacccccccaaaaaatgggagcccctgttctccactttttgaaaagcttaaaatgtgtttttatcttgggccagtctttagaacacccctggccaaaaatggttaac

SEQ ID NO: 11867 - DNA, 417 bp, Homo sapiens
  misc_feature 297: n = A,T,C or G
gtcggcacgaggctggccggtcgtggtggctcatgcctgtaatcccaacacttaaggaggctgaggtgggcagagcacctgaggttgggagttcgagaccagcctgaccaacatggagaaatgccatctctactaaaaatacaaaaattagccgggcatggtggcacgtgcctgtaatcccagctactcatgaggctgaggcaggagaatcgcttgatcctgggaggtggaagttgcagtgagctgagatcacgccattgcactccagcctgggcaacaagcgaaactctgtctcanaaaaaaaaaaaaaaaggggccgccgaatgaggaaattaaaggggttttttccaaaggacccctgccaaaaaaaaaacttttagggggacccctaatccgggaaaacattggaaagccaaa

SEQ ID NO: 11868 - DNA, 416 bp, Homo sapiens
ggcacgagaagcactccgcttgctaataaaaccagagtttctggatagtccaaaacattggttcttagagtataattcctaaaccagcagcatctgcatcacctagaaacttgtcagaaatgcaagttatcagactccacaccagacctacatgaatcagaaactctaggtgtggggcccaaaaatgtagcttaacatgcccttcaggtgattctgatgcaaagtaaacttacagaacccctgcactagagaaaacacttctttttgagatagtcaaggttgtatactgtttctaccaagcacaaatataggagcatttgagattcttcctgtgcaataataagaaatcaacaggaaatgtttcagtgactgtgtgtgtgtgtgtgtgtgtttataaaaatatcttgatatatatg

SEQ ID NO: 11869 - DNA, 412 bp, Homo sapiens
tgaaacaccgtctctaccagaaaatacaaattattagtcaggcgcggtggcgggtgcctgtagtcccagctactcgggaggctgaggcaggagaatgacgtgaacccaggaggcggagcttgcagtgagccgagatcgcgccactgcactccagcctgggcgacagagcgagactccgtctcaaaaaaaaaaaaaggttttcaaagttcctttttgttaaagaacccacgtaaaaggctgagtctattctgcatactatgcccacagaaaaggaagaaaactttttaaaagggagaatcgcatgttttcaatgaaaacattcacttggtatttcatttgtaaaaaaaaaaagggggcttttataaagaactttggggaaacactttgctgaaatgttgggactctggaacta

SEQ ID NO: 11870 - DNA, 422 bp, Homo sapiens
  misc_feature 422: n = A,T,C or G
ggcacgaggtgactcacgcctataattccagcactttgggaggccgaggcaggtggatcacgaggtcaagagatcgagaccatcctggccagacatggtgaaaccctgtctctactaaaaatgcaaaaaattagctgggcgtggtggcgggcgcttgtagtcccagctactcaggaggctgaggcaggagaatcacttgaacccgggaggcggaggttgcagtgagccgagattgtgccaccgcactccagcctggcaacagagcgagactctgtctcaaaaaaaaaaaagggaaatctggtttttttttaacccaaaaatttcttaggttggggcccaacttctttgttggctgggccctttgcactttgaagggcccccaccccaaggggttttgtttgtttccagggctttttgaactn

SEQ ID NO: 11871 - DNA, 413 bp, Homo sapiens
cctatatcaaaacttatcaaatggtgttctttaaatatgtgcattttatcatatttcagatatacctcaacaaagctgttagaaacaaggagttggaattagaaaaattacccaagtagtattcaaatacctaattatttgcttgaaagcactgaaggccaactatggaactcagtggctccaccagagagaagtctggctaggtgctcaggtggcgtgtcctgaccattcagtggctgagccctgtgaaaacaggcattctgtaggtcttcggatgaggaacttgcagaagcagccgggtgctgccatcctaagctggttttccatatgggcttctctgtgagtgttaagaaaagctgtggtttgcctgtcagagtgagcgcccccactcagggtaaccacagtttctccat

SEQ ID NO: 11872 - DNA, 409 bp, Homo sapiens
  misc_feature 409: n = A,T,C or G
cggtgctgtcgaaaaaatttctggattcttaaaccaggaagtatgtctgcatgcaaacattgcttctgagccatttcttggtatccttattgacaggtctatcctgcttttcttcactatgttaactgaacttactatttctgtctacttttaggctctgactttgacctttcctgtgtgtgaatttaatttctccctcttagcagtaaagcaatgcatagattacttttaatgacccaccctttcctttcatttgcattagccctatgatattctatatcttcttactttcctagggtagtagaagtcttggcttgttttgccagacagagcaaaagtggcctgggatccacctaaatctcgtaaaatatttccttacacagaacgcaaaattgcttagtactctctn

SEQ ID NO: 11873 - DNA, 412 bp, Homo sapiens
cgttgctgtcgggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcgattctctggccactttttctttcattacaatttgtaccgggattcttctcacccttctctgcgtccgtgcatttaaagagttgtctctttaaatgttgaagct

SEQ ID NO: 11874 - DNA, 408 bp, Homo sapiens
ggcacgaggagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagag

SEQ ID NO: 11875 - DNA, 408 bp, Homo sapiens
cgttgctgtcgctttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatc

SEQ ID NO: 11876 - DNA, 422 bp, Homo sapiens
ggcacgaggaagctgctgttcggaagtttgccatggactggaaagaagttcttgtcggcgcctagcgacgcccaacacctgtccaaacaaaaaaaaaagtgaacaagaattaaaagatgaaaaaagggatttatttacaaaatattactccaaatggaaaggaggtaaaaaaaacacaaatgaattttataaaaccattccccggttttattataggctgcctgctgaaaatgaagtcttactacagaaattaagagaggaatcacgagctgcctttttacaaaaaaaaagcagagaactgttagataatgaaaaattacagaacttatggtttttgctggacaaacaccaaacaccacctatgattggagaggaagcgatgatcaattacgaaaactttttgaaggttggggaaaaggctg

SEQ ID NO: 11877 - DNA, 408 bp, Homo sapiens
ggcacgaggtcaatgtttaatacattattgacagaacttacgatgattttaggtggctcagggatgtagtaaagtacttgtgttctgctggttaggctaagctgaagtgacaaatggccctcaaatgtctggtttcaacaaaagttcatttgcttttgttgaatgtctggcacatgtctgtcagccagcaggcacctgggaccctgctccgggttagcttcaccccgggactcgggctgccatgtctgacacgtggtggtccactggcagagggacacacgatcggggcaagttctgctggcccttaaagcttctacccagaagtgaccattaaccacttctgcctacattcactgggcaaatcaggtcccatggcaacgtgagagggcatgtactctcccttgaggg

SEQ ID NO: 11878 - DNA, 404 bp, Homo sapiens
cgctgctgtcggtcaaaatcacttatctgtagagcataaacgatgaccttgatcatgagagaaatggaaatgagaaaaagttgaaaaaatgggatgtttgacctaaagaagaggagcttcttttaagaagtaacagccacttttaaggatttggagttctgtcatgcagaaggatcagatttgacttgaccagaaggaactagggtcagtgggtggaagtttaaaagaagcagatttcaattctctttcaagataaatttcctcaaaattgtgaaaatagaatgagttgttttgggtggtaggctgttcctgttcactgacaagttggggattctagagtagaggaatcgtactgaaggagaatttgagctaggtgtcttcaagttacctataaactttgaggt

SEQ ID NO: 11879 - DNA, 405 bp, Homo sapiens
cgttgctgtcggaacatttatattgttattctttgtggctattggtgtgtctcacaggcaaaagttgatttggctaaaataggctcagatgtatttgcgtgcccgcgtgtgtgtgtgtgtgtgtgtgtgtgtgtgtgtgtatgaaagagagagagactttgacgggtgtagatattttttgcgctttgcctactatatgagtgataatcatgtgtttactaacaagtcgatgacctggctgtattcataataccatttaatattggcgtgagtgttctcgcttgacaaaaagaggcctcccctgcttctttcaacaactgtcacagagtgggtgggctgaaagctctgcccacggccctgctattggcgagagaggtcttttgtgggagcggtgtctcgtgcgtc

SEQ ID NO: 11880 - DNA, 416 bp, Homo sapiens
  misc_feature 131: n = A,T,C or G
cgttgctgtcggttaaaatagccccctgatgagccaggcactctgagggaacacagattatctgagtctgaacacgccagacttctccacaggtttattttggagtggaaagtatgcagaacacaaattanaaaattcaatcttttgagagattaaaatagggaaggctaccactgaatttctggaattgcttttcaggtccaaacgttatcttaaccttaggcaagctctctggccagccacacccatccctggtaaatgttgtaggacagagaccccccccagagccctgttgccccttcctgtcatgtttctcaccttccatgccccagtaaactgttgaaaccagagaatgggtcagggaagccccatcccactcccctgaaaatatctgggagactcttggtgtagggacc

SEQ ID NO: 11881 - DNA, 409 bp, Homo sapiens
  misc_feature 11, 13, 14, 16, 17: n = A,T,C or G
ggcacgagcancnncnnaagtaagaggagcaaacaaaatgtatcaatttcagccgaggttttctagggcaaacactagaatattgtaccttttgctacctgataccttatcaatcaatatatattactgagcacttcgatgcaaggattccatcacctccccaacatgtgatatagaatagaagcaggtaaatgtttactaaatgaaggtacacagcgggcttttggagaggaaatagactctggcctccagccatggaataatttatactgtctcttgctaacatacctggagccgtttcctcattttgtgatccaaagagtaaacatgtaaaaccagccaatcttaggttatattcttgccatcctagagagtaagtgctccaggacatcagagtaagaagtctgga

SEQ ID NO: 11882 - DNA, 408 bp, Homo sapiens
  misc_feature 140: n = A,T,C or G
cgttgctgtcggcgtgtgtgtgtgtgtgcgcgcgcgtgcgtgtgtatgtgtgtgtggtgggggagagaatgcacaaacactcgaggtggtttgtatatttgactggtgaatttcatagttgtttttctggggttacttanaatttgagagtccgtgagaagcattaggaagaacattactgagaaaaaaggaggggtgggaagcccctagacttctccccgagggtatccccgctgcagtcttctttagatgtttggattccccagtcctcttgttttgaggcgtgatataaattcagcctctcatacatttaaaaatatcggttgaacacctgctatattctaggcaccgaggagacggcagtgagcagacgagaatgcctgctcttctggagccacagaaaataca

SEQ ID NO: 11883 - DNA, 404 bp, Homo sapiens
  misc_feature 404: n = A,T,C or G
tggcgacaagattgaagctaggtctcaggggtctccagtcctccttcatcagggccaccccctgcagtattgagcaccagctggtccctctagggagagattgacaacagcccggaccctgcggcctgcctattccatctgaatgtcgcatcgtctgtttctcactaggggccgcctctgtcatctcactagacatttgaggaacctcctgcctgggccctctgcttctcacaggacagggacactgaactgcgtcagcctcagctcacccctccttagcccaaggtcttcctcatgcttgccacctactagtcatactggccttttagatccctgaagtgttgttcaaatccccggatcattgagtcccacccccagccctctgctgcggatcactccttaan

SEQ ID NO: 11884 - DNA, 411 bp, Homo sapiens
ggcacgagccccgttggcggatgatttttctaattctgcaactgcctggagcgcgggcatgatgacagaggaacggtcattgatgatgcatccctggaagacctgggagccaggtctggctccttggactgtatcttccgtgctccagtgggagtacagactgagagggagaagggggcggggtagagatgcaccccatgtcggtatgggaatcactctacctctcatttccttcaatctttcactcctaaaatgtctagtaaaccttttagtctgttctattctgcattcattcccttgactttcagcccttgtaattcacattgtttggctgggatcactcgcttcacaaaaggaaaagacttcctcctgtgaagagatccttagtatactacttgaagaaccgcgaag

SEQ ID NO: 11885 - DNA, 416 bp, Homo sapiens
  misc_feature 416: n = A,T,C or G
ggcacgagtgacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaactn

SEQ ID NO: 11886 - DNA, 405 bp, Homo sapiens
cgcaagagactattggcaatggattcttctctgtgtacagagccagcacccacaagtgcttgtactatgatgagaagaagagggccagtttccacaactttaagtcgcggtccagcagggaagaaatgaaatttcatgagttcgttgagaaactgcgggatatacagcctcgacgagggcaagagaggttgtatctgcagcagacgctcaatgacactgcggtcaggaagattgacatggacttcttaggttttaactggaactggattaataagcaacagggaaagcgtggttgggggcagcttacctctatcctgctgctcattgacatggcaggaaatgtgacacctgctcactatgatgagcagcggaacttttttgctcagatactaggtgacagacgag

SEQ ID NO: 11887 - DNA, 412 bp, Homo sapiens
  misc_feature 412: n = A,T,C or G
ggcacgagaggaagtattagctaatcagaaccacggtgccaggctgactcaccaagggctaagattgctttacttagtagcctcaagcccaaggaactgattgtgaaaaccacctgaataaacaggagggaggaagaggtaatactgttcatctatacatcatataagcctctgttaggcgctgcgcaatctatcaaccccagccctgccttcccataggaaattcctttattttcaattgccacatacatagatattccacggcttaatatacaagcaaatgtgtatattttttcaaggaacagaaaaaaacagtccatcttggctggtccctatggaccccagcccccactccttcttcaacaaagtccctgattttctcaaaagttcgaaccaaaagctggaagcgctn

SEQ ID NO: 11888 - DNA, 407 bp, Homo sapiens
cgttgctgtcggtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttgggttggtttggttccagttaaaagagaggacaggaactaaatggggctaaccacttcaggtgcagcttgtgcgagggtagatggttcct

SEQ ID NO: 11889 - DNA, 407 bp, Homo sapiens
ctcggcacgaggcgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccacgcaagatgcagggctctctgctcctggctctttatcgtcgtcgggacaccctttgtccaaactcaaggaatcccgggaggtctggctttgccgctttggctgggactcaggtacctgggcg

SEQ ID NO: 11890 - DNA, 417 bp, Homo sapiens
gggatttgttttcggcacgaggggtgatgctaggatggtcctttatatgtgtcctggcctctgcaggcttagggggcagttttgaaaatgaggggaggaagtgcttctgtctcgcacttgctgggtgctggacactgggccgagcaccagtccctcctcttcctgctagatgcctgagtcccattttacagatgagcaaaccaaggctcagagatgcggggtcactcatccaagaccacagatcagagggagccctggcctgaagtgcttgctgggctggccaaggccctctctggaccgctgtacttcaccactgctcccccaagcccagcctgtgcccccttggtcagacccccgttggccctctgttttggaacccatgggaagacagacctcatgtgaagggggcttcccaag

SEQ ID NO: 11891 - DNA, 417 bp, Homo sapiens
  misc_feature 1, 315, 318, 319, 320, 321, 322, 323, 324, 325, 328, 329,331, 332, 333, 338, 339, 340, 341, 345, 361, 362, 365, 373,378: n = A,T,C or G
nccggcacgagcgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggggnggnnnnnnnntgnntnnnttttnnnntgtntttttgtggtgtttgnnggnttgttttnttgtnttttgttaggcgaggggtggttttgctttgttttgggtg

SEQ ID NO: 11892 - DNA, 409 bp, Homo sapiens
cgttgctgtcggtttccttggtggaattttttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatactcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaagggccag

SEQ ID NO: 11893 - DNA, 412 bp, Homo sapiens
  misc_feature 15, 412: n = A,T,C or G
tgacaagccactcgngatttcagcagagatcccatcgattcgcagtaacactggactggatcggtacactcggcttcaagtgtggctgccgggaactgcgttccaccaaatacatctctgacggtcagggcaccagcatcagccctctgaaggagctggcgtgtgctgacgagtgcttgcccctgccagtgctccctaactggattggaggaggctatggaacaaagtactggagcaggaggagctcccaggagtggcggtgtgtcaatgacaaaacccggacccatagaatccagctgcagagccaagatggcagcacacgcacctacgaaatcacagtagtcactgcctgcaagtgcaagaggtacacccggcagcacaacgagtccagtcacaactttgagagcatgtn

SEQ ID NO: 11894 - DNA, 408 bp, Homo sapiens
ggcacgagagagagagagagagtgtgagtttgagagagagagagagagagagagagagagagagagagagagagagagagagagagagagagagagagagagagagagagagagagagcgctctcacacacgcgcggggtttttgtgttctgcgcctccctctcttttttgtgggggggcgctctctctgcgtccctagtcactctcacccctctctgtctttttttgtgggcagacgctcccacacacactgtctctctctctctctgtgtgcatatatatttctctgtaccgagcgggtgtctctttttttttctctccctaaaactctctctttcccgctctgtgtttctctctctcacacacacacacacagaggggggtgtatctctctctctctctctctct

SEQ ID NO: 11895 - DNA, 423 bp, Homo sapiens
ggcacgagggggctatggcggaaacaaaaggagatgagggcaggggcacttttaggaaggactgaggctgctggcagtgtcacatgactgttgagaagaagggaatttgttagcaagtggttacatttagtaggaaaagtgttgagggcatgggtttggattaaaggagggagtgagcaattgaggaggaagtggaaattgggcaaaacattccttttggaagtttggatggtaaaaggaagtgtaggttagaacaaaggtaagtctgagaggtaagagagaaggaacacactttgggcttggcctgaaatgagagggaatgaggaaaactgggtagagggcaaggatgctccagcctggtggctctgctctccaagaggaaggaatagagctttagaagtgtggatggccagagttcacggg

SEQ ID NO: 11896 - DNA, 413 bp, Homo sapiens
ggcacgaggttattagggataagctgttaattttttacaggtgtggaggatatttcaaatacatcgtttgcctttgcactaacatgctttcatttctttcagtctcttcctccattccctttaaagtcttccccatcatatcactgatctcaaaagctagatttgtcttcattttagccgtatccctaaaaccatgcattggtctggacaggagttgacccatattcccttgcagactggtcactccatgttctctgttacagtaaggaccagccaagcttcagctgtcccattcctccccctacaacacacacacctttcaagcagggaggagatgatcttccagccccaagagtggaggctgccacatcctaacatattatctattgaacaggaagcagtgcgtatccatg

SEQ ID NO: 11897 - DNA, 404 bp, Homo sapiens
ggcacgaggagactgaggcaggagaattgcttgaacccaggaggtggaggttgcagtgagccgagaccgcgccactgcactccagcctgggcaacaagaacgaaactctgtctcccaaagaaaaaaaaaaagaacttaaggttaacccaggccagggatggaattgacctcttacaagtcatgtgatcttggacagacaccctctagggaacttcataatctcatttgggaaaggggaataaatgctccgacttgggactgccactgggaggaggacaggtcatggtgtgtgaaggagcagggccacccttcgttcacggcgcgctcagggaatgtgaaatgtgggtgtgaaaaaatgtcccttgactccgcccttcctgcccttaaaacacacgcacatgcac

SEQ ID NO: 11898 - DNA, 405 bp, Homo sapiens
ggcacgaggcagcaccagctcttgggcctgctgtctgtctatacccggcctagctgtggacctgaggccttgggccatctgctgagccgagcccgaagccctgaagagttgagtttggccacccagttatatgcagggctagtggtcagcctctctggcctcctgcccctggctttccgaagctgtctggctcgggtgcatgcagggacattacagcctcccttcacggcccggttcctgcgcaacttggcactgctagtacggtgggaacagcagggtggcgagggccctgcagccctatgggcgcactttggggaatctgcctcagcccatctgtctgacctggctcctctactgctacatcctgaggaggaagtaactgaagctgctgcctctctcctggcc

SEQ ID NO: 11899 - DNA, 407 bp, Homo sapiens
  misc_feature 3: n = A,T,C or G
ggnacgaaaaaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaagaggttcccaatgggctcagggacgaagcttg

SEQ ID NO: 11900 - DNA, 419 bp, Homo sapiens
ggcacgaggattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccc

SEQ ID NO: 11901 - DNA, 415 bp, Homo sapiens
cgttgctgtcgtctgagtctggcgcggatgctatgggcagccaggaggtgctgggccacgcggcccggctggcctcctccggtctcctcctgcaggagttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagagcctgatcctaatgttgtccctcactatgcaactggagtggtgctgtttggtct

SEQ ID NO: 11902 - DNA, 407 bp, Homo sapiens
ggcacgaggcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctga

SEQ ID NO: 11903 - DNA, 411 bp, Homo sapiens
  misc_feature 411: n = A,T,C or G
ggcacgagccgactgtggagaagtgtccggtgtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttaatgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatn

SEQ ID NO: 11904 - DNA, 414 bp, Homo sapiens
  misc_feature 24, 25, 26, 27: n = A,T,C or G
gctactctctctttttgcggatcnnnncatgagattcggcacgagggggttcagagggttttcattcaatcaatcctccgaatccagagatttagacccagtcgtccgtattaggactggaggggggtcaataggttcagtgtttgagatgccaagggaacctgtcttttgatttggggttcaacatacagaggtagcagtcaccattatgctcaaagcggtgatcctgattggaggccctcaaaagggaactcgcttcagacctttgtcttttgaggcgcccaaaccattgttttctgtggcaggggtccctatgatccaacaccatattgaagcctgtgcccaggtccctggaatgcaggagattctgctcattggcttctaccaacctgatgagcccctcacccagtttct

SEQ ID NO: 11905 - DNA, 413 bp, Homo sapiens
  misc_feature 413: n = A,T,C or G
ggcacgagagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccan

SEQ ID NO: 11906 - DNA, 409 bp, Homo sapiens
cgttgctgtcggcgaggtggggtaggcgtgcaaggcgggcgccgaggtttgcaaaggctcgcagcggccaaaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttataacatgcagaagcaactctaggaagtgggaatctgagacaagctgttatgttgcctgagggagaggatctcaatgaatggattgctgagaacactgtggatttctttaaccagata

SEQ ID NO: 11907 - DNA, 418 bp, Homo sapiens
ggcacgagggcatataagatctattatgtctatggcttcatgatgctggtgctggttatcctgtgcattgtgactgtctgtgtgactattgtgtgcacatattttctactaaatgcagaagattacaggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgc

SEQ ID NO: 11908 - DNA, 420 bp, Homo sapiens
  misc_feature 404, 420: n = A,T,C or G
cgttgctgtcggtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaatanagaagaatggatcagn

SEQ ID NO: 11909 - DNA, 412 bp, Homo sapiens
cgttgctgtcgtgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttatctggggatgttaaagtgaaaaaggagagagacccttgaaccactgggcagccacctcctttgccctagaccagctcctctccc

SEQ ID NO: 11910 - DNA, 415 bp, Homo sapiens
  misc_feature 1, 2, 4, 290: n = A,T,C or G
nncncgagggaagatggacgcagctactctgtcctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctangccgagattggaggtggacacaaaggaagaggcagccagacagctacttcagcgtcctcaacgcattcatcgacaggaaggacagttactactccattcaccagatagcgcaaatgggagttggc

SEQ ID NO: 11911 - DNA, 383 bp, Homo sapiens
ggcacgagaaaaatttcaaccaaagaacagattcttctccagccaaccatgtcccgccactcagaaggggtttcatgcttctactgataagccaacttaacatcagatccaatacagattttttaaagataaaataccatctctactggacctgtttagtggctcaggctgccctcacaggacatccctgagaccaccctgtcactcttgatgttggaaccagggcccaggcctgctcctcattgtctcctgccctcctagtccccaggagaggaaaagaaatactgttttagagaaataacattttcaacaaaacatccctggagtcagattttgagttggggtgggctaatcagggagtcggggctctctgcgtgatgtcg

SEQ ID NO: 11912 - DNA, 401 bp, Homo sapiens
ggcacgagcctcggcctcctaaagtgctgttattacaggcatctgccaccgcactcggcgtatccctagaaatcctatgatagcatgatgtataggcacctaaaggcatggcacttgagaaatgtgaataataatggtcggtctctcctcatggttcgggagagggaaacagtctcaccccctaaatgtcaccttgaattacagcatgttatataagcacatcctggcccttccttgaatggggatctttctttctcaccaaatattgatccttttcccttcagagaacattgctctttttgtcttccccttaggaattttactgattccttaaatttaaaagggcgtgttgtaacctttatgtcccccgccccctcacagagttggtgcgtctgtgatgg

SEQ ID NO: 11913 - DNA, 385 bp, Homo sapiens
  misc_feature 371: n = A,T,C or G
ggcacgagaccaagaacacttcagtctctctaaggatgccctgagctacctcactgttaaaggacgacatcaacacagaatgcactaaacaggaaataagctgtaatctagagaatttccattatgtgttactttttggtgactaacatggaatgttgaaaaggaagagctggaaagctcagttgttttccttgttcctctgacattgtccaggcaagagggcatcctgatcagatgagtagatttggctgagaaaaaccctagagtaaggcaggcactttgtggaggtggatgatgatggctcataaaaacgtttgttctcagtccagttcagggctctgccagcagtctttcagatttgaactgcttanacaaaccctacaga

SEQ ID NO: 11914 - DNA, 396 bp, Homo sapiens
cgttgctgtcgggagtgcagactgttattgtattgtgttcttgtgcaaaaaaaccccaggtgtatcatgggaatacatctttgaccttggacttccttgtgtcctgctggcagaggtcactagttttgacacctggtgagagatgtgaagtgttcctttatttacttatatttatttatttatttatttgaggcagggtcttgctctgtcacctgggctggagtgcaggggtgcgatcatggctcactttaccctccaactcctgggcttagacagccctgctacctcaccctcctgagtacttaggacaggagacgaaccgcaccatgcccaccccatcttattatgattgcttttatttccagaacatatccccctatgaggcgacagtcgccc

SEQ ID NO: 11915 - DNA, 383 bp, Homo sapiens
  misc_feature 381: n = A,T,C or G
ggcacgaggctttacttttcaaacatgactattcattggcatcatgtgagttttttgtttgttttaatactgagttctcccctcctcccagtaagtctaggtgtggtctgtgaatcattattttaataaaatgttatggtttggctgtgtccctacccaaatctcctcttgaattgtagcttccataattcccacatgtcatgggagggaccccgtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgnga

SEQ ID NO: 11916 - DNA, 388 bp, Homo sapiens
  misc_feature 388: n = A,T,C or G
cgttgctgtcggagtcattctgcctagatattggagctaaaatacattgcagaaatttgttttagactagtctcttatgtagattgtgtgggtttatgtagaacattttgtgttcagaatgcttttattaaccttcttcatggtactcttgagaggctgtccttatctcttactgatgattagactgagacaagtggaaagtaaaggttagacaagatgtaaagtgtgtggtttgagctgtgatgagcacactagggagttccagataccagtttgatgcttattcaaccatttaggttatcggtctgcgagtttgttttctgcagtgtgtgcataactagtgttttgtcctcttagaggatactctggggacattcttgagtttttn

SEQ ID NO: 11917 - DNA, 399 bp, Homo sapiens
cgttgctgtcgaagagctctggcggttacagacactgcaggaggtggccctccgggtggcaggtgctcctgtgggacccgcctgctttgttcccaccagtgcccatgtggctgtaagaaatcataacttggccgggcgcggtggctcatgcctgtaatctcagcactttgggaggccgagacgggctgatcatgaggtcaggagattgagatcaagaccatcctggcggctgggcgtggtggctcacgcctggaatcccagcactttgggaggtcgaggtgggtggatcacgaggttgggagatcaagaccatcctggctaacacggtgaaaccctgtctctactaaaagtacaaaaaattagctgggcgtggtggcgggcgcctgtagtcccagctac

SEQ ID NO: 11918 - DNA, 398 bp, Homo sapiens
cgctgctgtcggtaaacgtgcagaggaataaagcccgaaaaactacctaccagtggttctctagctggtggaattgtcagtgattttaactttagctgctgagtctttttgtacatatccaaatttttaaaataatgaactcccacaactttaatcataagacatgatttaacataaatttgacatcatgacatgccagattgaaactgtaatgggccagatggcacgtttttacattgtctcctagcttttgccctataatcccaatagcaagagtggagagagagtagaaataggatcttggagagggactttgacgaaattgggaggagatgaaaaagccttgagtgctggcaaaggaaacacataagtgtcgggtatggttaatgtcagaaggt

SEQ ID NO: 11919 - DNA, 400 bp, Homo sapiens
  misc_feature 400: n = A,T,C or G
ggcacgaggagagaacccagttctaggtactgtctgggcctgggaggcgagagcagtgcccaggggacttctgggcttacaggacagcgtgtgtgacaaaattcacatctacctgaacttgcctctggagatgataagggccaaaggagcagtcagggaggggcggtgagccagagtagtcccagggggagacagattcctccctcctccccgcctgcagctctctttaattttttgtaacatttggagagacgtccgtcctgtcttgtagtctttttattttgtgcatccttataattgtattctacaaacaattttgttttctgcatttaaacatttttgtgtttttaggagatggtcttgctctgtcactcaggctggagtacagtggcacaatcan

SEQ ID NO: 11920 - DNA, 402 bp, Homo sapiens
  misc_feature 14: n = A,T,C or G
ctagtctcgagganttttttttatttattttttggtcccccaaagggaaaattttttttttgcctttaaaaaaaaaaaaaagccccaaaaactttttttttttttcccccgggaaggggagtttttttttgggccccgggggggttaaaaacccggggaaaaaaaaaattcccccacccaaccgaaaatccccaaaaaattgggaaacaggggggccccccccccccccccccccccctttaaaaaattttaagaggggggggcccaaatttttccccgggcggaatttaaaaacccggccccaaaggaaccccccggtttccaacccctaaaagggggggggaaaaaaggggggccccaaaccccccccctttaaaagggaaaaaattggggaccccccct

SEQ ID NO: 11921 - DNA, 402 bp, Homo sapiens
ggcacgaggtgacaactgattgggccttgtaggtatgattggatttagccaggcaattaaataggaaagcagatactcatgacagattaaaacagcttgagagaagtgaaatgagcaagtgtaagacaattgatactgtccatggattttagaaagtgtgaagtggagtgattgtgatgaagcttgaaagattgcctggggccaggctgttgaaggcttggtttgcttagataagtcaaatgcagtagacaatggatagtcatcacagatttttgtacatgggacttcacataccttaattgaatatccatcgtgtacaaaatattgctcaagcaatgtaggaatcaagggaataaaagcttattctgatattatagagcatataacagccatgtaaatatg

SEQ ID NO: 11922 - DNA, 401 bp, Homo sapiens
atcggcaccgagcctgagacttagaaaccgcttatttgtttaaaacccaccttaagagctcacaccattagggagaagcaccatgctgaatcatttcacagttttcaactctgggaaataatggagagagtttaaaaatgtaaaacttcagctattttggggctgaacttgcttacttgaaaaatctggtgctaggcacatatatctgcctctcctttgcgaataccactccaatattattctttactattcagatccaagcttcatgatctacttgatcttcatgttctttaaaacattcgaaagatgtcaactgagagaaacatttcagaggggggaggcttttggcactggtgataaacatccctccaagagaaccgcctggggttctcttctatttg

SEQ ID NO: 11923 - DNA, 400 bp, Homo sapiens
  misc_feature 400: n = A,T,C or G
ggcacgagacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattn

SEQ ID NO: 11924 - DNA, 382 bp, Homo sapiens
ggcacgaggtggcttgttgcaaattacatgcaattagccctcagacagcctgaatcgagagaattgtggcaaaacttgatggtgcagaacctaggcaggcagccagactcctaaacccagtcacgtaaatttgctgctgtaactggatcttcccaagccacaagtctgagaaatggtgggcactctgacctgaccactagattttcaggatattcctcctaagagaggtatccttgcttctaagtgacccctaaaacagaacctaggaaactctcagccagataaattagaaattgattctaaataggcttgtgcccaggaaatcaacaatgcagtaaaaatatcaggacaaaagcaagaatacttcccaaagtcagaactg

SEQ ID NO: 11925 - DNA, 382 bp, Homo sapiens
ggcacgaggttgggaagggtgtagtgccctaggttggtgacagaagggacagacacttgtgcacaggtgtctttggtgatggggtttttttttttataacttagtaaaaaaaaaaaaaggtttgggaaattttgtttttgggaaaagctaaaacccaggttaccctgagggggcgcagggttttctttcctgccctttaaatctctttgaaaataaaaacctggcacttgttgatggtgtttccaaacccccttaatttccaaaaaaaaccccaagtttaaggtcttaatggggaggggagggcacgtttttgacacatggaaacttccttaaggagggcctccctttcccctttccctaaaagttttaaagtgccgttggt

SEQ ID NO: 11926 - DNA, 386 bp, Homo sapiens
cgttgctgtcggaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacag

SEQ ID NO: 11927 - DNA, 397 bp, Homo sapiens
cgttgctgtcggaagaccaaggactaggagtgtgagaaaaattgatcctcaggaggaagactgcaatgcatttagcaggaaagagtaatgtttcttaagaaaaaaatgaaacaatgaaaatccactaaaatctgtctcaaggataatattccatgactctacagggcttaatgcgtgtgacatatatagacttctgataagcagtttgaattatatgggtcagagaaatttccaggtcataggacttctctttaaagtaaaataaataggccaggcacggtggcttattcccgtaatctcagcactttgggaggccaaggcaggtggatcacttgaggtcaggagtttgagaccagcatggccaacatggtgaaaccccgtctctacaaaaatactt

SEQ ID NO: 11928 - DNA, 396 bp, Homo sapiens
  misc_feature 396: n = A,T,C or G
ggcacgaggctatcaatgtaagatacatactcagattttgaagactagtattaccaaaagaatgtaaaatatcacattaataattttatattaattacatgttcaaatgatattttggatatactgaattaaaacattaaaattagttctacttgtatctttttacttttttaatgtggctagaagaaaataaaattatacatgtggctcagattatatttctattggacagcgctgctctagaacattatattaagtggttattattgaagtagaccaaagtttataccataaggatatttttccttaaataccatgtttgaagaacaattatttattgatccttgaatctgtaagatcaaataacaagtctctatccatgttaccaaatttaan

SEQ ID NO: 11929 - DNA, 394 bp, Homo sapiens
cgttgctgtcgattttttcctggagagccttatcatgtattttatatgcttatgtggtggtggatgacatcatggaccatatagcttttatagagaatttttctcaccatagaactgaggtctcaccaggtgatctactatgcaaattcctacagttttctattcttaagaaataagggccgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcagagcttgcagtgagccgagatcacgccactgcactccagcctggg

SEQ ID NO: 11930 - DNA, 396 bp, Homo sapiens
  misc_feature 396: n = A,T,C or G
gtccagttgctgacggactcacttttacatggtcagctttcagagaataatcacagagatgttagcagatttaggggcactttaaagcttttgttgcgatgtttttcaggcttacaccaactttcgcattcatagaatggtgggacctcaaggatgagtgaggagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaatn

SEQ ID NO: 11931 - DNA, 385 bp, Homo sapiens
ggcacgagagtgagtctatgtattagggataacagaaggaaatcaagcacaaacttgctctttatttacaataaactccatacggaatttgaattctaaagttaacaaatcaatgaactccatgtaaaatagtctttacatggaataatggaaaacaatcgatggtccttttcttaaaaaccaatttttccccattgtaatacctttttttttttttaaaagaaaatctcgctctgtttccagggctggagggcaaccatttccatgtaatatgtactttccccgaggactgccagaactcacttgccattttaagggaatagaaccccattgactaaacacccttccaaacacccccgggatcaatactttgtatccttcaatc

SEQ ID NO: 11932 - DNA, 402 bp, Homo sapiens
ggaaacgaagtttttgggagaaatccgtttgataaagccttggcggcttcgaggtcatgtgttgagcctctggctgcatgaacaaaagcgaagcccgctttcatggagcttctgtgaagagcaacaggaacacaggcagtccagtcgtcctgagatactgggaggagcatggttgcttttgaacacgtaggagataaagcctctctaataatgcctgtttttttttccttcactctgtctcccaggctggagtgcagtggcacggtgtcgcctcactgcaacctccgccttctgggctcaagtgattctcctgccccagcctcccaagtagctgggactacaggtctgtgccaccatgcctgtctaatttttttgtatttttagtagagatgaaggttttaa

SEQ ID NO: 11933 - DNA, 397 bp, Homo sapiens
ggcacgagggacatggctctgctgggcaaagcaaggacgggcacatccaacctatgcggtccatcaggggcactcacatttagaaggggggagtcttatttagcccaggggctgggggcaccatggtaatgtagaaaaaggggccagcgcctccagaaaatgggaccccaggcctggctctgctccttctgctgtgtgattctggttgagtggccttccctttgagtcctctggatgaagctaaggagaagtcttgggttctcaagtagtcactattcagactctcgctttcagagtatttataggaggaaaggacacataaggatagggctggtggacttataaggccgtgtgtttgccgccaccccatttgctcccagggctgggtgtttgtctt

SEQ ID NO: 11934 - DNA, 396 bp, Homo sapiens
  misc_feature 168, 169, 170, 171, 172, 173, 174, 175, 176, 179, 180, 183,184, 186, 187, 189, 190, 212: n = A,T,C or G
ggcacgaggggaccctgctcgcccagatgtgctcctggacatttgcccagcgtcctactgagcaggaactgagggcccgtaaagcagcacggccagggggacgtgaacgggctcgcctggcaactgcccaggacaaggcccgctccaacaaagggctcctggccttgnnnnnnnnntanntgnngnntnntgggaagttgagtggtgggttntaacctatacaggtttctttactctgtctttagctcgggcccctccgtttttttttccttgaatccgagacgggaataccgtgggctttctggccttatcccacaaatataagaacattccactggttgtctgctttccccctggaatataggactctttcctgggggcctgtgaggccttttc

SEQ ID NO: 11935 - DNA, 392 bp, Homo sapiens
  misc_feature 392: n = A,T,C or G
ctgcctcagcctttcgaaccggtgagactacaggcatgagccacctcgccccgccctgaggatttgtaactattaaaattagagacctaccgattattgattgtgtcagattgagctactaattcgatactcagggggggggatagaactagtagaaaactttggaaaatgtcatatagcttaccatttcgagctttgcgttattagatagtgcatgaggccttccttttaagaaaatgaatcaagggctgaggtctgtaatagagtattaatttaaaagccaactcttctcctggaagtcctgtcagtagcatatccaccatatggccctttcttctgttttcctgtattgcatcattcctatttagttctgtgctcttagatccttcttn

SEQ ID NO: 11936 - DNA, 389 bp, Homo sapiens
ggcacgagggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcg

SEQ ID NO: 11937 - DNA, 398 bp, Homo sapiens
  misc_feature 398: n = A,T,C or G
ggcacgaggcaaagaggagcgagaatcagatagtggaggtatgatgggactggtggctaaacagagaaggagaggtatataagatcactggaatgggaatggttgttttggaagtagtgaagttaggacacaagggtgaactgctttggggtttgtatccattctgttagccttttgtatttaaggccagcactgaagcagtggaggaaatgggcaaagtaagaagagagaattctgaaatgaagctgactttgagcaggagtgggagggaataagctagattatctgggcctccagcatctctagacctagaggttttctctatttctccttttcactgtgacccaggaaataattttcagaagtaaaaaatctcatctgagactctgcaacaggcn

SEQ ID NO: 11938 - DNA, 400 bp, Homo sapiens
gttgctgtcgattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctga

SEQ ID NO: 11939 - DNA, 397 bp, Homo sapiens
ctgctatcgggaacaatccttgagggtgagaacgtggattgattcttgattgatagtggggattccattatctgtatttggcagttatggcctgctgcggtgtatagaagcttctttccattcattttcccgaattttcatactgctcaaggaacagttgggggggaatgggcagaaggttgggcacttgagtatttgagctatcggtaataactgactttttagggagcacagatttgagtagagccatggtagtagttagtaccaatgggtttttgctgcttctactctttcttaacagaaaaagtggattgtgttcatataggaaagcagttcacagactgtcttcctgcccctcccgccaccaagctggacctagaatcaagtgtgactttaa

SEQ ID NO: 11940 - DNA, 391 bp, Homo sapiens
cccagtctacattgaggtatagtgtattaaaggatctcaggagacttgcagcaaattactactgcttctgtgcttaaattcagatgtctgagctctaaaaaaaagcactcctagtaaagactccaattgggttgttaaccctttggggcccaaggtttatccaaccccagagggattttttttggctcctttccttcaaggggaaggcaaaaacggctttaaagcaatatacccagggtttcctgattgccaccaaatggcctggaccccccaaaaaaaaaaagaatcttaaaaacccccttttctaatcccttttaataaagggggaaataagaaggtctttgccttcggaaagtctggcatgttgcccattactttaattttctgccag

SEQ ID NO: 11941 - DNA, 391 bp, Homo sapiens
ggcacgaggcctggaggcttttcaggtggcccagcgtggtgtcctgtcagcttcctctttaggaacccaccagagggcagcaggctcctttcacttcgctagtaagaacccctccgtttttgtgtgtttttgtttttgttttctggagacaaggtcttgctttgtcacccaggctggagtgcagtgtcgtgatcaaggttcactgaagccttgacgctgtgggcactgcctcagccgcccaagtatctgggaccacaggcgtgcaccaccatgcatagctaatttattttttgtagagacagggtctccctgtgttgaccaggttggtctcgaactcctgggctcaagcagtcctcctgccttggcctcctaaaagtgctgggatcacagg

SEQ ID NO: 11942 - DNA, 389 bp, Homo sapiens
ggcacgagcttagctgagcttgttgatattcttatcctatgttctgtccactcatggctgggggccctgctcacataccatctattctatgaagctgcgcctgagtgaggcttccttactgcctttgtacacagtaccaaacatagtgcctagcatggaatagatactcaatagatatttgttgaatgaacaatgaatgaatatttgttgaatgaatgcattatcccacttgggagcaatccactcttcctctatgcttttatatcactttgcctctacctcgttttatggagctctctacatttaacctttattttagctaattatgctttagatgcaaccccttctccagaaggtcagcccttggataataccgcctgggtcaattg

SEQ ID NO: 11943 - DNA, 387 bp, Homo sapiens
ggcacgaggaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcgg

SEQ ID NO: 11944 - DNA, 386 bp, Homo sapiens
ggcacgaggcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgt

SEQ ID NO: 11945 - DNA, 383 bp, Homo sapiens
cccttttggagaggcgacagggggaattgattttaaatattgttttcgcctcatcaaatgtcaccatccagtttagctactggtattcactggtatttctcaaattggagtgtcgaatgcttaggtttttgaaaaccgcggcattggaaagctttgataggaagtaaatgttggagctcttatttctccagttagcaaatgttcgatgcctggtatactgttagggtccaaatgaacagaatagaaaccctgctttgaaggagaaaaacactgaagagaaactacacgtaattagtgattactgcgcagtatagcttaggaagtgctaccgtagtagaataatctacaggggagtgattaacagtgcttgggtaggctagacg

SEQ ID NO: 11946 - DNA, 384 bp, Homo sapiens
cgttgctgtcgcttgccttttacagagccatgaagcagcagatgcaaccgaatactgtgcagcatgagccacagacgtttacgggaagaaccggcaggaggcgccgggaaactaaagggctccagctctctgagtggtggctttgccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctccccagctgggcggctgttaaccagccaggatgtctgaccctgagaagtcaccgtgcc

SEQ ID NO: 11947 - DNA, 382 bp, Homo sapiens
cgttgctgacggcggctggatggtccttatattccaaaactcaccccaagcctctcctgcaggggtggccagagattgatcccccagggctgggttaggcatccctggtcatgccccaaagcgcctgggtctctgctcatcacacttagtgtaaggatccatttactcatctgcctctcccgccctcttcccttctctcccctcctctcccctcctttccccttcttctcctctccttccctcccctcccctctctgaggaacttggtccagctacagtcaatatctagagaaggtattggcctagagaaccttgctcaatcttaagcccgcacacctgccgtactttgggatcaccccgggaaccttaacatgctgatgcg

SEQ ID NO: 11948 - DNA, 382 bp, Homo sapiens
  misc_feature 382: n = A,T,C or G
cgttgctgtcggcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagn

SEQ ID NO: 11949 - DNA, 402 bp, Homo sapiens
ggcacgagattatgattatagtaaacagactagtgggtagtaatgctaaattaccatcacagttatgtgccatctccccaccccatttttttttttttttggatcaccaaaaaaatccgggaaaccagcctgagggggggctgaccttgttaggaggggggcaccaccacaggggggggaattaacggggaccccgggctccaaaaagaccaaaaaggtggcccttggggcccaccctaacctaaaaaaaaagggggccctaactggaattcggaaacaagcggatttgaaaacaaaaaaaaaggattttttggccccctttttaaacaagcggccttaaaatttggaaaaccccggcctaaaaaacctagaaaaaaaggggagggaaatggagggcaaaaa

SEQ ID NO: 11950 - DNA, 382 bp, Homo sapiens
cgtagctgtcgggagggtttgaaggagaccatcagctattgtgtgatatcagacaccatggtgatgtaacggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcg

SEQ ID NO: 11951 - DNA, 401 bp, Homo sapiens
ggcacgaggtgatcaaggagatggcagctcatatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatataccaggagttggtaacatccactcaggtgccacacctccctggatgatccaagatgaagaatacattgctgggaaccaagaaataggaccatcctatgaagaatttcttaaagaaaaggaaaaacagaagttgaaaaaactc

SEQ ID NO: 11952 - DNA, 396 bp, Homo sapiens
ggcacgagattctccgggcttatattcattctctgcttctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaaattcacttacagcctgaggcttataaagcttgt

SEQ ID NO: 11953 - DNA, 396 bp, Homo sapiens
ggcacgagaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagc

SEQ ID NO: 11954 - DNA, 392 bp, Homo sapiens
  misc_feature 392: n = A,T,C or G
ggcacgagatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacn

SEQ ID NO: 11955 - DNA, 389 bp, Homo sapiens
ggcaccagatccttcctcaaagcatggttgctgagtacccagagttgcgaggagttttttaactgatttagccaggtggcaatcatgagtgaatggatgaagaaaggccccttagaatggcaagattacatttacaaaaaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagag

SEQ ID NO: 11956 - DNA, 397 bp, Homo sapiens
ggcacgaggtggctggcaccccaccctgtcttctctgatctggtgctggcgtagggccgtgggggtaagtcacgtctccccgtgggctcagggaggcctctgcacttagggtctgaccagcctccccactaggaacagggtgggaaagtctgctcctgagccaggagtcaggctgggagtagcaatgctgggatgggaggtgtgtggccctcatgggcctcctctgggaagcccccagcacagatgtgggcccactcagaggctgcctcctggacctccccttctgctggaccccggcgtatgcctcagctaagcccgtatttcattctgctcagatgctcagaactctagacatttgcctccgcaattatatcccattctcctggaggaccaggac

SEQ ID NO: 11957 - DNA, 389 bp, Homo sapiens
gatactatgcctttaactttagaccgcagtatattataatacatttgatatctgaaatatctttacttttttaagagtaagattccatatgtctgtctggaagggagccatggttattcacacgaatatccctgtcacttctccagaggtgtgaggtaactaacacgagcattctttgaagactctgggcacatgaatgatacacagaattgaatgtttaaatttccactttgagtcctcatgaatcatttgagactagcaccagctgatcttgtgtacaggctcagggtcagtgcccaagggctcccgcgtgtgtgttctgatcttcagtgcgtagcacattctccatttataaaagagtggtcagaataattgtggacggtacagtg

SEQ ID NO: 11958 - DNA, 391 bp, Homo sapiens
  misc_feature 369: n = A,T,C or G
ggcacgaggcgacatttaattttagttagtttacatttaaacagccacacttgactcgtgagtgccttattcgacggtgcatctctggaggacttgctcccttcagcctgacttacaagaaactgtgtctctacctgagctccagttgttgagcgctaaggggcaagtggaaacccagatgaccatcacatcagccttgggagcccaaagctgggcagagggcttggaagttggccatattcatggctggtatctccatcagatgctgatttggggccatctgtgtatgtaccctgtggagttaagtgctggtgattcagagcggtatagttgtgatttacacactcaagaaatgggagtgcgggccangtgtggtgtctcacgcctgtaa

SEQ ID NO: 11959 - DNA, 395 bp, Homo sapiens
ggcacgaggaacggggggacccttagccctcaagggaggaccaggaactgccaggaaaccccctgtccgtgtcccggaaggggacagccaggcaggtttgcacagcaggacctccttccatcctggagagggaggagggaggcagctgccacagtggaagtaaccttgaacctcctgtgagtcatggaatggaagacagagcagacctcagaccttggagagtcagggccgccactgagccagcccacgaggctgtatctgaggggtgagcctggcaccagcgggtgctccgtgactgcctgtggcagccccgccacacctcgtgccactcgccttcctggggcgtccgcgatcgccagtagtgagttccacgcggcgtctctgtggtaaggagc

SEQ ID NO: 11960 - DNA, 392 bp, Homo sapiens
ggcatgagaagaagctctgcttggtactactattatgaacaacattgttatttggaatttaaaaactggtcaactcctgaaaaagatgcacattgatgattcttaccaagcttcagtctgtcacaaagcctattctgaaatggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggttcctggaaggtgacgtgaaagatcactgtgcagcagcaatcttgacttctggaacaattgccatttgggacttacttctcggtcagtgtactgccctcc

SEQ ID NO: 11961 - DNA, 401 bp, Homo sapiens
cgttgctgtcggctttttggactgtttcttataaaatctgggaagatggctccagtgatcattctacatatattgtacaaacactagattttcacctgggtcataatactatggttaccaaaccatgtggtgctttggaaagtcctatggcaacaataaccaagataacaaggcgtcgccatgaaaatccaccccatggagtaacaagtgtgaaagaatggttcaattatgttacagctacaaggaatgaagagctaaatctgcttcgtaatgttgatgctaacaacactgagaatagcactactgtgaagaattctagtttgttgagtggattcagaggaggttctagctacaaccatgaaacagagactatctttgcattaccaaggatgcagcttgac

SEQ ID NO: 11962 - DNA, 398 bp, Homo sapiens
  misc_feature 390: n = A,T,C or G
cgttgctgtcgcggcccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcggnggtccccg

SEQ ID NO: 11963 - DNA, 397 bp, Homo sapiens
  misc_feature 43: n = A,T,C or G
cgttgctgtcggaaagctctgtgttcttttgccttcaatctgntggcttcaaaacaaacaggcaaaaaaagcttcttgcgccgttccctcccctgaaaacttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattctctc

SEQ ID NO: 11964 - DNA, 394 bp, Homo sapiens
ggcacgagcaggcggcagaggttgcagtgagccaggatcgcgccactgcactccagcctcagcaatagagtgagactgtctcaaaaaaaaaaaaaaaaaaaccccccccattttcaaacaaccccggaaaatttttttcgggggcccttttaataaaaaaccacggggtttttacttttgtatttccccaaacccccttggggcagggtttggggggcggaattttttagggccctcaaaaaaatcctttggggtttgaaaaccgggaaaaccggggcattacccctttttgggaagggggcaaagcctttttttttttgggcctttctttttttgagaaggggtcttcccttgtcccccctgcttaaaaaccctggtgcaaacccgtgctaag

SEQ ID NO: 11965 - DNA, 397 bp, Homo sapiens
  misc_feature 356, 395: n = A,T,C or G
ccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagatttggatatgtgctattctttacttcagattgagagttgngaaaaactggagtaaataatgggtttcttacttgcttanaa

SEQ ID NO: 11966 - DNA, 400 bp, Homo sapiens
ggcacgagctctggggctacaggtgaggacaggagggggagctcccagcctgagagttgtgacgtgcagtctaatgaagactaccctcggaggcccctaaccagggccaggagcagactgtcccatgtactgctggtatctgagtcagaagtagccaaaacaaagccacgtcacgccatgaaacggaagcggacagcagataaatccactagtacaagtgatcctgtgatcgaggatgaccatgtgcaggttcttgtattaaaatccaagaatcttgttggagtcactatgaccaattgtggaatcacagatctagtgctaaaagactgtccaaagatgatgttcatccatgctaccaggtgcagggtactaaaacatttaaaggtagaaaatgcaccaa

SEQ ID NO: 11967 - DNA, 401 bp, Homo sapiens
ggcacgaggctatccctcctcctgttccttcctccagaggtagtctctgttacccttttatttgtttcttttatgggtttttttgctgtatttatacaaatcgatgcacaaagagggttctcttctctcataaaagtgattattagtcttcagtgcgcctttttttctcctaacaaatgtaaactgggagcattttcccaagtacatatttataatacttacggggcctatctagtattctgtgaatatatactgttaatttattccttcccattgacagacttaccttgtttccatgtattgccattataatcaatttgcaaagaaaattgctgaacccttgttttttcactagagatagacattttatataataagttgttgggataagcagttttgaa

SEQ ID NO: 11968 - DNA, 401 bp, Homo sapiens
gggccattacccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcatgccgtgagcgaggctgcgagtgccctgggcgccgtttctcacgcagtgaatgcttttccaggcctctgttgcttactgcaccacacctgggggggtgggagcgtcctctaggtgcccctagttctttgtcctgcctcccagagggaggaaaagcccc

SEQ ID NO: 11969 - DNA, 401 bp, Homo sapiens
cgttgctgtcggctgtctgtcagtggagatggtgttggctgtctgtcggtggagatggtgggggctgtctgtcggtggagatggtgggggctgtctgtcggtggagatggtgggggctgtctgtcagtggagatggtgcactctgactgctattattctacatttcactttgcactggtactagggactagatagaattgaccgggccattgaggataggctgcttctactacgccccctgtccactgggcagccacttttttagacaccaggtgtgcaccgggcgcatttcctcctccagcccgtcttaggatccccaccctgctgttgaagggggcccattcttcaacgcttcataagacacttgtccggagaaacctccgttcgggccgaaactgtcg

SEQ ID NO: 11970 - DNA, 395 bp, Homo sapiens
gccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcacacccaggctgccccttggattgttctacccaagcttttccctggggtctg

SEQ ID NO: 11971 - DNA, 390 bp, Homo sapiens
ggcacgagggtgtgtctgccacccgcccttctcaagtggagctctgggtcgagagagggagggggtgaattttgggctaaggagcctgctgatgtcacttttcttgtcttttcaattatctgtattggctttttgattgtcaaagtaaaaaaatgtgaagattacaggaatcatgtcctgataatagctacctcatatcaagccctcactatgtgccaggcaccttctggggacttggctgcagttgtctgttactcttcacacaagctcaatgaggcggtcctgttattaccatttttattttaagaatgaggagaatgcagcttcaagaaggtaagcaacttgccgaccgtcacacagcttagccgaggaagagccaggcttcacaca

SEQ ID NO: 11972 - DNA, 388 bp, Homo sapiens
cgttgctgtcggcagatcacttgaggtcaggagttccagaccagcctagccaacatggtgaaaccttgtctctactaaaactacacaaagtagccaggcgtgatggtgggcacctgtaatcccagctactcagggagcctgaggcaggagaattgcttgaacacagaaggtaggcattgcagtgagctgaaatcacctcattacactccagcctgggcaacagagcgagactccttcttaaaaaaaaaaaaaaaaaaaactccgggggccgttttttacgaaaatccaaactggataaaaaccttgggggagttgggacaacccccacctaaaaggcggggaaaaaaaggctttatttgggaaattggggaggctttggctttattga

SEQ ID NO: 11973 - DNA, 397 bp, Homo sapiens
ggcacgagcagaggtgggaggtgatgagactcaagactacagagagaagaaagggccggcagcccagatcccagccccacccctcctgccctgcattcaggcagagcacagagggataaagagggaggtgggttgggggacaaggcagagatgcatatacctgggacgtacacctgcgtggagcccagaaggaggcttctgtccgccacactgctagtccccagggcccccttgcaagtggacatcatgttaccccacatgcatgtgacttggccagaggagacagagtcttcatgtgaactggaaaaagatccccctctcccggtggatacatttgacaaacaaaaagtgggctggttttcagcccctgctcatctcattggcccaatacctgtgg

SEQ ID NO: 11974 - DNA, 390 bp, Homo sapiens
cgttgctgtcggccgcaggtgagcgccgcggtcccggcgagcaggtcgggtcagcccaggccagtaacctctgagttacgggaggagtgatcgctagggtccaccccggtcccggccagatctgccagctcccctctctggcgggtgttctggtgccaagtctgggagcccaggtagccctccgcagacagggcttctcggcacctcaatgaggacggacgttgatgaggccatgaatgagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagc

SEQ ID NO: 11975 - DNA, 403 bp, Homo sapiens
  misc_feature 403: n = A,T,C or G
cgttgctgtcggttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctn

SEQ ID NO: 11976 - DNA, 391 bp, Homo sapiens
ggacgagggggatgagagctgtttcgttcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcacaggagaacttcgatatggaggctttcactgagatgatggaggcctatgtgcctggcttcgcccacatccccaggggcacaataggggacatgatgcaaaagctctcagggcagctgagcgatgccaggaacaaagagaacctgcaaccgcagagctctggtgtccaaggtcagg

SEQ ID NO: 11977 - DNA, 396 bp, Homo sapiens
ggcacgaggcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccactttctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcacgccctgg

SEQ ID NO: 11978 - DNA, 402 bp, Homo sapiens
  misc_feature 402: n = A,T,C or G
ggcacgagcttcctctacagctacagctttcacatatgacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcacaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacn

SEQ ID NO: 11979 - DNA, 395 bp, Homo sapiens
ggcacgaggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacctgggtgga

SEQ ID NO: 11980 - DNA, 387 bp, Homo sapiens
ggcacgaggcggcgggcgcatctcccaccagagtcaggacaagaagattcacgtgtacggctattccatggtgagccgcagccccgtcccgccctgccggaggccccagtaccagcttcgaggcccacctgagcctgctgccctgacccgtggccccagctgagcacgcaggcttcctggggttctcccagggtcggcggcagagccctccctccagggcccattgtgttcctgcattcccccatggagcacacgccagacctgaggggtgggacggacacccccaggcatggccggctgtctcctctccctgccttgggaggccttgctgggctctagctgtcctccagcactttgggccctgggcccccagaggcagtcagtacc

SEQ ID NO: 11981 - DNA, 390 bp, Homo sapiens
  misc_feature 390: n = A,T,C or G
cgttgctgtcgatgctgtggccgaccatcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccacagtttgtgagagtgggggacctgccctgtgacagtgtggaggaccagctgtn

SEQ ID NO: 11982 - DNA, 401 bp, Homo sapiens
ggcacgagcagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccag

SEQ ID NO: 11983 - DNA, 398 bp, Homo sapiens
ggcacgagcagggcctcttcaacactggcttccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgg

SEQ ID NO: 11984 - DNA, 388 bp, Homo sapiens
ggcgccaggcgaacctcatgatctatatgatgatatccttctcaaacttgggggatgtgaaaactctggtactgaaggaaaagaccgcatatactgggccatcaatgacaagcactttgtggcccatatagctaactaccgatctcctggaagacggacccagcggcactattcaacctaccaacaccttatgtgttcaatttgtgactcacgtgcacatttatcagaaaacagtcccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgac

SEQ ID NO: 11985 - DNA, 397 bp, Homo sapiens
cgttgctgtcggaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccat

SEQ ID NO: 11986 - DNA, 395 bp, Homo sapiens
cgttgctgtcggtgggcttgctccattgtgttggtgcaaccccagcagcggtctctggggccaggcaggtgggtggacgattggacttggaggggaatacagagggcatggaagtggcgaggctggcctgttggcgagggtgtcctggtggtggggcgggctgagtcaaggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggcggcctggtcccttcttgccgagagagtgtcctgggtcacggacgcagaggacgctcactga

SEQ ID NO: 11987 - DNA, 399 bp, Homo sapiens
cgttgctgtcggtgggcttgctccagggttttggttcaaccccagcagcggtctctggggccaggcaggtgggtggacgattggacttggaggggaatacagagggcatggaagtggcgaggctggcctgttggcgagggtgtcctggtggtggggcgggctgagtcagggaaggactctgaaggtcccaagcagctgctgaggcccccaaggaagtggttccaaccttggacccctatgggtctggatttgctggttaacaagataacctgagggcaggaccccataggggaatgctacctcctgcccttccacctgccctggtgttcacggtggcctggtccctccttgccgagagagtgtcctgggtcagggacgcaaaggacgctcacagactcc

SEQ ID NO: 11988 - DNA, 400 bp, Homo sapiens
  misc_feature 317: n = A,T,C or G
cactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcangcctggggcatctgggcattgtaggggtgcagtggtatgtgcccacccctctcccattatcctttagctttaggccaagagcg

SEQ ID NO: 11989 - DNA, 389 bp, Homo sapiens
cgttgctgtcggcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacg

SEQ ID NO: 11990 - DNA, 382 bp, Homo sapiens
cgttgctgtcgccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatac

SEQ ID NO: 11991 - DNA, 394 bp, Homo sapiens
  misc_feature 394: n = A,T,C or G
ggcacgaggttaacagtgatgatgacagcgggctgctggtacactgtatctcaggctgggatcggacccccctcttcatctccctcctgcgcctttccttgggggctgatgggctcatccacacgtccctgaagcccactgagatcctctacctcactgaggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgactn

SEQ ID NO: 11992 - DNA, 384 bp, Homo sapiens
cgttgctgtcggtctgaatgccgcctgcatggcattggtggatgcaggtgtgcccatgcgggctctcttctgtggggtcgcctgcgccctggactctgatgggaccctcgtgctggatcctacatccaagcaagaaaaggtaggtgtgaagaccagggtggctgaagggcagaggccagacagctgcccgtcccttcctccaggcctcgcttctctacagacagtcggctcatgccacctcaatcccacttagcaagggctgctctaatcatcatggttcatttagcagcaagtgctggaaacccagctcagacttgcttaattaggaaggaaatgtggggccgggagcggtggctcacgcctgtaatcccagcactttgggag

SEQ ID NO: 11993 - DNA, 393 bp, Homo sapiens
  misc_feature 393: n = A,T,C or G
ggcacgaggaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggn

SEQ ID NO: 11994 - DNA, 400 bp, Homo sapiens
  misc_feature 303: n = A,T,C or G
cgttgctgtcgaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactanagtggtgccggagggagaagttggcacagcctgtgtatgaaacggttcaacgccctctagatcgcctgttctcctctattgtcaccgttgctgaacc

SEQ ID NO: 11995 - DNA, 403 bp, Homo sapiens
ggcacgaggttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagacaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattg

SEQ ID NO: 11996 - DNA, 400 bp, Homo sapiens
cgttgctgtcgctcactgcaacactcttgccttccaggttcaagagattcttgtgcctcagcctcccgagcagctgggagtacagacccctgcccccatacccggctaatttttgtagcaaattactcatttgtctgtctactttttattataaagattgtggcaactctgcttaggactctggatttttctgcccaattaaggtaaaaaaagaaaaaaaaaagcaaccaccaccataatattacccaggaaaccagctgtgttctgtaaaaggccggcctatcagattcaagttgcaagccttatacacagtaagtgtctcatgcacatatccatgaggattcacataagctgccatcggcccacataaggataaactaaaacaaagaatcaacatggt

SEQ ID NO: 11997 - DNA, 391 bp, Homo sapiens
  misc_feature 40, 324: n = A,T,C or G
ggcacgagggagcgtgggtgggacacggtgtctggtgtanacggggagcgtgggtgggacacggtgtctggtgtagacggggagcgtgggtgggacacggtgtctggtgtagacggggagcgtgggtgggacacggtgtctggtgtagacggggagcgtgggtgggacggtgtctggtgtagaccgggagcgtgggtgggacacggtgtctggtgtatacggtgagcgtgggtgggacacggtgtctgttgtagacggagagcgtgggtgggacggtgtctggtgtatactgggagcgtgggtgggacacggtgtctggtgtanaccgggagcgtgggtgggacacggtgtctggtgtataatggaatgggagtgtgtgtttgtgacatgg

SEQ ID NO: 11998 - DNA, 398 bp, Homo sapiens
ggcacgagcggtcgcggagctgcggccagttttgggagggccggccccgggatgctacacacaacccagctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgaca

SEQ ID NO: 11999 - DNA, 397 bp, Homo sapiens
ggcacgaggacaggaggaagaaacaagtataaaggttttggttttggaaagaagttggaatctccagaccctgggaccttaagatccacagaattgctgaaagaaaaagtactaccttattgaaaggatgaagaaacacgaaaagattatgattacatgctggatcatccagaagagtactacagccattactaccactactatagcaggcgcttggcccctaaggtggatgttagagtagtgattttggtcagcgtgtgtgctatttcggtgtttcagtttttcagctggtggaatagctacaataaggcaatcagctacctagccacagtgcccaagtaccgtatccaagctacagagattgccaagcagcagggactgctcaaaaaagccaaag

SEQ ID NO: 12000 - DNA, 403 bp, Homo sapiens
tcaattccgttgctgtcggcggcggccacagttggggccggtggctccggaacgagatcgggaagggaacagtccactaaccctgccgatagctatcatctggcccggaggagaaccctgcaagggggtgcgagctccttgctgacacaggcagggtttgagagtgccgaaaaagcatacgtggaaacgctgacagagatgctgcagagctacatttcagaaattgggagaagtgccaagtcttactgtgagcacacagccaggacccagcccacactgtccgatatcgtgggcacacttgttgagatgggtttcaatgtggacactctccctgcttatgcaaaacggtctcagaggatggacatcactgctcctccggtgaccaatcagccagtgacccccc

SEQ ID NO: 12001 - DNA, 394 bp, Homo sapiens
ggcacgagcccaaagtcaaacaaactgacttacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcc

SEQ ID NO: 12002 - DNA, 385 bp, Homo sapiens
cgttgctgtcggggaattcattcaagactttcataaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccc

SEQ ID NO: 12003 - DNA, 388 bp, Homo sapiens
  misc_feature 388: n = A,T,C or G
cgttgctgcctgaatgtattcgagcactatttgggggatgacacgactagggagcatccacctgtgtgcgacagctgtgataactatgacgctagagcctcatgcagatccaataacaccgccagtaaacagacgaaacatgccactgacctggatttaactgaacagggattaggccctatgataaatggcattgtctccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgn

SEQ ID NO: 12004 - DNA, 403 bp, Homo sapiens
aattcggcacgaggtagcatggagggggagaggacgtaggctgtgctctcgggctttgtgctcggcgcactcgctttccagcacctcaacacggactcggacacggaaggttttcttcttggggaagtaaaaggtgaagccaagaacagcattactgattcccaaatggatgatgttgaagctgtttatacaattgacattcagaaatatattccatgctatcagctttttagaatgtggtaggttggtacaaattccgtcgtcattcagatcagatcatgacgtttagagagaggctgcttcacaaaaacttgcaggagcatttttcaaaccaagaccttgtttttctgctattaacaccgagtataataacagaaagctgctctactcatcgactggaaca

SEQ ID NO: 12005 - DNA, 390 bp, Homo sapiens
cgttgctgtcgctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatc

SEQ ID NO: 12006 - DNA, 383 bp, Homo sapiens
cgttgctgtcggctggtgatagctgtgttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccatagg

SEQ ID NO: 12007 - DNA, 402 bp, Homo sapiens
ggcacgagcagacatggcggtgttggcggtgaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccgg

SEQ ID NO: 12008 - DNA, 381 bp, Homo sapiens
ggcacgagtgcacgcctgtgatcccagctacttgagaggctgaggcaggagaatcacttgaactcgggaggtggaagttgcagtgagctgagatcgtgccactgcacgatccgcctgagcgacagaatgagattccatctcaaaaaaaaaagtacttaatacctactttaaagattgtcatggaaatataaagtatgtggcccttactaatgctagataatgctttgctttcttttatttgcatcttaccctcttccgtgagtattgatactgtcttaaacatagtagggtttgattagatatttgctggttgccccttcacttgcaggggatacatacaaatgttggttggtattggataatgaatatgatgtttctaaa

SEQ ID NO: 12009 - DNA, 367 bp, Homo sapiens
ggcacgaggagctttgtcaaaatacctggcctctagttctgagattttattattgttcattagaccagtgctagggcatgaatgttttgtgtttatcttttttttttttaacctttattttaaggttaagggaaccccagaagggttggtcccataggaaacctggggccacaggaattggtggaccatttaattcctccccccggggggaagccccagccctaaaaaggaattttttgggcccttttcctttccccccccttcccctttaaaaaaaaccccagggccaatggttccttttttggggccaaaaagtcttaacatttccctccccctaaaaagggaaaccagcgcggagtgaattttg

SEQ ID NO: 12010 - DNA, 363 bp, Homo sapiens
ggcacgagatagggtagtcttgactagatataaccaagggataaaagaggattagctgactcaggataacatttcaggtttgtgaagatgaatttgtcctttgaaacagatctttttagaaagggtgtttcataatttctgaccgaagtatttgttacacgtaaaataagtaagaacggactgaggccagaaagctgtggatgacagaagggattggtgcattctcagtgaattttgatacaaattaagtatgtgggtagtttttaaatacatttactatatatatatattaatgaaaaattgtttcctaaactgtgaaaaggcttattaaagaaatttagaggctggatgcggtgactcatg

SEQ ID NO: 12011 - DNA, 380 bp, Homo sapiens
ctttgatccttctggaattaattttggtgcattgactgaggtaggggctcacgtttccttcccgatgtcagccactacttttggtcttttaatctataaaagcagggcactgggttagaatttcctaaatctcttatatatcaaacaaagcactcactgcaaacttgatcaatagaggaaagtatgctttttttgtattttaccttttaccagtttcacttactgtaaatcataaggttgtcttacatagtagaaaaatagcattatcttaaacctggctttttattactaaatatatcactaaaaatgctttacaaagcagtaatgattttatttcttggggaataaaatcaagaaagctaaaggagctgctatgccac

SEQ ID NO: 12012 - DNA, 375 bp, Homo sapiens
ggcacgagacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctca

SEQ ID NO: 12013 - DNA, 369 bp, Homo sapiens
ccgttgctgtcgggctgaggacttatctggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaacagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatt

SEQ ID NO: 12014 - DNA, 377 bp, Homo sapiens
  misc_feature 377: n = A,T,C or G
cgttgctgtcggccacgaacacagccttgggcccaaggtgatgcgcgccgctcttgagtccctcagatgccaaacgcaaaaaaaagccttctcctctaaagacacggaaatgcaccgagtccggctctgcctcacccccaaatccttccggtcccccaactcggcagccaaaatcgaaaactactctcgtctcagcgcccccgctgttgattacctgccattccgcacgggcgcctgcgccccggccgctgtcgccgacttaggacggcatcccgagactacccttctcaaggccgtatgaccagtccgagctgccatgatagactctccgaagccggtcgtcacctgccggaccagccctgcagcaccgtcctccn

SEQ ID NO: 12015 - DNA, 372 bp, Homo sapiens
cgttgctgtcggccacgaacacagccttgggcccaaggtgatgcgcgccgctcttgagtccctcagatgccaaacgcaaaaaaaagccttctcctctaaagacacggaaatgcaccgagtccggctctgcctcacccccaaatccttccggtcccccaactcggcagccaaaatcgaaaactactctcgtctcagcgcccccgctgttgattacctgccattccgcacgggcgcctgcgccccggccgctgtcgccgacttcggacggcatcccgagactacccttctcaaggccgtatgaccagtccgagctgccatgatagactctccgaagccggtcgtcacctcccggaccagccctgcagcaccgcc

SEQ ID NO: 12016 - DNA, 148 bp, Homo sapiens
  misc_feature 4: n = A,T,C or G
ctangaaagaccccttcctcttgcagtgtgtctccagcgccctctactgacaaagtatgccatcatgcaagctgcaaaggaaacatttcaagagtctatatctattttcacggagcgggcaccaacagtgaatgtggagctgagagag

SEQ ID NO: 12017 - DNA, 379 bp, Homo sapiens
ggcacgagagaatgcctccaggctggtcattccatgtgactagtgcagggttgcatgggagaggatagctgatgaacccagattgtgaaaggctttgtggctcgtgctgaggattgtgggcttaactctgggtattgtggagctgttaaaacacatattaaggagtgcagtgatcagattttcctttttaaagtgcattctgtggagcagtaattcttagctatggagtccaccacaaactttgtcatgataggttgtgaggtatattaagtatatgttaccaataataaaatatcagggcttacacattaattgattttttaataagttaaagcaagttgaggttatcactgtgattttcttcattcacttacatcct

SEQ ID NO: 12018 - DNA, 375 bp, Homo sapiens
ggcacgagatacattttatatttggaaggttgtccaagggcaggtgggagcagtatagtatatgcatgctcaggcagggctagagtttgacctcaccacctcaccagtcatattagagtagctgtccagacaaggtgtgggacacaatttcttatcagaccaacaacctgcaaagcagtcctcagtcctcatttccctcctgcttgtgaccagctatcaaaacctcaactctggctaaatccagcaatccgcctaggttgctgagcactgctagagacaaatcatacaactatgcaaatcagtgttactatatgatcactaacctcgtatgaaccttcactgtgcttgcaacatcagctcccattcctaccactt

SEQ ID NO: 12019 - DNA, 371 bp, Homo sapiens
cgattcgaattccgctgctgccgaaaacttctggtattttacccacgaagaacttcacgggtccagtggatttgcccttatggccgagtgtccatacacactccaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttcccca

SEQ ID NO: 12020 - DNA, 373 bp, Homo sapiens
tccgttgctgtcggtttccttgttggattttcttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctat

SEQ ID NO: 12021 - DNA, 381 bp, Homo sapiens
cgttgctgtcgaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagaccacaaccatcgcagatggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagccatgcctcctgttgcctgcaggccagaagcaaggtc

SEQ ID NO: 12022 - DNA, 362 bp, Homo sapiens
ggaccaagacaaagttaagtaaactctggagcagtgtatgtgatgagtgtgtggcagggggttttttattctcgcaaattttgtgtacgtttgaagctaccacagaatagcagatattagaatgattcctgctgactcaccagtgatttcaactgttcacaggggtcaggcaggaagcagatctcttgccctccctctgatccaggtcacttagtccagcccctgaaagcagtggatggacaaccatgccaccctctttcttccaatacaccttattttgtatcctgccctttttgtgtagcattagatcatgagcattttcctctgctataaatgtcccctcaaatatgttgattcttgtg

SEQ ID NO: 12023 - DNA, 375 bp, Homo sapiens
cgttgctgtcggtcttgggagaaggaagcctttcctttttggcagaagtttcaaatggttcttatttcttgtctcactaaggcagtaatagcatagtgatggacctggttgggtagtgggggacagctgaaaaggcaggagttttacttttgtttgaaaagagaccacatcacatatagcatctcaccattcacaaagtgtacatccaccgatactactccactgttagagccttcgtcctcctatggcagtagtataagaaaccttccaccaagtcagagtgctctaactgatgccaaacctaaacctggaaataaagattttcctggagcagtaagacttcagactgttggttgagctattatctcaaggtag

SEQ ID NO: 12024 - DNA, 367 bp, Homo sapiens
  misc_feature 367: n = A,T,C or G
ggcacgaggccgatggaggaggggaggtctgagcagagttcggtgtgcaggcgtaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggagggcataatggctgccctgctgggtgctcatgtgactatcacggatcgaacagtagcattagaatttcttaaatcn

SEQ ID NO: 12025 - DNA, 375 bp, Homo sapiens
  misc_feature 375: n = A,T,C or G
acgggacgagggctcttgctggtcccatgttgcctgccctccgaggagcctcgccaggcagcagctgccgcctcatcaggcgagaccccccaccaggttgggcaaacccagggtcccatattcggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtgttccccagtctccatatgcagctn

SEQ ID NO: 12026 - DNA, 370 bp, Homo sapiens
cagggctgtcggaacactggagttttgcttagctacctactcatcgccaaacatgaactgccctctggcatagagtggtgtaatgcgaaaggaagagacattgtcagcctggctcgaggatggccgcgttctgggggagagagttacctttggcctaaatctccctctgtgtctcttgaagaacttacggtatcttgcctatactagtggatgttccttgagctgtgtggtatgtttcctaattgtgggtatttacaagaaatttcaaattccctgcattgttccagagctaaattcaacaataagtgctaattcaacaaatgctgacacgtgtacgccaaaatatgttaccttcaattcaaagaccgtg

SEQ ID NO: 12027 - DNA, 381 bp, Homo sapiens
cgttgctgtcggcaggatgatgggcaggacagggagaggctgacctacttccagaacctgcctgagtctctgacttccctcctggggctgatgaccacggccaacaaccccgatgtgatgattcctgcgtattccaagaaccgggcctatgccatcttcttcatagccttcactgtgataggaagcctgtttctgatgaacctgctgacagccatcatctacagtcagttccggggctacctgatgcacccgccgaggcccgagtaccagactccgtttctgcagagcgcccagttcctcttcggccactactactttgactacctggggaaccttatcgacctggcaaacctggtgcccatttgcgtgatctctccaccg

SEQ ID NO: 12028 - DNA, 377 bp, Homo sapiens
ggcacgagctgaagcgcttcctgcttaccaagttgcctccatatctaatcttttgtatcaagagattcactaagaacaacttctttgttgagaagaatccaactattgtcaatttccctattacaaatgcggatctgagagaatacttgtctgaagaagtacaagcagtacacaagaataccacctatgacctcattgccaacatcgtgcatgacggcgagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaacc

SEQ ID NO: 12029 - DNA, 143 bp, Homo sapiens
tcaagttacaaaagctctggaaccctgtggcttcaaatcctttgggaagggtgactgttgtttcccctacacacagtgtaagccggaatgggaatcgctgaggctctgatccacttctaagaacagaaggaaagtgaaggcag

SEQ ID NO: 12030 - DNA, 354 bp, Homo sapiens
tttcttgtgctagaagacaaccgaattgttttggctaagaaacactaatctagctgaattcccacacactcaaaaatattttctaccaaaccccaaatcaattgatgtctccattctacatggctgtctccaatgtcaggaaactcactatattccaaaattccatttgttgtcgaagagaatcattatagagagaccccttcatgtgacctgcgacctgcgatatttaatttcatttaaaagacagacacacagggaaatatatagctgagagatgctttcattaatagagaatcctgggaacccttgagtaatcacattttgaccaactctagtgaatagaccatttccctt

SEQ ID NO: 12031 - DNA, 332 bp, Homo sapiens
  misc_feature 330: n = A,T,C or G
tacggctgcgagaaacgacagaaggggagaggagggctgcagatgatgacttggttttgcctggattgagtctgggatggggatgagacatcatgtttaaatggtcttatagggagtaggaaagaggctaaaacctcaagagatagaggaaattcaagtacaggattaagttgaacaaaagtgataaccaaccccacaaggtgatttttatttcgtaacctcagtggggaaatcttcggtgcagggcagtggtcctcatttggggtgatttttgtctcccaagggacatttggcaaagtctagaaatatttttggttgtcacaactcggngg

SEQ ID NO: 12032 - DNA, 337 bp, Homo sapiens
ttttcggctgccagattacgacagaagggaaacctttaaagtctttgagtttcgaaggacaaactttgggatttccctggttaaactcaaagtgactgtgtgacagaaggggtggattagctatattctttgctgtatttttataactaaagctacaatgattagggaagttgcaatgtcaaatcaatattctctcatttgtctaccagaaagcagtcttactagaaatgcacatacataagatttttgatttggttccagttgacacttgatgtgtcaagtaccaggcagtaaaatgcagatccagtaacatttctttttcttttgtggctagctg

SEQ ID NO: 12033 - DNA, 337 bp, Homo sapiens
tacggtgcgagaagacgacagaagggataaacaaatttttttaaataaatgagagatagctaagggtttttaaaaattattatatctacattatgagaagaaggcctttattgtccttggaggtatgcatttccagaccccttacttaagagctcctggaatgtggttctgcttgacagagttctgtattagcacttggataccagaggcagcaccacaatcaagctgccaggccagagaatgtttcctttccaaactcagctgccctcttgcacttaatctaattgggtagtgatagaaaagtacagttgttactaaaacactcttttgcctggag

SEQ ID NO: 12034 - DNA, 222 bp, Homo sapiens
ctgaaagttttgaatttgattaaagttattcatgtcttgttaatctctgcaacatttgtagttgcgtttttctccttttgtctttgaagaattttgcccgatttttttcctagtagttttcaaagaaccagcttgtagcttgagtgatactggtgttttctagctcatcatcggattttctgctcttccccgtccagctgcttaaagtaatttttaagctca

SEQ ID NO: 12035 - DNA, 462 bp, Homo sapiens
cgttgctgtcgaggatatgctgttgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaaccaaggtaattaagaggtgctcccactgcacttgtactcagaaggctgaggtaagattgttagaggccagcctgggcaccacagggagaccccatctctaaaatttagccaggaaccatggctcatgcctgtagccccaggaatttgggaggctgagtggggaggatcg

SEQ ID NO: 12036 - DNA, 454 bp, Homo sapiens
  misc_feature 17, 19, 20, 22, 23, 25, 26, 27, 28, 29: n = A,T,C or G
cattacgtcagcaacgncnncnngnnnnngatcccatcgactcgaattccgttgctgtcgaaataaatgactggatggtcgcttctttttaagtttcaaattgacattccagacaagcggtgcctgagcccgtgcctgtcttcagatcttcacagcacagttcctgggaaggtggagccaccagcctctccctgccctagcagatgctaatccaccgtgcgtcctggcagaggttgaagggggctcctcaagtcccaggtccagcttggtgtggttcagctactcgagagacatctgctgctaatggatgagcagtcaacctggacgcaggaaatcattttttatttggggcaaagaggcagaggaatggagctcagagcttttagagaatatgggccagaaacaggaaggagtcacgacctgataacgggaaccagcggacagtgaacgcagt

SEQ ID NO: 12037 - DNA, 442 bp, Homo sapiens
  misc_feature 349: n = A,T,C or G
cgttgctgtcggatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggncgcttcccccgctcctccatcaccctcagccttcacacttcaaagttcaagttcaaagctgttcaagtttcctaccagcaaagagccctaact

SEQ ID NO: 12038 - DNA, 436 bp, Homo sapiens
cgttgctgtcggatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaagagcc

SEQ ID NO: 12039 - DNA, 434 bp, Homo sapiens
cgttgctgtcgaaagttatcaagtaaatatgtcctctgtgttctgtttcatgtgatggagggggtttcagtctgtgttcttggagccaaagggttcctcaagggtgcctcaagagtaatggtttaagaaaagaggggcaatgagagggagcgagggggaaggcctagttggtatttgagcaggggccttaagctccatatccccaccccctttacccaaaacagcccatttttcttatgtatattggaatttcaagtaagctttcatggggtgcagtggggcggggaggaatggatgggataaaaaaagtggagattttgctgctttaaaaaagttgagaactacttgtgtaggttttaaggattttaatgtatttcattttggcaaattcaactgccacaaagcagctatgcataagtgtaactgtgcagtgg

SEQ ID NO: 12040 - DNA, 434 bp, Homo sapiens
  misc_feature 6, 352: n = A,T,C or G
tcgttnaattcggcacgaggatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttanatggtgctaaccacaggtgtcccagggtgctctgtgccagttaagatttttaactttcaaggggcagggcatactgggaaat

SEQ ID NO: 12041 - DNA, 431 bp, Homo sapiens
tctcatgggctgcctgggaccagcaactcgaatagcatctgatttgggagccaaaggcagggctcctgagacagcagggatggtgtcctctctatctcacctaagctactggctacagccactgccaacgggcatgggctgaaagggaacgacgagagcgctggccttgacaggaggggcttcagcagctccagcccagagcactcgggcagcatcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgg

SEQ ID NO: 12042 - DNA, 423 bp, Homo sapiens
  misc_feature 423: n = A,T,C or G
ggcacgagattttcttaacttgaaattttctactagccctggtgaacttctgtgcttaaaaaaaaaaaaaaaaaaggggaaaatttcactttaaaaacttttgttaacagcaggggacccttgttattttcaggtcccccaccccccaaaaaaggggggggtttgctccctttaaaggggtgggaagccctaattttttttaaaaaaacagtgcccacactttcccaaacccaaaaggggggaaagggcggcccttttgaaaaaatgcggaacccctttataattttttcaaggggaaccaaaaaaatttaaaatgtattaaaaagtgaaccccgccccctttgaaacctaaaaaaaagttttaatggtgactttttaccaaagcggggggcctaaaacctaataacccaccgctttggaagn

SEQ ID NO: 12043 - DNA, 170 bp, Homo sapiens
  misc_feature 1, 5, 8: n = A,T,C or G
ngaangancgcgagaatgcagttccgcggcagaaacctctgtagaggagcaggatgcaaccgacaggctgtggccggacagctgctgcccagcacatggagcctgcacgcgcacagtttggccaaagaagcccccatactcccggtgaaaaagatggagtcttgctctgt

SEQ ID NO: 12044 - DNA, 424 bp, Homo sapiens
cgatgctgtcgccctcagctccctgccttcaaacctaccttacagacctgcctggcctgcacctgagccaccctcttcttccttcctattcccactaaggaggtgtccctgcttccttcatagtgggtccttcccctgcaccgggaaacaggccctagagatgactccatggggtgaaggaccagagcctccttgcctctctctctgtctctctctccctctcttgtcttcccatgaagctctgatgtttccagtacaaaataaacctcgctcagtcccagtccttctccagttcctcccctcacaagcatggccccccactgctggctttccttccccaccttccaccctctccttggccttctccactctggcttcagtggcctccgatggctacactcaaagcctgggtgcactggccttt

SEQ ID NO: 12045 - DNA, 424 bp, Homo sapiens
ggcacgaggccttcacagccagaagaggttgtgaagggataaacacttctgagagtgggtggtagtagaactgagtattcaagactgaatgttaggcaggtagacagtgactggttaggctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagg

SEQ ID NO: 12046 - DNA, 423 bp, Homo sapiens
tctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggc

SEQ ID NO: 12047 - DNA, 426 bp, Homo sapiens
ggcacgagcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggc

SEQ ID NO: 12048 - DNA, 424 bp, Homo sapiens
  misc_feature 424: n = A,T,C or G
ggcacgaggccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccn

SEQ ID NO: 12049 - DNA, 428 bp, Homo sapiens
  misc_feature 17, 21: n = A,T,C or G
ggaccggacaaaccgantttnttgaggagcccatcgcactcaattccgttgctgtcggtcttacagagccatgatagaactgtggttagtgagttaaaattcctggagaagctactgtttttctcctttgaaacttaggtttctaaagttgcacctaaggaatctgtcacattttctgttgaatcatggattttgtttttgtttttaacagacattccttctgataccgacttgaaaattagcgtatggtgacctgtgtttaaaaaaaaaagtacaatacacctacatatagctatatagcttaatgagacttccaccccccccccccttttttttggattgccgttgtgtaaataaccgggggctggccacatttaaggcttaaaaatttttaaattttgtggctgatgatagcaaacacccctgtg

SEQ ID NO: 12050 - DNA, 424 bp, Homo sapiens
cgttctttatgcggagcccgtcgaggtcgaattccgttgctgtcgctcccacctccccccccaacatccttgtccggacccacttcatctctcgcggagggagaagtccacagaaacctggaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccgatggaaggctgaggaattttcgagaaagggcccaggaccatctggtagctaggacggaggggaccaggttttcttttttaaacatccaccaccaattgctctcaacctgtaccgggtaagcatcagaccctgcgagtggttgtttt

SEQ ID NO: 12051 - DNA, 427 bp, Homo sapiens
  misc_feature 401: n = A,T,C or G
ggcacgagccgtgcagcgctcccgcgagacgctcacctgcgccccaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccagcgctgtggagcctgtgtgcggngatgcagcccctgcctgtctactgag

SEQ ID NO: 12052 - DNA, 427 bp, Homo sapiens
cgagctttttgcaggacctcgatcgattcgaattcggcacgagctaattatgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgct

SEQ ID NO: 12053 - DNA, 427 bp, Homo sapiens
cgttgctgtcgcaatccttcagatcatccttgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtacc

SEQ ID NO: 12054 - DNA, 429 bp, Homo sapiens
ggcacgaggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctctgctgacggagggcatgtctggccgggagatcgctcaactggccgcgtccttgcaggccacggcgtatgcc

SEQ ID NO: 12055 - DNA, 417 bp, Homo sapiens
ggcacgagagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctgggcttgaactcctgaccctgtgatccgaccaccttggcctcccaaagtgctgggattacaggtg

SEQ ID NO: 12056 - DNA, 417 bp, Homo sapiens
ctggaatcccagctattagggaggctgaggcaggagaattgtgtgaacccaggaggcacaggttgcagggagcctagattgtgccactgcctgggcaacagtgagaacctgtctacaaaaaaaaaagggcatcgggatttttttatacaaccttaaaccaccttttttagctttaggcgcctgcggtggcccttggatctgttctcaatcctcagggggggtggcagcatgggaccatagagagctgggcaaagttcactttctctttgctgacagtctcaccttttctcactgggaagctgcacaggagcctttgggctggttcagcccagaggcccctggcttcctgccttcctggaattctatgctccccttctgaatgggacccctctactcctgccaagttagaatggagca

SEQ ID NO: 12057 - DNA, 419 bp, Homo sapiens
ggcacgaggagagaactgctctcgagattagttctctcgaactagtctcgagagcagagaggggatttttttttattctttgttggttttttactatcccctttttttttgctttgttttttttgctttattccccacccccgtggttctttttttttgggggggggaaaaaaaacttcttttaataagataacaaacttttttttttttttaaaaagatccccgcccagggtagggggggggggttttcaaaaaaaaaaaaaaaaacccccccccttaaaaaaaccttttcttccccggcaaaaaaaaaaaaaaaaaaaaacctcccttttttggaaaacgggggggggggggggggaatttttttaaaaaaaaaaaaattgtggggcgcccccctcttttttttttaaagggggggt

SEQ ID NO: 12058 - DNA, 417 bp, Homo sapiens
  misc_feature 402: n = A,T,C or G
ggcacgagacgaaaggaaaccttacagaatcatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattggcaatttcctgattctttttgattaggattccagatgggggcctcatttctacagcccccaacatttctatangccgtatcactggcc

SEQ ID NO: 12059 - DNA, 418 bp, Homo sapiens
atcggcacgagggtagcttggaccttgtgtgccaacgcttactcacggctgcgcctaacagccttcactgcctgggctcactcagggagcgcctcattatttgggcagccatggattctatcccagccccatcatcagttcaaggacacaacctgactgaagatgcctgacatcctgagagttggcagaacacaggaggctattctgaaggagatgcaccatcacagccacagaaggcactagaggaggtgtcaatgtcagatccactggcaagccaccaaagaccgtcactcccaggatcctcacaggagcacatggcgcagtgcgaagtgagacgccagacccatgttccaaacagagaacctgtgcatgcactgccttcctctgccagccagaaacgtgtggaccagaaacgttg

SEQ ID NO: 12060 - DNA, 421 bp, Homo sapiens
  misc_feature 54: n = A,T,C or G
ggcacgagcgccactgcactccagcctgggcgacagagtgagactctgtctcanaaaaaaaaaaaaaaaggaaaaaaaacctttgggccagccttgtcccaaaccaaaaaacttcaacccgggggggggggccttttttaatttaatgaaaagtttggaaagggaaaaacccttggaaaagcccaccccggcccctttcccaaaagaatttgggggtttcaagggaacaacttctggaaaaattgaccaggaaaaaccggataaccccaaccagtttttttaaaccgggttttggaacctaaaatttggaaaagggaaccccaggcccataaaccaaaaccggggcctttaaaaaggacaaaatttccaccccagaaaaggtccaacccaattccaggctttctcgaaaaaaaaatttcat

SEQ ID NO: 12061 - DNA, 422 bp, Homo sapiens
ggcacgaggaaaaactcaaaagcttgtcactgcagcttcagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaacgcaaatgaagggaaaaaagaaacatgggatacagcagaagaagactctggaacg

SEQ ID NO: 12062 - DNA, 417 bp, Homo sapiens
ggcacgagaataaattgtggaactgaagtggattaattcagcacatttttgtgatcctcctatttgtctttggggatctcggtatggctttgtaagacatgagtaagcaagtctctccctgacccaagagtgcaggtcatgttgtatatggctctgtctgttcccatagcctggaggtattcccgaaagtctttacctaagttgcctctatttcaccatccatcccatagaggagtgagcagctcatggctgagtggtccccagcagtggaggaagcagaaatcattaggacccttgcaaaggaaaaaccttctaaagagaaggctgtgcggtgagcagcagccatgggcccaagcctcgcccttctcaccagccacgtggcgcctgctgccgggacgcatccacgggtaaggggtt

SEQ ID NO: 12063 - DNA, 417 bp, Homo sapiens
ccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagatttt

SEQ ID NO: 12064 - DNA, 419 bp, Homo sapiens
ccgaattcaccccgaactgctggccaaaaagttagttaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaagg

SEQ ID NO: 12065 - DNA, 418 bp, Homo sapiens
tttgcagatcccctcgattcgaattccgttgctgtcggcaacttgaccgaagatttagaagagaatttagaaagcacagtctatgatgagtataaatttggcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagctaaagaaaatgccaaaagttaacaaagagctggcacttaaattaatcgatggagaagaggagaagcagaaatctacatggcaaaagagagttaacaaccttcctaacattctcaccg

SEQ ID NO: 12066 - DNA, 422 bp, Homo sapiens
  misc_feature 366: n = A,T,C or G
ggcacgaggagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattntatgacagtcaaacatgggaaaacattcttaaggataggatgggatctgcactgat

SEQ ID NO: 12067 - DNA, 413 bp, Homo sapiens
  misc_feature 36: n = A,T,C or G
gtccgatgctgtcgctgtcgtttaggctttagtgcnagagcacgagcttggctcacgtgcaacctccgcctcctgggttaaagagattctctcagctcagtctcccaggtagctgggattacaggcatgtgccaccacaccccgctaatttttgtatttttagtagagacggggtttcaccatgttggccaggctggtctcaaattcttgatctcaagtgatctgtccgccccggcctcccaaagggctgggttgggattacaggcgtgagccaccgcgtgcgggtcaggacccagttttggctgctggctcccagcacgggactcgggggatatacagtggctgcaccaaattgtaggtgtgggttcctccaattcccttaatgttagcgggatatacagatgctagaacaa

SEQ ID NO: 12068 - DNA, 415 bp, Homo sapiens
ggcacgagccagctacactggaggctgagtcaggagaatcacttgaacgtgggaggcagaggttgcagtgagtggagatcgcaccactgccctccagcctaggtgacagaatgagactctatctcaaaaaaaaaaaaaaagggatttcggggggggggggctcttatgggggcccaaccccatggatacccggtaaaattttaggaaaaaaacaaaggaagaccccgcccccaaaacccttttggcccccctccttctttaaaacccagttttttcagttgtggaaaaaagagctccccttgagtcggtggcaaaccgtttattttttaaaagcccccaccttttttttaaaaaattcttttggaaacggccaggagtaaaaccaggggtggaaataagaaaagggctccctaaa

SEQ ID NO: 12069 - DNA, 411 bp, Homo sapiens
ggtgtcttgaactctggcactgtacagtgaaagtgtctgtagttgtgttagtttgcattaagcatgtgtaacattgaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtc

SEQ ID NO: 12070 - DNA, 416 bp, Homo sapiens
cgttgctgtcggcatgggtttgtagatttctgaaacttagaggtcatttagctaaaatctacattttttttaacttttaatatgattgaaatgatattttacactgtatcacagatacagtattttatataactttttgtaactgaccttatcttggccttgagtcccatcctctctggtggtagcgtaaaactgaaaattccagtttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattg

SEQ ID NO: 12071 - DNA, 411 bp, Homo sapiens
  misc_feature 399, 411: n = A,T,C or G
ggcacgaggtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagcgctgggattataggcgtgagccactgcgcccagccttacttatttttaaatcagattttttaatcaactaaaacagctatgagttaagtacctgccctgcaaaaatttttagaagaagttctaggattatgaaattaagaattattttccttaactggaacagttctaanatttatctgatn

SEQ ID NO: 12072 - DNA, 411 bp, Homo sapiens
tctaggatcctatcgatacgaattccgttgctgtcggttttagtagatatatctgatagttcagtaattaattcacctagttgtattagctcatactcatacaccacacacgctggccaaaacccattgcagcaaatgtgggcaacaaaaaaaatcagctttcaactggggagagccaccttgcaaaagtgattgttcctggtaagtcctctcaagaattgaaagatatcatgccttgcctctgaacaatgcaaggaaagaggcttgctgctgaacatagacagtaaagtctaaacattttatagccttagataatggtttctttgggaaagaccttaaaataggagttactggggaatgtttattaataatcacgtagtgctgagaaggaggatgtcttaaaaaccagac

SEQ ID NO: 12073 - DNA, 415 bp, Homo sapiens
  misc_feature 1, 4: n = A,T,C or G
nggnggagcagacgcgtgagatcaaagtggccgggaccaaagcggacagggtccaacgtgccagcactgccaagagaaggccttttgtactcaggttaaataagaacatcctgcaaggagtctgttcttttatgcagcctaaagatcaagtaataatcattgacactgatactgagcatgtcgattttgaagagactagcatttcctggtaatgaagtggagtatatatccatatatttctgttttctggatgagaagactaacctaactaagtaggaaccttgaagaatcatgttcttcctaggaattacaaatcccccgaatccatgtctaacataatttctactggcctctttgcttctcatgctttagtaccagggcttctgaatttgaaagtcttcatgcaaattgcccc

SEQ ID NO: 12074 - DNA, 413 bp, Homo sapiens
  misc_feature 397: n = A,T,C or G
ctgctgaatagccccttctcacgacgtcccgcagcgttttacaggtcatgcatgaaggagtggttgggttggcttgagttctttcttatcctcacagttgaaggcacgtttaatgcttggagggtgagaagaagctgcaggaaggtggttggtatattggaagaaatttttttgcagtcattaaaaaatgtagagcatatctaatgatagagaaaatgtttattccacagtaataagaatttgcatatacagggtgattataatcctgcaaaataaaaaatttattgggataataaaagactgacaggaaaatttttaaagtgttaacattggttatgtttgggttggtgaggctgggtgatttttagaaatttacaacagagagaagttgtggganaaagtatacgttagtt

SEQ ID NO: 12075 - DNA, 414 bp, Homo sapiens
ggcacgagcagaagaacatctattatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacag

SEQ ID NO: 12076 - DNA, 415 bp, Homo sapiens
cggcacgagcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagacgcta

SEQ ID NO: 12077 - DNA, 413 bp, Homo sapiens
  misc_feature 413: n = A,T,C or G
tctatgttgactgtattgtgttagaagcacattatcacttcgtcacaatgcccgacccccaccccagtaattatccagacgcatggcccacctggcacacaggaaatggtagagctggaatgatgggactcctctcacaaatgtattcttcctttcctcctttcccgaccatcctttgctatgtacatggggggtttctaccaggtccagtagagcacaacacgacttaactcaggccttgaactgtgtttggttggttttctttgattgaattattctcagaagggctgtgttgccaggccctgtgggttgatcatgtgaccgcctttctgacaaaatgtctgccgccatctttatttgcaggctaatggaagtgctaagaaatctggtggggactttaagcctacttcccn

SEQ ID NO: 12078 - DNA, 416 bp, Homo sapiens
ctgcagccaagttcttagggttccgtaagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactc

SEQ ID NO: 12079 - DNA, 412 bp, Homo sapiens
ggcacgaggtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagc

SEQ ID NO: 12080 - DNA, 412 bp, Homo sapiens
cgttgctgtcgacagcggtggtctcatttctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctg

SEQ ID NO: 12081 - DNA, 411 bp, Homo sapiens
ggcacgagaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcc

SEQ ID NO: 12082 - DNA, 415 bp, Homo sapiens
ggcaacagcctgggtttgagccacaaagcctttagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgaggaaaagagtcctttgaatatctccgtaggagttcaccccctggactcctt

SEQ ID NO: 12083 - DNA, 412 bp, Homo sapiens
cgcacgagaaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagt

SEQ ID NO: 12084 - DNA, 407 bp, Homo sapiens
  misc_feature 403: n = A,T,C or G
ggcacgaggagatgtgatgtatgctttataaggctcatcagccatgcgagagcagcgatggtggcccaggccccgactgtaggagctgaaagacaggcgaccacaccacattacaggagggtgagaggaacggatgcggagaggttctgaacttgtaggtcaaaatgtgaaattcgaaagaatacccaaaaaacctaagaaaattttgtaaaggaaaatagatttattattaagcacatgaaaagatgcccaacatcagtagccatcagggagatgccaatcaaaaccacaatgagataccacctcacacctggggctgtcagaaaaaaggcagtaacaagtattcgcaaggatgtggagacactggaactcttccacactgttgatgggaatgtaaaatggngcag

SEQ ID NO: 12085 - DNA, 405 bp, Homo sapiens
  misc_feature 405: n = A,T,C or G
ggcaccagatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatn

SEQ ID NO: 12086 - DNA, 408 bp, Homo sapiens
  misc_feature 1: n = A,T,C or G
ncttctaattccgcacgaggagagagagagagttagagtttgagagagagagagagagagagagagagagagagagagagagagagagagagagagagagagtgcgagagttagacccagagagagagggggtgtttgctcttgattgcccccgcccctccctctctttgggatttttttttttcttttttttccgagctcttgacttttttttttctgttgccgccccctttatcgttttctctttttttactctttacctttttttttttttctgcgcgcacactttttttttatcccttttttttctctccctccctttttgggtgcctctctttttttatttatatatttgtgtgcacgattttgtgcgcgttttttttttttttttttgtcctctctctctgt

SEQ ID NO: 12087 - DNA, 408 bp, Homo sapiens
ggcacgagggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttcttatacttgaagttgcttttacgatattattttggtggctttcttttctctctttgatgggcaatagaggaagtagataatgggatt

SEQ ID NO: 12088 - DNA, 405 bp, Homo sapiens
  misc_feature 14, 16, 17: n = A,T,C or G
ggcacgagctcagnanncctctttcaactctagtttttgaggtggggacacaggaggtccagtgggacacagccactccccaaagagtaaggagcttccatgcttcattccctggcataaaaagtgctcaaacacaccagagggggcaggcaccagccagggtatgatggctactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagttaaggttcttgtggtttacccatctgaaatatgtttccatcaca

SEQ ID NO: 12089 - DNA, 408 bp, Homo sapiens
cgttgctgtcggcatcttttatgtacacatgtctattcagactttatcctcatgatttcagaaaaaatatagagagggtcctagactgcttaatagaggaaagaagtatcctggaaagcttgttaagaacgttctagagccacaacatgattgtaggccaagggcttgtttttgtgaccttgatctaagataatgccatggttgattgtatgttggaagaatctttgattggaatttggagtaatattaaggtagtttgccttttctgcagacatttttaggagtctttttgtgtgagtggtggtggagtgtatagttttgttgaacctagctaaattctgaatatctttccactaaaagcacaacaaatctatttacagtgcctgaagcctgggagagccacatgat

SEQ ID NO: 12090 - DNA, 406 bp, Homo sapiens
ggcacgagagtacttttgataataattcactctgtgcgatattcctgaataagtccatctcaaaagtttgggattttcctcctcttaactttcttaatatttggacatgccgctgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcacagaagcttttaatatttc

SEQ ID NO: 12091 - DNA, 405 bp, Homo sapiens
ggcacgagctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtac

SEQ ID NO: 12092 - DNA, 409 bp, Homo sapiens
  misc_feature 291: n = A,T,C or G
cggtgctggcgctttcattgtaaaaataatatgtactttgcaccacttaaaaaaaaaaaaagaaaaaaattcctgggggcggttttctccgatattccgcacttgttagaaacctttggtgtgttgggccaaccccccgctgaagggcggggaaaaaaaggctttttttggaaaattgggggggctgtggctttttttgaacccattgtaaggggcataaagcaggttaccaccaccatgggcattcttttttggttacaggttcgggggggggggggggaaggtttcaanattgcctacgggagaaaaaaagaaaaacctcagcttgcaaatttttgttcagagatgggatcgttctttgtcgttggagggatttacattaaaaaaattcacgagatattgctcatgg

SEQ ID NO: 12093 - DNA, 410 bp, Homo sapiens
cgttgctgtcgggttgtccaggcccgttctgcagggctgttgtgtagactgcagacatccgtacctcaccacagaccacagatgacctcgtgtcatactgtgggctgatgagaggtagagcatcatgcatcgaggcctgagggtgcagggcgccctctcttggcctggaggaattgctcctaactagagtaagtttacacgagggtcccaggcagagctgcagagctggaaccggaggctccacagtccttgcctgctcatggacctccttcagagcacctttctacagactggactgcccagctccgtggggtggcatctggtttctggtgctattctgccaagttatcgagctcctcctcatgtttcaacattccatcttcccgtttctatcctcgactccaaagtag

SEQ ID NO: 12094 - DNA, 408 bp, Homo sapiens
  misc_feature 408: n = A,T,C or G
cgttgctgtcgggggctgcccagcacctgtcatcctgctgggatcaggttttcttagtgcttgagaagactcaagagggcctgtcccatgccattgttggccttaagagcaagtgattccagaagaggagtgggcaccactctcatccagaggcccgtcctgagaggcaagtgaggctgtgctctgtgcctgggctcccccaggtggcacctgtcggtctgtggacctggttgaggcaaggatgcccatctggacatggagccgacacaggtagtcagggggccagcgggacgcttaccaacagctgtcttttccccacctcagaatagcattcctttcgaacaccacggcaagtagctgctcgtctcccatcggaaggcagcactggattcctggtcgggtggcttn

SEQ ID NO: 12095 - DNA, 406 bp, Homo sapiens
ggcacgaggcaagttatttcacttctctggctctgtgtactcagttgtgaaacagcgataatgtgtaactcagttttgccttaaagattaaatgatataatgttttaaagtgcttagcactgtatgagtcatagtattcaataggtggttgctgatgttgctattatagcattaacttttcagagatgaaggtagaggccagacatcttatttcaaatatcattgtaactttaaaaatcccagtaaatgttgcctgttcggtatacagtcaaaatctcccaaaacaaatccacaaaacagaagtgtagggtgggacacaggtgcatctggtgtttcgtaagtatgagcttagatatggagtgtggtagaaaaagaatgaagagaggataatggaggaagggaaaaa

SEQ ID NO: 12096 - DNA, 406 bp, Homo sapiens
ggcacgagctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgtt

SEQ ID NO: 12097 - DNA, 407 bp, Homo sapiens
  misc_feature 407: n = A,T,C or G
cgttgctgtcggacttggcaccctctgtgtcctggggcccctgcccagctggctgggccacctgcgtgtctggcttcatcggcgggccccaagacggagctccaggcccctatacagggagtgcgatcccacggcagtgggcagtcctgtcccgcgagcccggcccttagtctgagtggtgctgacctctaactgtggacgccatgctccatcctcctggtgggtggcggcggggcggggggggcggccatgctgggcagcccacacaagccactgtcacctgctgtcgccacctggccgaccctggttgattggggaatgctgtcagccccgcagcccctgtggccatatctggggcccgagcttgtgctggtgcctgctggagactggctgggttaaggctgccn

SEQ ID NO: 12098 - DNA, 405 bp, Homo sapiens
  misc_feature 404: n = A,T,C or G
cgttgctgtcggttgcagggccctggaggccaaggccaccctgtgtggggtccctgttggcagccaggtccctacacaaacaagtaatcctgtttggcctcctaggttttgcatatgacctgcagcctaatttggggtgtaggggaagctctgctggcccttgctcctttgtatgttgggtgactttaatggctggccacatacccctttctcccagctactcattcactgacttgggtaagttctaagacagttcgcacttagaaaagaatgtgacacatcaacattaacttttcctgaaaagaagagtttgcctaacatggtcctaaagaagcttggaatttataagactttcctttataagatatagtgggggtttttttgggtggaggggggtttgtttng

SEQ ID NO: 12099 - DNA, 409 bp, Homo sapiens
ggcacgagggaagctccccagtgtcctggaggcctgctggctggacgaccccctgcctctggaaccaagggtgaccaaggctggcgccaccatggctctgctgccgtcacctcctccctttagcattgagcagccccggaggggctagccctgaggctgacctgcccataggccccaccatcgcgctgcttagtggcctctccctgcagcctgtcgttgctgggggcggcatggccttctgtctgtcgagcgaggagccgcgccgcccgctgcgaagcgacatgagccacttccaagcctcggaagcccagcaggtgctacacaacaagctcgaggtcatcctgggggactccattcagagggctgagtacaaggacctgctgctcttgctccagaaagactcactgct

SEQ ID NO: 12100 - DNA, 408 bp, Homo sapiens
ggcacgaggagagagagagagagagagagagagagagagagagagagagagagagagagagagagagagagagagagagagagagagagagagagagagagagagagagagagagagagagagagaggtttttttccccccttgtgagagagcctctgtctctctcccccccccccctctctcttgtggggctcgcactgtgtcacccccccccccctctttttttttttttcccccccccacacacactatctctccccacagagagtcgcgcgcgctctctctagggctctctctcttttctgggcgctctaaaaactcccccccccccctcaaaaaaaacacccccgcgagtctctctcacacccccacccccccccccacatagtgttttctcccctccccgcg

SEQ ID NO: 12101 - DNA, 406 bp, Homo sapiens
  misc_feature 406: n = A,T,C or G
ggcacgagacggagctggctgcccagcccaaaggcccatgaggggatgcagttatgggctctgtcgccgtggattgttattttgtgtcactaagtaatccataaagcgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagcgaaagataaagctgaagaagaaacagaagaaaagccttcagtttggctgtgtcttaaatgtggccatcacggctgtggcagaaattctcaggagcagcatgccttgaagcactatctgacgcn

SEQ ID NO: 12102 - DNA, 409 bp, Homo sapiens
gtggggactggaccgcccgacctgccatacccgtttcttacggggctcgtcgccgccagtagccgcagcggcgcactcttgggcctcgcgccggctatggccgggccctggggctgagccctcagggtgtgaccgagattcccgacgagagatactgaggggaagagaggaaagaggggcgggctcctggctaggcattctctcctgagcggaatcctgctaagatggagaaggaggagacaacccgggagctgctgctgcccaactggcaaggtattggcttccacgggctgatcatcgcccagagggacgacggcgtctttgtgcacgaggtgacgcagaactcccctgcggcccgcactggggtggtcaaggagggggaccagattgtgggtgccaccatctactg

SEQ ID NO: 12103 - DNA, 407 bp, Homo sapiens
ggcacgaggaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgatgatcagtgtcgcgtgcatcctggcccaggagcagcttgtggtgggagtagcagacaaagatctgttgaagagcaagatgctccc

SEQ ID NO: 12104 - DNA, 408 bp, Homo sapiens
  misc_feature 408: n = A,T,C or G
ggcacgaggcctgttgcagccatggtgcattgcagttgtgtgttgttcagaaagtatggaaatttcatcgataagctaagactcttcaccaggggaggatccggtggaatgggttatcctcgtttaggtggagaaggtggaaaaggtggtgatgtctgggttgtagcccacaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacn

SEQ ID NO: 12105 - DNA, 406 bp, Homo sapiens
  misc_feature 406: n = A,T,C or G
ggcacgaggtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagan

SEQ ID NO: 12106 - DNA, 410 bp, Homo sapiens
ggcacgaggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacact

SEQ ID NO: 12107 - DNA, 405 bp, Homo sapiens
ggcacgagatcacttaaaagcgtaatggatgattttggaaccattgagtcaacattttatgacattataaaaaataagaagctaattctggactttgtactgaagcaggacatgccattactaggggctgagaagagaaagaggacaacggtagccaaatatggtgatgtagatgatgcggactacatgtggtaccaacagaaacgctcagccggtgttacggcaagaggcgtggagcttcaagctgctgcagagagatttgcacggtgatttgggcgaacagatttcaaagctagcactggttggctttttacatttcgaaatcggcatgcaattgggaaccgaaaaggatgtggggaacaagtcctaagttcagtttctgagaatgttgagccatttcgacag

SEQ ID NO: 12108 - DNA, 406 bp, Homo sapiens
  misc_feature 259: n = A,T,C or G
cgttgctgtcggcaacttgtacggatttgcccttttacgtagacgggctttacagttagaagagcttacattatgtaaggacacacctgataatgctcggaccctcaatgaactgggtgttctctactatcttcaaaataacctggactctatgcaatgaaaagaaacagtatgataaagcagaagaactttatgaaagagctttagatattcggagacgtgcattagctcctgatcacccttctttggcatatacggngaagcatcttgccatcttgtataagaaaatggggaaacttgacaaagctgtacctttgtatgaattggctgttgaaattcgacagaaatcttttggcccaaagcaccctagtgtagctactgccttggtgaacttatctgttcttta

SEQ ID NO: 12109 - DNA, 399 bp, Homo sapiens
cgctgctgtcggcacttagattttggagacatcaagcagatgttttcaaaaatgattgtgatcaagaatctgaattataatattcacagtctgctccccaacccagtgatgccaactgtacagatgcgcctccactaaggggcatatgccacgctcgtctgaccctggaatgaggatgtacgaagcaggcagagctccggttcagccctcacaatgggactgaagcacgagagaaggctgggcacaagggctgtgtggaagtagggcttgtctccatggatgacgtccagaaggatgtcatgaggaggaatatcacacgtgttatacacattggagggaacagagactggcacaggacctcttcattgcaggaagatggtagtgtaggcaggtaacatt

SEQ ID NO: 12110 - DNA, 404 bp, Homo sapiens
  misc_feature 404: n = A,T,C or G
ggcacgaggaagagttgtaggtactaatgttgggtcaattttccaggtaaattaaccaagccagagaagggtaagttacttgctaaagtcatgcagtaacatcgtattctcattctccttcctgcacctgtctctcctaatagaatggcatcctctcaatacagttttttttttatggctagcacatagcatggtgccttgcacatagttgttgctcaaaaagatgtttttgttcaacaaaaagtgaataaatcttttaaaaaggaataatggcttcatccatgtccatatggaagtcatagccagtaaggaaatgaatttctggactaattcatataaaacaaaggggcaagtttagtggtggagatattggaaatttttataggcatttggtagagcacaan

SEQ ID NO: 12111 - DNA, 403 bp, Homo sapiens
ggcacgaggagagagagagagagagagatagagagagagagagagagagagagagagagagagagagagagagagagagagagagagagagagagagtgtgtgtgtgtgagagagagagagagagtttctctctctctgtggtatatatatacacccactctctcttctttctctctagacacacaaagcggctctctcgcgggttttacccacgctctctcccccccagaatatactgcgcgctttcccctcctctgtatatccgcgcgcgcgcgcacgtgggatatattctctctctctctctgcgcgcgcacacacatatcccgcgtggttttctctctctctctctcttcccgtgagagagagagtgtgtctctattttctctctcttgcgcacgttcc

SEQ ID NO: 12112 - DNA, 404 bp, Homo sapiens
  misc_feature 404: n = A,T,C or G
ctgcaagagaggatttcaggaaaccttgtatgtgtggaatgaacctaaatggtgcattaaaggaatttctttgcctgagaaaaagttggcaacctgtgaaacggttgacttttggctgaaggtgggagccggtgtgggagcttttactgccgttttgctggtggctctgacctgctacttctggaaaaagaatcaaaaactggaatacaaatattccaagttagtaatgacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaaccn

SEQ ID NO: 12113 - DNA, 401 bp, Homo sapiens
ggcacgagctatttttttggtgtgggtggatggggggagatgctaaaatattgctgctaggatccagaaataccacactgtttcatatattggaacttgttattggctagccttatgccagcctgccactgtcaatatattctgttccccttggttacaagcttaatatactcttgtgtttttggcgaaatgagctttttatcctattgtaatattttcaattgataatagatgtcattaaatctactgcttgtatagagacaggtgtacccaaatttactcttgacctttttataaagccaggtaatggagtctgttcctttgcatctcaggaaggaattgactttgctttatgtatcagacctcatcaattgcaccctctccatcatgccttattttcc

SEQ ID NO: 12114 - DNA, 398 bp, Homo sapiens
ggcacgagggagtgcagtgttgcaatctccacctctggggctcaagcaattgttgtgcctgagcctcccgaatagctgggactacaggcacacgccactacgcccagctagttttttgtattttagtagaaacagggtttcaccgtgttgcccagggtggtctcgaattcctgaactcaggagatcctcccgtctcagcctcccaaggtgctgggattacaggcgtgagccactgcgcccagcctattcataattctttatagggcttattaccaaagaacagaaggctttttaaaagtcatctattgtttagtgattattaaaaataagtcttctgatgaggattacatgtatctaactactgtaaaatagatttcatgtcagggctacataatcag

SEQ ID NO: 12115 - DNA, 404 bp, Homo sapiens
  misc_feature 404: n = A,T,C or G
ggcacgaggctgagtgcgctgcactgaccttcttccaagcctcagttcctgttctaggaacttgaggctatgtagccagaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccan

SEQ ID NO: 12116 - DNA, 399 bp, Homo sapiens
cgttgctgtcggccatggttgtgacaaactctgaataccagaggacacaaagggagaggaaaaactggtctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagaga

SEQ ID NO: 12117 - DNA, 399 bp, Homo sapiens
  misc_feature 37: n = A,T,C or G
cgttgctgtcggaagaattcgcggtcgcaggagaaantctttttattttgatctgtttttttgttttttttttttttttctttttttttttttattagggggggcccagcgcgtcctaaaaggggacccaccccccccccaaaaatcccccccgcgaaaaaaaaacccccccccctacgcccccccgtaaaaggacgcatacctcacgaaccgggggggggggggggcccttttctcttttttaaaaaggggggaaaaaaaccccccccccccggggaaagaaccccccccccaaaaccttttgaacccggggggggccccaccggattaattcctccccggggggcttgccttttccccaaaaggggggggaaaaagagggcgcccccccgaggggat

SEQ ID NO: 12118 - DNA, 402 bp, Homo sapiens
  misc_feature 402: n = A,T,C or G
cgttgctgtcgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcn

SEQ ID NO: 12119 - DNA, 398 bp, Homo sapiens
  misc_feature 398: n = A,T,C or G
ggcacgagtggaaccagcgactcagttatttcaaaacaccatgaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaan

SEQ ID NO: 12120 - DNA, 401 bp, Homo sapiens
  misc_feature 401: n = A,T,C or G
ggcacgaggagaagcagagggagtggcatgcagggcccctgccatgggtgcgctcctcaccggaacaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaan

SEQ ID NO: 12121 - DNA, 404 bp, Homo sapiens
  misc_feature 4, 7, 8, 9: n = A,T,C or G
ggcncgnnncactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccatt

SEQ ID NO: 12122 - DNA, 404 bp, Homo sapiens
cgctgctgtcggtaataccaggtgcctgtcctcactgtgtgagtggttctctagccagacatgaggagggatcctattgtttcccatagctaggcagcctaagagagtaggggaaagagctggctccagatgaaaagggcaccatctccagctcttggaagcagagagggtggtcctttggattcccagtggcagcagcaaccaacctggcccttagtagtttctaagttacaccatgttaatggataaaggaattactcagcttgaagggatctggttcctttacactggcctgatgtgtggggagaaaggggccaaaaagtttacgatttggagttaacatcgaaatttctgctttgttggtcaggggttacagcattaatggacaggttcaccctgaccta

SEQ ID NO: 12123 - DNA, 401 bp, Homo sapiens
ggcacgaggtaggcttattttcacgctttgtgcctcactaaatatcctcttgaaagggaagtttctgctcaccctgaagactgctggatcagttagtgagacaaattccaagaagctggcttggatgtcaaattggtcttgggctcatagagaggaatggatttgttgccctgaaaaggagcgataactctagtttttaaacatttgttttagttcagataattactgcccttattcattgtgtccacctgagtcagaaagcattgctgctgttgcctggtctaagggaggaggacccaggcatgtaacggactgcatgctggccagttgtggtggtcagagcaagctggaggccagcgaggcccttcaggggtcttttcaagggtctgccttggggagcg

SEQ ID NO: 12124 - DNA, 402 bp, Homo sapiens
cactacggcttacggctgacaaaagacggcagaagggactgatatattagcttccttggagctcccaccctcttctggtttttccacaagtgtctgacatcacactatattgcagtcctgatcactcaggttttaaattgctgtgtaatctgcgactatgctctcccctgataccattttcagagagacacaaagccttcgtgcttttccttgtctctgccacttgtgccatctttcagattacatttagagtttgctgctccttctctggaatattgtttgcagcgcttcccggatagatactctgagtatagatgtgcacctttccatctctttgtcacctaatacagctcagtttcctgagtctggattgtatcctccaatccagggttctcagacttt

SEQ ID NO: 12125 - DNA, 402 bp, Homo sapiens
ggcacgaggaaaggcaggaggtggcggctggcgacccgacccccgcggcccctgcccgcactcctggggctcagccagggcgaatggccgtactcatcccaagaagttgtcctaggtcccagacagctttcagggtcccttgcggaggaggtggtgggaccacagacacatggagagaatctggaactgttctggtttctgaacttttccccgacaggaccccagaccctctgagtcatccccgcaggcttaacgagactcggggagagttagtgccgaggccagacactagtgcttttcaagaattttggttaccagggctttcccgagccgagtggggtgcggctctgttccccagcacccccttttcgccggccaggccgactccgcgttactgtcccc

SEQ ID NO: 12126 - DNA, 400 bp, Homo sapiens
tctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgaa

SEQ ID NO: 12127 - DNA, 400 bp, Homo sapiens
  misc_feature 400: n = A,T,C or G
ggcacgagacaggaagccctgaaggttcaaaagaaatacaaaagcaaaggctattttcttttttttttctttctttcattccttccttcctcggtttctttctttcttcctttcatttttttttcttttttaaaagcgagcggctctgcgggggcggtttggggggggcgccgccgaggggaggtcgtctcgcctcccgcgcgccggtagactggacttgaacactaagtcttcaatagctgagattctccatcttaatctacttggaggcaagagcagatgggttgtttcattatggatggaggggatgatggtaaccttattatcaaaaagaggtttgtgtctgaggcaaaactagatgaacggcccaaaaggaggcaagaagaatgggagaaagttn

SEQ ID NO: 12128 - DNA, 398 bp, Homo sapiens
cgttgctgtcgcatatgtgtccatcaatagagaacttgctaaatgatttatactacctttacatattgaaatacgcatagccgtggaagataatttagtagatctatatgtcccattatggaacaatccccatggtggggggaaaagtaaggtgcagaactgtatcatagatgttctctctctctctctttttttttggaaagcacatgtatgcttttatatacacagaaaaattctagaatggcaaacaagatatctttgcaatagtttttttctgggaggggactcatttaaaaaaattctcccatattgcttgttttgttttgttaaagacatccatgtattcctacttgggttaagccatgataactaaatatgattaaagttcagaacaataa

SEQ ID NO: 12129 - DNA, 400 bp, Homo sapiens
  misc_feature 1, 2, 3: n = A,T,C or G
nnnacgagagactatgtgccttatacccttcgcatgtgctccagtcggccgagagaacatggtgttgggaaaagaaagagcagctacacatttgaatagttggaacaggtgtttggtcagggaggaaggtatgctcagccctgccagcctgtacttattaacagtagaggcttgtaccaagagctggagtcagacggcagcactatggaggactattcacaggaggactggtgaaaccacagtcaggatctccatggctatccaacagatcaagaattggatgaaatacctggcacaaagagaacattagcaataaaacaagagtcttctgatgaagcacagagaagagacatcatgcagaagattgtacagattttggaatcggtacagatgaaatggg

SEQ ID NO: 12130 - DNA, 398 bp, Homo sapiens
  misc_feature 398: n = A,T,C or G
ggcacgagggactatcttgatgatgtcgtctcattatcagtgcttaggtacttttgattacctgtgtttcagtattagggacactttagtacttcagatcctgcaaatatttttgcagatgaagtatgtatgcatgttactaagttaaacttagaaacagaacctcattcagttattataatggatttttgcaaactactgcaaatagcaaatcaatgccaatgttaaacaaagaggaaaacgctgtgtggactttgttctcttgcaccggtatttcaggaacatctgcttgccatccccacagctctttaaaactggctattatgtgtgcctttcattcttacatttctaatcatactgcaggaaaaacattggattcagcttagactgaagaaaan

SEQ ID NO: 12131 - DNA, 399 bp, Homo sapiens
cgctgctgtcgcgaaaccgcttgagcatcctcctgtgaaaaggaatgaagaggctcaagtgcatgacaagcttaactctggaatggtttccaacatggaaggcacagcagggggagagagaccttctgtggtaaacggggactctggaaagtcaggtggtgtgggtgatccccgtgagccattaagctgcctgcaggagggctctggctgccacccaacaacagagagctttgagaaaagcgtgcgagaggatgcctcacctctgccccatgtctgttgctgcaaacaagatgctctcatcctccagcgtggccttcatcatgaagacggcagccagcacatcggcctcctgcatcctggggacagagggcctgaccatgagtacgtgctggtcgaggg

SEQ ID NO: 12132 - DNA, 398 bp, Homo sapiens
ggcacgagattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtgga

SEQ ID NO: 12133 - DNA, 404 bp, Homo sapiens
  misc_feature 404: n = A,T,C or G
cgttgctgtcgaagagccaccagctggaatctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttccggtccatgttccccctcggaccaaggtccaagtccctggggcctgctggagtcccttgtgtgtcccaaggatgaagccaagagcccagcccctgagacctcagacctggagcagcccacagaactggattctcttttcn

SEQ ID NO: 12134 - DNA, 404 bp, Homo sapiens
gacggtggggaagatggcgtaccagagcttgcggctggagtacctgcagatcccaccggtcagccgcgcctacaccactgcctgcgtcctcaccaccgccgccgtggtgagcagctgcagtgccaccttctcattatctgggctggatatgactgggtcttcaggaaactggggtttgggcctccgggaggcccagaggggctggtcccggggatgggtggaggcgtacagggattactctggggttcgagttggcgccaagaatgcttatccagtgacgcgagaagggagtgctgcttcatggggggtcagcagttggaattgatcacaccttttcaggtgtacttcaatcctgaattaatctttaaacactctcacatatggagattaatcaccaacttctc

SEQ ID NO: 12135 - DNA, 401 bp, Homo sapiens
cgttgctgtcgggaggccaagagcaccatttggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattc

SEQ ID NO: 12136 - DNA, 401 bp, Homo sapiens
  misc_feature 401: n = A,T,C or G
gcctgatgggatatattcagtcatggcgtccgaactttccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatn

SEQ ID NO: 12137 - DNA, 399 bp, Homo sapiens
ggcacgagggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttac

SEQ ID NO: 12138 - DNA, 401 bp, Homo sapiens
ggcacgagatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaag

SEQ ID NO: 12139 - DNA, 404 bp, Homo sapiens
ggcacgagagaacagagagcagtgtacgatgagcatggaacagtggacgaggactctcctgtgctcacccaagaccgagactgggaggcgtattggcggctactctttaaaaagatatctttagaggacattcaagcttttgaaaagacatacaaaggttcggaagaagagctggctgatattaagcaggcctatctggacttcaagggtgacatggatcagatcatggagtctgtgctttgcgtgcagtacacagaggaacccaggataaggaatatcattcagcaagctattgacgccggagaggtcccatcctataatgcctttgtcaaagaatcgaaacaaaagatgaatgcaaggaaaaggagggctcaggaagaggccaaagaagcagaaatgagcag

SEQ ID NO: 12140 - DNA, 404 bp, Homo sapiens
ggcacgaggatgaccccaacgatccatactaggagcatggattgatactgccaaatggaaacattaactggaactgcccatgccttgggggaatggccagcggtccctgtggagaacagtttaagtcagccttttcctgcttccactatagcacggaggagatcaaggggtcagactgtgtagaccagttccgggccatgcaggaatgcatgcagaaatacccagacctctatccccaagaggatgaggatgaggaagaggaaagagagaagaagccagcaaaacaagcagaagaaacagctcccattgaggccactgcaaccaaagaagaggagggatcaagttaatgaaggccacaaggcactgggcaccagtccttttggagtggaccttttgcaaaaggg

SEQ ID NO: 12141 - DNA, 397 bp, Homo sapiens
ggcacgagactggatgtatagcagtttttccaagaagcttggctcagaagggtagcagacaggatgacaaatggaaagagaaatgaggtcactggaggattgttaaagagtacagcatgtttgagtgtcacttgaaaggttccagtggagaagctgaagaagtaggtaaaggtaagaataaccaagggacagaagtcctggagcagggaggagggaatgggattctttaaaacctcttcatcaagaaactaggaaaaaaaaccaaagctgtaccatctcagatttcagagaaagggaatttagaaggaagtaatataagcaaagaacaacaatattctgtgactgtttttaataataactaggaaaattcctagtgcagttaactctgaacaaaatt

SEQ ID NO: 12142 - DNA, 396 bp, Homo sapiens
cgttgctgtcgggggagggggaggagcatttgttatgtggggcagtcagaaggaacatgtaaagactcaaaagtgtgtaatgtttcatggaagccatcaacaaagcggatgactttctttatttttttgagacagagtcaaactctgttgctcaggctggagtgaaaaacatatacctcatctcactgctgactcagacatttgtgtcaaagagaatatcctgcctaatgcctccgagcgagtcttattacagatgcgcaccacccctacccagttgtggtcattatagacatcacttacgcccatatacccctttccagtattgtttggaaaaaattgttcttattctgtgaccaccctcttggaatttatagtgtcgggagacatccgcctgcg

SEQ ID NO: 12143 - DNA, 395 bp, Homo sapiens
  misc_feature 331, 348: n = A,T,C or G
gatcacttgagcctgggaggtcaaggctgcagtgagctgtgattgcatcactgtactccagcttgggtgacagagcaagaccctgtctcaaaaaaaaaaaaaaaaaaaaattttttggggccctttttttcttaaaacccaaaattaaaaaaacccttgggaagtttggcccacccccccccaaaaggccgggaaaaaaaggctttttttggaaaatttgggaggcttttttttttttttaaccccttaaaacccggaaaaaaaaagttaacaaccaaaattggtttttttttttttttccggttccgggggggggggggaagttttcccnccctcctgctgcgtagncgaacactctacttcctttgcacccttaaaccacaacttgagcgtcg

SEQ ID NO: 12144 - DNA, 392 bp, Homo sapiens
acctcctggtaaggagctactaccaaatactaaagctactttttcttactcgttcgtagtactgtcgagaatcagcttatcttcaccctcttagactatatgtgaaaaggcacaataggaagtttgggcacattagagacaaatgtgctatactttacggcttagcctgcgcccggttcttatttatcgtcaactgtggacaaaatgattttgtttcatgagacaaagggggaccaccaacttctacggtaatgtctgccttttgctagatagactgtctattacataaccatatgtagtttatttttaaggagaattacatatttttcttcacatgtcactgttagaagtaaatcccaatagtaagatttccctaaacaaagtatttcttg

SEQ ID NO: 12145 - DNA, 397 bp, Homo sapiens
  misc_feature 5: n = A,T,C or G
ggcanaagctcagtatgtctctttcaactctagtttttgaggcggggacacaggaggtccagtgggacacagccactccccaaagagtaaggagcttccatgcttcattccctggcataaaaagtgctcaaacacaccagagggggcaggcaccagccagggtatgatggctactacccttttctggagaaccatagacttcccttactacagggacttgcatgtcctaaagcactggctgaaggaagccaagaggatcactgctgctccttttttctagaggaaatgtttgtctacgtggtaagatatgacctatcccttttaggtaagcgaactggtatgttagtaacgggtacaaagttaagggtcttgtggtttacccatctgaaatatgtta

SEQ ID NO: 12146 - DNA, 392 bp, Homo sapiens
cgttgctgtcggtgaaattctgtattgatttttctctaaggagaatatgacatgcttgtgcttaccaagatcaagtgcattgaggggcagttttgtttgcctgaataaacgtaaaggacaagtaaacaatttgatgataagctacagtttttcttacaaagtaaatattttatttatgcgctgatagttggcttttgaatccattatttcatgcttttttttaaaaaaaaaaaatatcataataactttttgaagaggcatttggtcccgatataaattcttttacttttattcactggttgcactaaataatgagaaccttgggtggatttttgtttacttccaaaaaacaaggttagggatgtttttattcccctaccttgaagaaagtg

SEQ ID NO: 12147 - DNA, 395 bp, Homo sapiens
ggcacgagaatggatctgaatttgacaaatagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctg

SEQ ID NO: 12148 - DNA, 393 bp, Homo sapiens
ggcacgagattatatggaccccctaagtcttattttctagtaaactgatgatactggaaattcttttacttgacatgcacaagaataagctggaggcgattatttcctttcatacagagttcatgaattgttttaaatgcttcttaaagtctggctttataaccgtttaaaatcaactatgatgattttagataaccaagtaggtattataatacaaaacaattttaagtgtaagaaactatagtataatcaaagtaaattcagttattgtatttgtggtgttgccttgccttgcatgatgctgggggaaaaagagaaaagaaatggttttctttttgtactttcattcagtgcacagggaaaaaagcatgtattgtgccaccggaagacaag

SEQ ID NO: 12149 - DNA, 159 bp, Homo sapiens
acaaacgatttctgttcattctttaagcatctatatttcatttgttgtgcacatatgcatatgagcccatttaagatatttgcatatacttgatagaaaccataaaggtgtagcagttaagtccagccacatttggttaatcagtgtttgatataattg

SEQ ID NO: 12150 - DNA, 394 bp, Homo sapiens
cgttgctgtcggccatggttgtgacaaactctgaataccagaggacacaaagggagaggaaaaactgttctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagacaagtccccacacatcagcaatctctcaccacttcttttgcaagtttacagaagcaaacagaaatgtacaggatacttaaaatggaataactttttggatgcaaaac

SEQ ID NO: 12151 - DNA, 395 bp, Homo sapiens
ggcacgagagactctgtctcaaaattaagtatctctaaatacaggattataatttctgcttgagtatggagttaactaccttgtatttagaaagatttcagattcattccatctccttagttttcttttaaggggacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctact

SEQ ID NO: 12152 - DNA, 393 bp, Homo sapiens
cgctgctgtcggggtcaccctgcatcaaaacacatggagcagactgctgagccagctcaggggaagcggagagaccccaggagtgacggtgagaatgcaactcacttgtcattacacaggatatggcagatcggatttgaccaacaaaatggggaggaactgatccagatgtggaatgtgacagagaatcccttcccactgccatggaacatttataaaaataatcatacgttaatcaatgaagaaagggagccacacatttaaaaaagcagaaatcgtacaggccacttcctcagataaccattctaactagggtcaaattatacatcaggactgaaaccacaaacatataggaaataagataaagtcttttggtttttttgagacggagtt

SEQ ID NO: 12153 - DNA, 391 bp, Homo sapiens
gaaatctgttctttcacattgcaaaacagagtctgagagcaagaattcacattcgaaaacttcaggtgaaaagaaccacgtggaaaaagataaaatgaatacattggacattttgagaatggagactacagagagagagaatccagaagctgaaactgtatctgtactcctcaacacatggaagatcaatcgcgtaaagattttgaagaggaagatggcatattacagcctgagaaaaatgattcttttcaaaatatgcagccagatgagcccaaggttcttagtgaatgtgtaagcgttcaagagaataataaggcggatgaacttaaccaagtcccaattctaaggactcgatttcagaaaccaaagccaaatataggaagaggaactg

SEQ ID NO: 12154 - DNA, 396 bp, Homo sapiens
  misc_feature 323: n = A,T,C or G
ggcacgagagagagagagagagagagagagagagagagagagagagagagagagagagagagagagagagagagagagagagagagagactctctcactcttgcgcgtgtatttatacacacacacacgcgtgaagacacctctctgtgtgcgcgcactccccccctctttgtttcgtgagaactgtgttctttttgcgatatgtgtggcgctctatctctttgtttaccccctatatcccccgctctacacgttttctggcgcgcgtgtgcattttttttgtgacgcaggcacgggggggtgtgtgacatttttaacccccncacgccccccctcgctacgatgttctttctttctttttcgtccttggccttttgcctatagtgatttcccact

SEQ ID NO: 12155 - DNA, 392 bp, Homo sapiens
ggcacgagggctgacgtggactgtccacagtgttcatgtgctggagtcagggacggccgcacctgcctccgccggctccagtgtgcggggagcctctgcctgagtgtgcaccaggcccatgtttattgaccacagtctgagcgggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgaa

SEQ ID NO: 12156 - DNA, 395 bp, Homo sapiens
ttgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagag

SEQ ID NO: 12157 - DNA, 394 bp, Homo sapiens
cgttgctgtcggcaggctgtgatcggtatcctacagccttaccctcgtgtcctggatcttttccttccatttcctgtgtacagcctttttggggacactgccgttaccccactctagctagcatagctctgtctgtaggtgctccataaaggtgataggactgaccacaccgtcacctttcccggaaacccaagagggagcgttccacagagggagcgtgtagtggggggaactgttttataaattaatccgtttattgaaaggttcacaaggacaaagaggcaacagcaagagtcaggcacagaaataaaggacgcagaagtagaagtgcgccttggacctggaggactcttccagagtgtttatcacttggtgacctggtaggagggctgcg

SEQ ID NO: 12158 - DNA, 396 bp, Homo sapiens
ggcacgaggattgtcccaggacctgaagggagcatggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgcttttttttttttttttttaaaacctatgggaaatttcccttgttgggaaccttggccccgggttgggttttcccttcctttggaaaattaaaacccaaaagccctttttttttggttgaattaccggagggccttgccctaaggggctgccctgccccttggggggaatacaaaaaaa

SEQ ID NO: 12159 - DNA, 391 bp, Homo sapiens
ggcacgagctttcttaaaaccatctaaaataaaaccttcttattttagtagtgtcagtgaaaataagcagtgacatttcttagaattctcagctttcaaatctacatgctgtgatcctgtctgcctaccatctggacagtttttgtttactcttgggttcccccatggagtaaaagtctcaaatcatctagcattgtttctcttatcctcaggtgatccacccgcctcagcctcccagagggctgagattacaagtgtgagccactgcgcccagcctacagaggactattgagcatccaatgactatgctaggtatgcaggtatagtactaagtaacaggagttcctaatcctaagaggttctccatctagcagaagaaaaccaaacactt

SEQ ID NO: 12160 - DNA, 392 bp, Homo sapiens
ggcacgaggttgctcacagtggttcacgagttatcgaacatgatacagttaatgatttccgagagaagatgatgtataaagctatacattgtgttcaaaatatgaaaccagaggagtatgctcataagattttggaattacagatgcacagtataatggaaaagaaaatgaagaccaagagaaatattgccaagcattacaagaataacccatcactaataactttcctttgcaaaaactgcagtgtgctagcctgttctggggaagatatccatgtaattgagaaaatgcatcacgtctatatgaccccagaattcaaggaactttacattgtaagagaaaacaaagcactggcaaagaagtgtgccgactatcacataaatggtgaaatg

SEQ ID NO: 12161 - DNA, 391 bp, Homo sapiens
cgttgctgtcgagaggtttaaccttggaataaaagaaagaatcagcaaatacattatctgagcctacatacactttgtaaaaagtatacttccactgttcagaattagatgatggcacaaaacctgttgaggtcttcattcatccttacaaatgtttattatgctgagtgtcccaggtgactggatacagtggagtgaattagaaatttgaaattattgccctgaggggacctacattcttcttgttggagtgcgtctgtgtgggataaggtagacaaataatataggaaattcaaaaaattgtttcagaccatagtaagttctatgccagaaatgaatagtccatatgataagaggaacagacattgtgagatgttggatctataggaaa

SEQ ID NO: 12162 - DNA, 396 bp, Homo sapiens
ggcacgagataaaacccagctgtgtaagaattattctaaatttaaagtttattcttattaccgtagggataggaatgtcagcactcactgaattatggccttcctctcctgtgtctggacctcctggcagcttatggttcccgtttcctttggataacaggatacagctggtggcaaaattctcacctgtggaatggccattgggagttttcttctccatatagatctttgcaaagcagcagaaaccatttttgcaggaaaccacaagcctgtgttaaacaccaaaagagaattgaaataacatgtccatgagttcctctttctagaggtaccaaccatcatgtgggatcctaagtatagtgttaagtagctctttgtcctccccttcactttgag

SEQ ID NO: 12163 - DNA, 392 bp, Homo sapiens
  misc_feature 392: n = A,T,C or G
ggcacgaggcagggtggagccctctgagctgcccgctgatctgcagcactggatctcctacaacgaggccagcagccagctgctccgcatggagagtaggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggn

SEQ ID NO: 12164 - DNA, 397 bp, Homo sapiens
cgttgctgtcggttttcatccaattcctactcgtagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccaccca

SEQ ID NO: 12165 - DNA, 396 bp, Homo sapiens
  misc_feature 3, 9: n = A,T,C or G
ggnacgagnccgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagaga

SEQ ID NO: 12166 - DNA, 395 bp, Homo sapiens
  misc_feature 279, 395: n = A,T,C or G
cgttgctgtcggggcgtaagcacatctcttttctggactggccgactcctttctggctccatcctctcttgagccttctctgtccagcttaaagaaatccttgcagaaaactggtcaggatctgggtatgggtgggaaggagcaaggagattgctctgggattggcagtcctgttctctatgaatcggtgtcctttggggaggcctggactgaaatactaaccagataactcccctcccacctccatgcggagctgcatgtggattgagagctgtttanggtaggccaaaatgctgtcaagattctcttacccttgtgctcttactctggacagccctgaggttggctgcctgccttcctccttgctgtttgatctaaaatgcagggtgttagcn

SEQ ID NO: 12167 - DNA, 391 bp, Homo sapiens
ggcacgagcctgaagccagtagacagtggagaggctcggtggacgaacccggcgctgttggaggacgacctcagtgtgctcctgagcctgggcatgggggcggtggctgtgctagacttcattcactactgcagagccaccgtgtgctgggaactaaagggaaacatggtggtccttgtgcacgacagtggagatgcggaggatgaggagaatgacatcctgctgaatggcctcagtcatcagagccatctgatactgcgggctgagggcctggccactggcttctgcagggatgtgcacgggcagctgaggatcctgtggaggagaccatcgcagcccgcagtccaccgggatcagagcttcacttaccagtataagatacaggacaaaa

SEQ ID NO: 12168 - DNA, 395 bp, Homo sapiens
ggcacgaggccatctggccctcacctcccgccgtagctggctgtgacgcccgccatgggcacactggggcagtgcagtgagaagacgaggatgcccagcaggctgacaacggtgcagaacaggcagaacttgatgaccgcggagccccggagcctgagcttgttcacaaagaagccgcccaggaaggtgccgccaccacccgctggcaccaccagcctctcaccagagcagactgtcggcctcacatcacccccacctgcaggagggcggctctttcctctcggccacacctagagcctggttccgatgaacgcaactctgaatgcctggaacattcaaatgctcttgtttgaggaggtggccaaatgtaaatggattctgaagaatcaggaaca

SEQ ID NO: 12169 - DNA, 397 bp, Homo sapiens
ggcacgagctggcggcattatctgcgggcttatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccaaacacccctgtattgtgctctacaagagggcatcgagcccctcagtgtgagatattttgccaactggcatgcggaataggagcctccagctgtcctagacgaccgggcaagccatcgcctatgggaggccagcaagaggctggcagagcttaggcctggggaggatg

SEQ ID NO: 12170 - DNA, 392 bp, Homo sapiens
  misc_feature 392: n = A,T,C or G
actgcacgagggtcaatccaacattgtttatatcagttcacccgtaatgagaaacttccagatgcgaataaactgctttgagaagtatgcacacggagacagtgtaatggaccaaaggcatatataaaaggtgaaaggaagcatgtttacaccaatgccaaaaagcacatgctaatttctcttgctactcctgatcttactcttcatttaaagagatttcagcaggctggttttaacctacgcatagttaacaaacacataaagtttccggaaatcttagatttggctcctttttgcacccttaaatgtaagaatgttgcagaagaaaatacaagggtactctattccttatatggagttgttgaacacagtggtactatgaggtcggggcn

SEQ ID NO: 12171 - DNA, 396 bp, Homo sapiens
  misc_feature 396: n = A,T,C or G
tcttagacgaccaattataggttatggagtataatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcacgagctaggtaatgaggaacagcaagaaaaactgctcatggagtggctggactgctgtgtgacggaggggggagttctggttgccan

SEQ ID NO: 12172 - DNA, 393 bp, Homo sapiens
cgttgctgtcgattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttatcaaggtggtgccagaggcggagctgcaggaggagaccatgcggatcgctaggaagatcgcgtcactgagccgtccggtggtgtccctgggcaaagccaccttctacaagcagctgccccaggacctggggacggcttactacctcacctcccaggccatggtggacaacctggccctgcgggacgggcaggagggcatcacggcct

SEQ ID NO: 12173 - DNA, 388 bp, Homo sapiens
ggcacgaggatctttatgcatttcccactactcccttactgtcttttagcattcacagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttt

SEQ ID NO: 12174 - DNA, 387 bp, Homo sapiens
cgttgctgtcgattttggaactcaaccctatgaacaatgggccattcaaatggaaaaaaaagctgcaaaagaaggaaatcgcagagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagaatgagatgatttactcaaccctttgaaactggatgaaacagatagatttctcatgactttattttttgaaaacaataaaacgttgaaaagggtggctgaaaacccagaatatgg

SEQ ID NO: 12175 - DNA, 385 bp, Homo sapiens
cgttgctgtcgcttatttttgtctttcactatcgcaggccttagaagaggtctacctgcctccagtcttacctagtccagtctaccccctggagttagaatggccatcctgaagtgaaaagaaatgtcacattactcccttcagagatttcttgtagaagagccaatccctgaatgccaccaagatcttaatcttcacatctttaatcttatctctttgactcctctttacaccggagaacggctccagctgttctagctctctttcagttctttgaaccttcccaccttagggtctataagggtccctctgcccaaaatggtctactctcccttcttcttcaacacatccttcagtttaagcacttgcttctctcagtttaaac

SEQ ID NO: 12176 - DNA, 388 bp, Homo sapiens
  misc_feature 354: n = A,T,C or G
ggcacgaggtccagccctggtaatcctgatgcagagggtccacaaccacatttgggaaatgttgacctaatgcacagcaggaaagcactttcatttgctaagaagtttccatatgaagggccacgcagacctgagcatgtagaaaggcaaggggccagggaagttactagaacactgactctggggttatattgcctgggtttgaatctaatcttggtcgcttactggtgatgctacccaaggtgtctgtaccttcatttccccacctgtagaaatagggataggatagtggaaggtattgagatgagctgagaccatctgcatagagggcttaacatagtgactgggacttancaaatgctccatgagttatgattgctggcactgg

SEQ ID NO: 12177 - DNA, 389 bp, Homo sapiens
cgttgctgtcggctgaagctgtcaccttgtggaatatcagatattaaggatggccagaagggcagtgggcagagccagagagtgtttcttgaagcctgtgacagatttgaagggcctgtttcatatatctataaactgaagagctacattgtttaaagaatttaatttggaaataaatttaccctgagatgtgtgtgtgtgtgtgtgtgtgtgtgtgtgtgtgtgtgtgtgtgtgtgtgtatgcatatataaataccacggccaagaggaccatcccttcctttatctgagaaaggaagtatacaaaatccgcatcaatttaccggcacgagtccccctgcttgcattgtaggtgtcaaagcccgggtgcctgatcttgacataggaag

SEQ ID NO: 12178 - DNA, 385 bp, Homo sapiens
tacggttgctagattacgacagaaggggcgtcagatgggagtgctgtttaaccttttcaggaactgtcagactgttctgaagagggtacattattttacattccaaccagcagtgtatgagaattccagtttatccacatcctcatcaacagttgttttgtctgtcttttttattatattcatctcgcatgtgaagcgcgtatctcattgtggctttgattcacctctccctgacggttgacgaccccacttctcattgcgtagcctcattacctccccgcggcctttcttcatacactggttgctccaggaattacctcattcatctcgcccccgatttccctgttgcgcccgcttcctattccccctcctccgccttcgtccc

SEQ ID NO: 12179 - DNA, 390 bp, Homo sapiens
cgttgctgtcgctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcaagccctcgcagggagcctggtagcaggggccggaagcacagtagagacggacctgtttaagaggcagcaggcgatgccctccacaggaggaatgccccccacgccgcaagccgcgcagctcgctggacagaggcagagtcagcagcagtatgacccctccacggggcctcccgt

SEQ ID NO: 12180 - DNA, 386 bp, Homo sapiens
ttttacgattctaaaatcctaacagattttaactgttgcttaaatattatttcttggcatatatagctttttaagtctgtgggtcaaagatagatgtactcatttgagacttagtgatttgttttataagtatgttgaataagttgagccagtttgaattgtgtccttctcttttaaagaaaagatttcccaaatttaaacctggatttagatgttttttgggttaaccctactgaactttccaaaattttcaggcttctgggcctaactcaaactgtaatttcatgaggccggccaagtgatttttaatctcatttaaaagttaccataagctctacttgaaccatttgggttttagtataataaaagggcacatgtattgggtt

SEQ ID NO: 12181 - DNA, 389 bp, Homo sapiens
  misc_feature 389: n = A,T,C or G
cgttgctgtcgatcattttgatatttcattctgatttctgattctctgatttctgattcctaatgaggacagtaggtctggatccaaattctcacagtaaaatcaagcagtaattttctctcatatctattagggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgttcagtaaatccatagatgactacattttgagaaatactaagataatactaaaaattatgccn

SEQ ID NO: 12182 - DNA, 388 bp, Homo sapiens
  misc_feature 388: n = A,T,C or G
ggcacgagccccagttttggggctcacttgtcctgtatcctaacaactatttacatagtatttacattatattagccattgtaagtaatctagagatgatttaaagtatatggaaggatgtgtgtaaattgtatgtgaatacaaacattttatataagggacttgagtatctgtggatcttgatggggtagggggtgtcctgaaaccaatcccccttggatactgagggatgactatacacttaagccaccagacatcttgcatatcatagacaattgtttggggtccatgagctttaattacaaaatgtaatgctgggagaacatagagaagagtgattttgttttttaaatgtacacttgaatctgtagaaatatactacatttgn

SEQ ID NO: 12183 - DNA, 386 bp, Homo sapiens
ggcacgagactaaaccctcccctagctttggtttcccccgcagtctgaagactctaatacttgacactcgttcagagagatgtttggggaatttatagacacttaacatttatgcatccttatatatcgggggcgggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatg

SEQ ID NO: 12184 - DNA, 389 bp, Homo sapiens
ggcacgaggctggcccatctggactcatggtagtggttaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgataccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccat

SEQ ID NO: 12185 - DNA, 389 bp, Homo sapiens
ggcacgagggaacatgagggaatgggcaagcctagagatggtttcatgccatctctagctttgggagccaaattctgaaacagaaactttctgtttcccataattctccctcaacctcacatttttatatccatttggatgcagaggcaatatccccattttacagcagagggagatacgatttagttgcaactacatacagttagcaagaggtagagccaagactggaatcttcagttgctagcttcagaatctgtgctctttgtgtgcaaaatcatttctaagcaagaacaaggattctagattgtcctcatccttactacagagtcatatcagactcggggcaagacccaaaggctgcaggcaccctgggcaggttcataatttgg

SEQ ID NO: 12186 - DNA, 390 bp, Homo sapiens
  misc_feature 390: n = A,T,C or G
ggcacgaggtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggn

SEQ ID NO: 12187 - DNA, 390 bp, Homo sapiens
  misc_feature 390: n = A,T,C or G
ggcacgaggtgtgggattacagttgtgagtcactgtgcccagcatggagtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctggttattggtcttgttatccactgtattagcaccttccctgatgtgctttggaggttgatcaatgaatttctgagactttctgctggaattactttaagggtgtcttattagatgatgaaaagttggctgagacacccttcaagtgaccatgtn

SEQ ID NO: 12188 - DNA, 387 bp, Homo sapiens
  misc_feature 387: n = A,T,C or G
ggcacgagcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcn

SEQ ID NO: 12189 - DNA, 385 bp, Homo sapiens
ggcacgaggctgcatcaagctggggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggtagggaggtccccaatgtgctaagctacaatcattctccctgagattttcatttagcacccagtttcttaaacagtgtttcagggccctgtctggaacttg

SEQ ID NO: 12190 - DNA, 386 bp, Homo sapiens
  misc_feature 25: n = A,T,C or G
ggcacgaggaaggcagttatatggntttttactttttcatcaattccataccatcgggagtaactaaatgaaacatacttcaaagaaagaagtcaaattaaatgactgtcattgcccattaataaaaacaacaatctgagcttaacaaaaaatttaacaaacagggaagacagaaagatggtatatttattgcctgactacactggcataactcactttaacaaaaattatcacatttaataatataacctgttatagctaaatattaaacacatattaattagggccaactttgaaggatttctaattcatccatttccttattcactattatatatgaagcactacactaggtgcagggtcattataaacaagttttttctttg

SEQ ID NO: 12191 - DNA, 388 bp, Homo sapiens
ggcacgagcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttcc

SEQ ID NO: 12192 - DNA, 390 bp, Homo sapiens
  misc_feature 390: n = A,T,C or G
cgttgctgtcgcttatgtcgtattgctttacagccactacacttggattcctgttgattaacttctccattctcttaagcacctttagaagatttagaagtttcctagttttaagtgtttcaccagcaagtattccatacctacttgatgttgctggtctggtgtcttatttcctaaagtgaagcatctttttttaaaaaagaatttgattgacaatatatccagtccaatataagtatgaaggattctctctcctgagattgtagcaggcagccaaacattttcaaatgatgcccaaggttttagctgtcttgtgtgcatccacagtctgcgaagaagacatgataaggacatcagggagccaacaagactcctaatagcctcactacn

SEQ ID NO: 12193 - DNA, 389 bp, Homo sapiens
ggcacgagccggggcggggcggggcgaggtcctaactagctgggttagtaagcggcgcgagcgtgcgagtttctgtcgcgcccgcgtcgtcccagctccctggactaccagtattgtcgcccacgtgggcttctctttcgtccgctcaggcctcacttttctccgtaaacaccccggcacgatggagcggccccagcgttcgggagcggcccgggagcggaaagcggcagtgtcctgggagcctcgaaagccgcaggggcggcagctcgcctcggaatgacctctgacggaagaaataaaacggggcctgggacgcttgcacgaaagaacccgacaaaaaccagagcccgcactcactctcgtactggggaggtggacttcagggaggg

SEQ ID NO: 12194 - DNA, 389 bp, Homo sapiens
  misc_feature 25, 52: n = A,T,C or G
ggcacgagacactgtcttgactaanaaaaataaaagggggaaaaaaaaaaangggcggttggtttttggggcccaaaaaggggttggggaaaccccggtttttttgccttatgcccccccctggacttccttgggaaaaaaagcctattggcctttcccaaaaaacttttttttcaaaaggaccggcttgtgggaaaaaagcccccctgggggctttttggggggggttaaaccccagggagacccgggaacctcatttcttggccccggtttttatttttttgtaagcttttgaaaaacatttttttggccctttttgggggaggcccccccttttataaccccagggaaacaaggtggcaaactgcctaagacttccccggggtggc

SEQ ID NO: 12195 - DNA, 390 bp, Homo sapiens
ggcacgagcccgagcggggctgggactcttttaagatgcccacgttcgcacagagaccccggatcgcggaagctcgcgtctcgaaaggcggtctcacgccctgcccgtcctgggttcacggtttttcatcacctgcggctgtcctgcgatcgaccacagctgtgcaggaggggcaggaggtatctgttgctgcagttaccggaacctttgccaggactagtacaggaccacgggctggtagctcagggatgtctcgactgtgagttacagctgcacgctctccaggaaagaaggaatttcctcttctctggaaaccccaccacacagctggtttctcattggtgctgcttgcccattccctgagctgtgactgccagaggagtgggaggt

SEQ ID NO: 12196 - DNA, 386 bp, Homo sapiens
cgttgctgtcggcagaggccatagccatagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcattggccttaaccccctgcctgatgtccaggggaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccgcagcagggg

SEQ ID NO: 12197 - DNA, 385 bp, Homo sapiens
ggcacgaggcaaagcctcgcggcgaggatagcacgagtattcaagcgcggctgaggccctccttggctagtgctgggacatggagccccggcagccaaggccaaccttgtgcattccgcccacgtaggcgcctggggccctggtcttcctcgactgcctctccactgcctggaggtcatcaaatgcccctggaccacctcctacgtgccacacgctgtgttggccatccaaggttccatattgagcataaaacagccctctgccctaaaggagttaacctgttggaatcacatacaaaggattctgactaccaagcgccttgaagttaagttgaactctgaagacagattgcctggctacaaagctcagttccactacatatggt

SEQ ID NO: 12198 - DNA, 390 bp, Homo sapiens
ggcacgaggtgtccttcctgaccttccacttccaccatgtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggtgctcatccaggaggcagaagacgtggacgtgtcccggg

SEQ ID NO: 12199 - DNA, 386 bp, Homo sapiens
gttgctgtcgctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggaa

SEQ ID NO: 12200 - DNA, 390 bp, Homo sapiens
ggcaccaggcgctttgtgactggaggtcttcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcaatgtttggaggccattatgaaaacttcatg

SEQ ID NO: 12201 - DNA, 390 bp, Homo sapiens
gcggagcgagcaacacagtcctttttctttcgtgcgctccgggccaaggcggaaaaagacgaggacagtgttcctcacagtactggacagctcacagtccgggctaagcaggggctaccttcacggaccataaaactccaagaggctcaagaagggacagatcagccatcacttcatggtcaactttgtcagggagcgctaggagccaggaatttacctgtgcggccagatggcaccttgaactcatttgttaagggctgtctcactctgccagaccaacaaaaactgagactgaagtcgccagtcctgaggaagcacgcttgcccccagtggaaacactcatttgtcttcagtggccgaaccccagctcagctgaggcagtcaagcttg

SEQ ID NO: 12202 - DNA, 385 bp, Homo sapiens
ggcacgaggacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataa

SEQ ID NO: 12203 - DNA, 386 bp, Homo sapiens
ggcacgagagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcag

SEQ ID NO: 12204 - DNA, 385 bp, Homo sapiens
ggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaag

SEQ ID NO: 12205 - DNA, 389 bp, Homo sapiens
  misc_feature 389: n = A,T,C or G
ggaagcaaaaaagattatattcaggaaaaacagatgagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagn

SEQ ID NO: 12206 - DNA, 388 bp, Homo sapiens
ggcacgagtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacatgaattgcacaggaaaacgtgttctaatcttaggcgcttcaagcggagttggtacttttgctatacaggtaatgaaagcatgggatgctcatgtgacagct

SEQ ID NO: 12207 - DNA, 386 bp, Homo sapiens
cgttgctgtcgtggcactattacagcgtttgctttgggtctggaaccctcaggggcccgttgggggactggaggatatgactatgatgttaagctttgggattttgctggaatggatgcttcttttaaggcattttgatcccttcagccctgtgagtgccatctgatcatgttattacagtttagtaacacaggagacatgattcttgttgtatctggaagctctcatgccaaggtgattgtcagagatcgcgttttgatgtattggaatgcttaaaaggagaccagtatattgcggacatggccatcaccaagggtcatactgcattgctttatactggctcatggcatccctaaatatagggagaatttatgacttgctcaccg

SEQ ID NO: 12208 - DNA, 385 bp, Homo sapiens
  misc_feature 385: n = A,T,C or G
ggcacgagggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagn

SEQ ID NO: 12209 - DNA, 387 bp, Homo sapiens
attcaattctgcacgaagaaaagctgagaaaatgaccactttggtgctatggggaggccttgcctacatgggcacaccgtttggcattttggcccggcttacctggtgggaatattcctgggacatcatggagccagtaacatacttcatcacttatggaagtgccatggcaatgtatgcatattttgtaatgacacgcctggaatatgtttatccacaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggaga

SEQ ID NO: 12210 - DNA, 384 bp, Homo sapiens
  misc_feature 384: n = A,T,C or G
cgttgctgtcggtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgctttgttcttaaagtttttactgcctcaatttgtcagctaatggatcacaagtgattgggactgcctggagcttttttcagttatggtcttagatgtgagtcagagaatattatctattgagtttcacccacttctctgcccctgtgcttttacagactggcctn

SEQ ID NO: 12211 - DNA, 381 bp, Homo sapiens
  misc_feature 20: n = A,T,C or G
ttttggttgtcacaactggngggatgttgttttcatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatgtagagaatcttaagtgataaccagggtcacggattccaaacatgtcattataaattgttttatatggtgctcactggtgcatttttccttttggataagggaaaacattattccacttactgtttttg

SEQ ID NO: 12212 - DNA, 383 bp, Homo sapiens
cgttgctgtcgctgggtgcggtggtgcgtgcctataattccagctactccagatgttgaggcaggagagttgcttggacccgggaggtggagggtgcggtgagccgagatcgcgctactgtactccagcctgggcaacagagtgagactccgtctccaaaaaaaaaaaggggggtaaaaacctttgaaaatggaccccggtttttaactttttattggaaatcctaaagggggcttcgggttttcaaaagaattttccaaaccaacccccggccgggggaaatttgaccttttttggcaaacggggaatattttttttcctggagcccctggggggggggggggaattttgccttaagacccttgggggtttttggggcaaag

SEQ ID NO: 12213 - DNA, 384 bp, Homo sapiens
  misc_feature 234, 245: n = A,T,C or G
ctgacctcaggtgacccacctgcctcggcctcccaaagtgctgggattacgggtttgagccactgcgcctggccggggattatgttttaaatgttatctttcacagcgtctgaagttctgtgcttgaaacctaagtcatttggaatgtacttgttttgtgggtgtgctgagaggatcggcaacatggcaaggtagttattataatataaggtgagatggggcggtatgttgtanaaccctctaanactaccactctacactcatccttcaagattcttttctcgagctgatcaaccatgattttgatgacgtccttaccgagccctgagaaactaaaacttcctagaggccaccctttgtagaaaccgacaatccgtctactcc

SEQ ID NO: 12214 - DNA, 384 bp, Homo sapiens
cgttgctgtcgcgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccat

SEQ ID NO: 12215 - DNA, 384 bp, Homo sapiens
gccgcactccactgcacaggacacttatgccaccctcttgccagatgcctttgaagaaagagtcagactggtccaccctcccccagcccctggggctccttgagcctctctccagccttggcaggaggaggaaaagcagcacctccctcagacagctggaaaggccctcttccttcccagctcagtgggtccggccaagggtcaccagacgggtatttgtccccacctccctaccaaccccaagaacacactccacacccctcttcgctgctgcggtgtgaagcttcagcctaacccaatcccacagagtccatctcgacagcctgggatgacacgggttccccagagggggacagagtgctgggtgtgggtgccagtttagac

SEQ ID NO: 12216 - DNA, 379 bp, Homo sapiens
ggcacgaggctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggctctctttagcttctggttcttgaaagaaattaatctgtatataacataagaaactttgaaagtcaaaaaaacaaaaaattttaattcctc

SEQ ID NO: 12217 - DNA, 384 bp, Homo sapiens
  misc_feature 99: n = A,T,C or G
ggcacgaggttttctcctgttaagctccattgccctcttccacattttgctattattataataaacattataaatgttaaaaactcaacaatatgttgntaaacttattgttttatgtactctatgctttttttttttttttgaaaaggaatttttctttttttcccccagctggaagggaatggccttaattttttttaacaaaaacttcgccttggggggttaaagaattttcaaatttaacccttctgaagaactgggaataaaggcttggcgacccccccttcagttattttgtttttttaagaaaaccccgggtgtttcaaagtaaaaagggggggcttggaactccgagcccaagggggtgccccccaccttgaaacc

SEQ ID NO: 12218 - DNA, 384 bp, Homo sapiens
  misc_feature 380: n = A,T,C or G
ggcacgagcaaagaattttattcaattaaacttgaaatgcatctggattcttaaaggttcagtagtgatcactgggacagggcgatcataaaactgaatgggctgtcggaaggtgtcgaggcagcagcaagggtgacattgccactgacgggggcttccgaactggggacgtttgtcattgggatgtgttacaagttcgggctgtggaaattactcgatgaaaaacgcacattaacgatagccatgaaatattagttaagggaaactaggttgagaaatgagacagcaggatctatcagagcctggcattgttcgccacagcccaggtagtgattaaaacgactgtcaagcggcagtgggtgggagctgaggagcacggngctg

SEQ ID NO: 12219 - DNA, 384 bp, Homo sapiens
cgttgctgtcggtgtagtccgagtttccacagccaggtactactccgccagtgaccctggacagtaacaaaacatataaagcccgagcccaaaccccgccaccatcataggtctgtagttactgtggaatcaataagccatggcatctaagaaatttgctgttaaaagacggggtttggctatgtaactcaggctagtctcgaactcctgagttcaagtgatacacccactttggcctcccaaagtgctgggattacaggtgtgagctaccattcctgacctaggggcttttctaaggaaggcagaaaatgtttgcctaacacagtgtgggaattttgctgtcctcgtggatcttcatatcttgccacaaggttcaaacaaagg

SEQ ID NO: 12220 - DNA, 384 bp, Homo sapiens
cgactctcctgctttggtatttgagtttgatttaaacaaagcgtcgtggatgggaggtgtatcatacgatcattttaaccattgtgccttttaatgtggaaaatctgcccaaaataggacctgctgcagtggttttcacatatacaaagaagtggctagaatgttctctcagaacagcacacgggattagaaaggacatttggccgctggaattcttcagtgagaattcagtgattaagcctgccttctgttttccttgtgggccgcagggttcctgtggatgtccccaccctcagattgctggagtagaaaacttaactttccaaaacactgagttgttttcagcccagcattagaggttaaagatgctcatgtagaaagccg

SEQ ID NO: 12221 - DNA, 380 bp, Homo sapiens
caagtttgatgcaacataaactgataaagtttgaaataaaaagagacaggttggtaggaaagaccattcatatcctatccccaaactggcttaagtccactcccactgcccccagctaccacctttttactttattctacctgctatttctttggccaccggaataataagcctgatgtaaattctgtttcatactcccacaggtcaactttttttggagtttgacaataattattccaagtcaagtaattcattgattttagtggaagattgttttccaggtgttattcttccatgcgcctcacccccatctcataaagtagaaaagagatgatttaatttatgggtctagaaaataaaaatgtaaatacttgcttgtt

SEQ ID NO: 12222 - DNA, 380 bp, Homo sapiens
ggcacgagattttggagacgacatggtgagaggctagctctagggatggtttagaaaataaagtcacctggggactggtccacccccttccggtccccttgcctgttggggtcagggctgccctgggaagggcagcgacgctgggttggtaggagcatagactgcagggcatctgcctgagtgtagagtccctgggcctctaattctgtaaaatcgcggtaatagcatccgcttctctgagctgttagaggtgtaacaggtaaacccatgtaaggtgcttaggacagggctggtgctggctaagtgccgttaatatcgtcagcatcattacctgcgttattgtagcactgatcgccatgtcagctgccttcaaggtctgg

SEQ ID NO: 12223 - DNA, 383 bp, Homo sapiens
ggcacgaggtgtgttcctgttgtggctatttttaagaatcggtgtttctcagaattgataagaccatggcacaaaactgtgacgattggctttggagtaaccctgtgtgcggttcctattgcacagaaatcagagcctcattcccttattagtgaagcattgatgaggagagcagcgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttctaaaca

SEQ ID NO: 12224 - DNA, 379 bp, Homo sapiens
gggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttccc

SEQ ID NO: 12225 - DNA, 154 bp, Homo sapiens
  misc_feature 10, 11, 12: n = A,T,C or G
aagtttctcnnnacacgatctgatggggtcttgggctaaaggaggtccctgctgtcctggagaaagtcctagaggttatctcaggaatgactggtggccctgccccaacgtggaaaggtggcaaggaagccttctcccattatccccaatgaaa

SEQ ID NO: 12226 - DNA, 384 bp, Homo sapiens
cggtgctgtcgggtggcttttgcctttgatcccagctatgccgaaggctgaggcaggagaattgcttgagcccaagaggcggaggttgcggtgagccgggatcgcgtcattgcactccagcctgagcaacaagagcgaaacaaaaacaaacaaacaaacaaaaaaaacccacccaaatcctttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttag

SEQ ID NO: 12227 - DNA, 384 bp, Homo sapiens
cgttgctgtcgggtggcggttgcctgtgatcccagctatgcgggaggctgaggcaggagaattgcttgagcccaagaggcggaggttgcggtgagccgggatcgcgtcattgcactccagcctgagcaacaagagcgaaacaaaaacaaacaaacaaacaaaaaaaacccacccaaatcctttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttag

SEQ ID NO: 12228 - DNA, 379 bp, Homo sapiens
ggcacgagcccgagctgccccctggctctcagggaccctggcccagcagcccgggaagtggccccggagcgtactcttcccttgaggggggctccctgggcacaggccccccctggaaggcaacccggccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaatggacccagcggcctccggggtgcagctccggaaggagactctgcagcccttgcggaggagtcccctccagccccgtccagccgcagctccagcaccgagg

SEQ ID NO: 12229 - DNA, 380 bp, Homo sapiens
ggcaccaggcgctttgtgactggaggtcatcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatga

SEQ ID NO: 12230 - DNA, 380 bp, Homo sapiens
cgttgctgtcggcacttctccctaagccctctctgggccgaagctactcctgccctgatctggggccccctggcccaggtgcctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtg

SEQ ID NO: 12231 - DNA, 378 bp, Homo sapiens
cgttgctgtcggccagagtgttagaggtatggggcagcttgagaagaaagggaatggcttaaaaaagccactatgcagatcaaaaaagggaacagggtaaaggtgagtagaatactgaccagccccatagataacaataaacaatgttaaatatgcgaatgacagaattgaaagtcatctaatgcaacttcatcaaaggtgagtcaggcttggtattgacaaaagaaagaggaaaactcacagtgagttagtggagtccatttatgtagttatgtgttctacctttttaaattgtagtaaactgagtttgggatagattgattctttcatacattctactccagttagtagatattaaatatatacatatattttatg

SEQ ID NO: 12232 - DNA, 152 bp, Homo sapiens
catgatatcctgaaacccacggcaggaactgaacctggtaaagagaataaggagtttggcctgagaaaagcaaactcttgcattctcagacaatgaggtagatcagttaccctacttcacagcataagaggggaatgtgctctcagcatttg

SEQ ID NO: 12233 - DNA, 377 bp, Homo sapiens
ggcacgaggcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagtgctacttttgacgagccttcaacaagctgcccagtcctctcctcagcagacgcatcaggttgtagttgcatctttacagtggtctttccttttattt

SEQ ID NO: 12234 - DNA, 377 bp, Homo sapiens
ccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggt

SEQ ID NO: 12235 - DNA, 153 bp, Homo sapiens
ctaaatcttttccttttgcttctccttaaattgattgtacttccaaatttgctgttatgattttttcctaatactgtgatctatctgatctgcagacaagaaccttgtctctgttgaagagcatcaaggggagattatgtacacattgaaatg

SEQ ID NO: 12236 - DNA, 376 bp, Homo sapiens
  misc_feature 43: n = A,T,C or G
ggcacgaggtgtgttcctgttgtggctaactttaagaagcggngtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgactt

SEQ ID NO: 12237 - DNA, 378 bp, Homo sapiens
cgttgctgtcggtttttgtgtttttagtggagatggggtttcaccgtgttggacaggctggtctcgaactcctgacctcgtgatccgcccgcctcggcctcccaaagtgctgggattacaggtgtgagccaccgcgcctggccagttggtacctaactcttaacacctttccttgccgtgacgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatat

SEQ ID NO: 12238 - DNA, 373 bp, Homo sapiens
  misc_feature 8: n = A,T,C or G
ccgagcantcgttttttgttcgtgcttttccctttttacccccttttttgaaggttaaggaggcggagcccctattttttactggcggggggggccttttaggggtttttaaccccctttgccccctttttaaaaaaaaaccgtttttttggggcttggaaaacttcgaaaaaatttttttttaaaaaaaggggcctggtttggaaccgtttttttcccaaaggaccggggcggaaaaaaaactttacccttggtccaaaaaaaaaaggggaaaccctggcccttcttagggggaaaaaaggcccgcgccctaaaaaacccgggggggtaccttttttttaaaatcaaccccttgatgatggggggagacccc

SEQ ID NO: 12239 - DNA, 377 bp, Homo sapiens
ggcacgagatttgaagtttgttaatggagtgacttgggcccaggacccaggaagttaagcagctcctccacttcacccagataacattgaaaactccgggtgctgaccagttttcctgccccactcctttcccagctgtcaccttcctgagagtagaggtctgagatgtccagggtgtagatgggagaaagcctggagaggagaagcaagagtcttctataatctctagataatcagtagcttagctaattgaataaagaactgaataaatgattttaattgaaatattgccatggtaatgctagtgttgtaataaagatgtggcatgtcaggaggaaagtgcaaccgatatttgggtctcctcaaattgttagtct

SEQ ID NO: 12240 - DNA, 377 bp, Homo sapiens
cgcctgtagtcccagctactggggaggctgaggcaggagaatcccttgaacccaggaaggggaggttgcagtgaactgagattgagccactgcactccagcctgtgtgatacagtgagactccgtcttgaagagaaaaaaaaaggtgggggggctggtttggaatcataaacataaatattgaaagtgctggtgacctttaatactacaattgtgtggtctgcagtcggggagcatagagatgggacctggtatttaataggttgtggttgcaatcagcatggcctgagggcccaggaagatcacacagctgacaccctacctgctttccttccagttactctgaccttccatgtctgaccctcctctccaggctga

SEQ ID NO: 12241 - DNA, 373 bp, Homo sapiens
ttccgttgctgtcgggggctgcccatcacctttcattctgctgggatcaggttttcttagtgcttgagaagactcaggagggcctgtcccatgccattgttggccttaagagcaagtgattccagaagaggagtgggcaccactctcatccagaggcccgtcctgagaggcaagtgaggctgtgctctgtgcctgggctcccccaggtggcacctgtcggtctgtggacctggttgaggcaaggatgcccatctggacatggagccgacacaggtagtcagggggccagcgggacgcttaccaacagctgtcttttccccacctcagaatagcattcctttcgaacaccacggcaagtagctgctcgtctcct

SEQ ID NO: 12242 - DNA, 375 bp, Homo sapiens
cgttgctgtcggggcgttcctgtcggggttgcagcggcgggagggagcccagtggaggcgccctcccgaagcgccactgcccatgctgaccacccagcccttcggctgctgatgtcatgagtaacaccactgtgcccaatgccccccaggccaacagcgactccatggtgggctatgtgttggggcccttcttcctcatcaccctggacggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggc

SEQ ID NO: 12243 - DNA, 377 bp, Homo sapiens
cgttgctgtcgggcagctcacggaattgtcatgagatggggtgttcccagtcatgcccatggcatctctgcctcctcgggccccacctgcctcgccctgtggcctgagtcccttcagctgtgtgggcctccctgagtgccctgagtgaggtggcagaaggggtgagaggccatggcgtctttggggctggtgagccggatctggccatctgtcacctctcaggcgtgcaggcactaatccctccaagcctcagttggccacagtgagaaggggcctggtaacactgtcctggatgccaggttgttgtgaaggacccggcttaacctctggcaggaaggaggtgctcacgaggtgggcacaggcagagggctggctgt

SEQ ID NO: 12244 - DNA, 367 bp, Homo sapiens
gccgtcaggtgcgggcccaggtggcaggcgcgcccgttgggcactgggggacgcgggcgcgtcaggtgaagactgggggccgcaggcgcgctaggagaactatgccatttttgggtcaggactggagatctcctggatggagttggattaagacagaagatggctggaagagatgtgaatcttgtagtcagaaacttgaaagagagaataaccgttgtaacatcagtcacagcattatcttaaatagtgaagatggagaaatattcaataatgaagagcatgaatatgcatcgaaaaaaaccattttagaaatgacacaaatactcaaaaggcatggctattgcaccttgggagaagcctttaatcg

SEQ ID NO: 12245 - DNA, 368 bp, Homo sapiens
cgttgctgtcggattgccaaagagtgattatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaag

SEQ ID NO: 12246 - DNA, 372 bp, Homo sapiens
cgttgctgtcggattgccaaagagtgaagatgtggctgagtgattgatgatggtctgaactgggtattcagggaagagaactagaagccaaccatgtagaatctatgcaggtgctcttaagacattggtttgactggaattatcttcttgttaggtcttaggaatctccttccaggtaactttttctatgattagacaattgatttgttcagggtcacagagcaaagtccacatttaattccacatggccaataaaagtgaggggctacaaggtgagatccaggggccagagttatcaaagtgatacagcacttttaggaataggacagggaatggaggaattggaattccagtattactttcaaaagcagt

SEQ ID NO: 12247 - DNA, 150 bp, Homo sapiens
  misc_feature 13, 15, 121: n = A,T,C or G
gaatttaacacangnggataccgaacttccattctttagtcattccaggcggatctgagttttatattcgaacttttaatacagcttttgagttttgagtgacttgaatttttaatctttnttttaatacgtagcttaaatgaacatatg

SEQ ID NO: 12248 - DNA, 368 bp, Homo sapiens
ggcacgaggtccagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagag

SEQ ID NO: 12249 - DNA, 372 bp, Homo sapiens
  misc_feature 372: n = A,T,C or G
cgttgctgtcgcttattattgctattaatattagttttagctgccaataataaattgagttactgttgatagcaatgtcaatgtcaaatataatacttgaaagtttttatctcaacacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacn

SEQ ID NO: 12250 - DNA, 367 bp, Homo sapiens
aattccgttgctgtcggttgcagggccttggatgtcaggccaccctgtgtggggtccctgttggcagccaggtccctacacaaacaagtaatcctgtttggcctcctaggttttgcatatgacctgcagcctaatttggggtgtaggggaagctctgctggcccttgctcctttgtatgttgggtgactttaatggctggccacatacccctttctcccagctactcattcactgacttgggtaagttctaagacagttcgcacttagaaaagaatgtgacacatcaacattaacttttcctgaaaagaagagtttgcctaacatggtcctaaagaagcttggaatttataagactttcctttataa

SEQ ID NO: 12251 - DNA, 367 bp, Homo sapiens
  misc_feature 367: n = A,T,C or G
aattccgttgctgtcggacttggcaccctctgtgccctggggcccctgcccagctggctgggccacctccgtgtctgggttcatcggcagtccccaagacggtgctccaggcccctagacagggagtgcgatcccacggcagtgggcagtcctgtcccgcgagcccggccctcagtctgagtggtgctgacctctaactgtggacgccatgctccatcctcctggtgggtggcggcggggcggggggggcggccatgctgggcagcccacacaagccactgtcacctgctgtcgccacctggccgaccctggttgattggggaatgctgtcagccccgcagcccctgtggccatagctggggcccgn

SEQ ID NO: 12252 - DNA, 364 bp, Homo sapiens
cgatgctgtcgatctttctgtgtttttttatactcttttagggttggctttttacaaaccatgactttccacttgcctgtagttttttgtttgctttggtttggtttgattttatatttttttctcctaatctatgactttattgttttttcttaggttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttg

SEQ ID NO: 12253 - DNA, 366 bp, Homo sapiens
aattccgttgctgtcggcatcttttatgtacacttgtctattcagacaagatcctcatgatttcagaaaaaatatagagagggtcctagactgcttaatagaggaaagaagtatcctggaaagcttgttaagaacgttctagagccacaacatgattgtaggccaagggcttgtttttgtgaccttgatctaagataatgccatggttgattgtatgttggaagaatctttgattggaatttggagtaatattaaggtagtttgtcttttctgcagacatttttaggagtctttttgtgtgagtggtggtggagtgtatagttttgttgaacctagttaaattctgaatatcttcccactaaaagc

SEQ ID NO: 12254 - DNA, 364 bp, Homo sapiens
ggcacgagacccgggaggcagagcttgctgtgagccaagatcaagtcactgcactccagcctgggcgacagagtgagactccatctcacaaaaacatgacctggacagggctgaaccggaaaaaaattccggggggcttttcaaaaaagatctttagggggaaaaaaatttttttaaccaagacccaaacctaaaacccccaaaagggaaaaccggacaaacttggcccctggttttttggggaaaaacaaccttccggttaaaaaaccaaatgggggccgggggtttttctgcccggaacccccaccatttgggggggcaggggcaaccccccctttgggcctaggagtgggaaaccccccgg

SEQ ID NO: 12255 - DNA, 147 bp, Homo sapiens
  misc_feature 147: n = A,T,C or G
cgcgtgctacgttcccatatccaaatttggaagaaaccacaaggctgcctctgactgaggccacaaatgggcacatagtttaccttcactttttgaaaaccatattaagattgagtcagcactccatatgactgcttgatgaccacn

SEQ ID NO: 12256 - DNA, 359 bp, Homo sapiens
actactgctgcgagaataccacagaagggtttcgcggcaagaatatacggaaggggaggggctagatgcaagcagagcacatcccccgtttaaagcactatggtggcttcacagtgcgcttagaaaaaagagaaattctttttatacaatataagttcctgcagaatgcagacactttctacttctccaggctcttttcaactcctctcctactagcttctgtatttaagccacattagacctttcttcagttttttatatagactttgttgcatcacacctcagagattctgtgcatgttcttcctcctgcctagaaaggatcgtccctccactttcaccaactaatcccttctcacg

SEQ ID NO: 12257 - DNA, 144 bp, Homo sapiens
tcattttgataactagctttccaggtggacttagccataggaaaatattactaatgtaatttaacaaattgctgcatgtatttcatttaaaaatatgcttaaaatgtcctaaaacaaataattatctccctaagaggatgcatt

SEQ ID NO: 12258 - DNA, 342 bp, Homo sapiens
tacggctgcgagaagacgacagaagggaccccctaccccctctaagggcttcaccaattgttctttagccagagactccttctacccagctcgccagccacctttgtgcagtggaggttgagaatgccccaaggatgcacgtaatggaccagcctttccagcatttggctttggctcccagaaattttgagctttggcaaatcttacaagctctgtgagcctctgtttccccatgttctcatattcagaggtgctgggctggactcccactgccagttccctgagctgtgcagggactcctgctctgcatggtttgttttggtgctcatgggaccataagtg

SEQ ID NO: 12259 - DNA, 188 bp, Homo sapiens
cccgaggtagcgccagcgccaagatactggagagcaagtgtccagccccagcagccaccccgcccttcacaccaccaccgaggacagtgcaggggtgcacactgagttctaggccagtgggtccctgactgctgcacatggcacaggccgttcccttccggacccaggcaggctcagctctggggagg

SEQ ID NO: 12260 - DNA, 460 bp, Homo sapiens
  misc_feature 16, 17, 18, 19: n = A,T,C or G
acaggggcattggaannnncctcttgtccttttgtgacgatcccatcgattctaattccgttgctgtcgaaatgacttattttatatgggatgatacacataggttatttgcaaatactacactattttatatgagagacttgagcattcgcagatttcggtatccacgggaggtcctggaaccaatcccctatggataccaagggactgctatgtattacaaagccacatgctttggaattacttcagtggtccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaaca

SEQ ID NO: 12261 - DNA, 465 bp, Homo sapiens
  misc_feature 11, 17, 18, 19, 20: n = A,T,C or G
ggtcttcgtantttcgnnnnatcccatcgattcgtctgcagtaaagtattttcacttcttttcttcttctcaatcttctcaatcacctgcccctagaatctgagtggtcctaacctagacctcttgctggccgagatttatacaatgtggttgtttttccttatcttgactaatcttcccgaatcttacattgtgccttaatttgcacatctgcacctctaatgtctgcctatattatctccttggctcacaaggaccttgtgggagagctgctcacatctcaacatgtaaataaaatgtgcctttgggtcaacacaggagaggtgattccaacgttaacaagttggtcaaggaaactgtcagctgtttatttttatttcaatctcttctgttaaactataacacactgattgagcaactaaacactaatatgcagagaggaaaaaaacacaaaaaatatattgg

SEQ ID NO: 12262 - DNA, 466 bp, Homo sapiens
  misc_feature 11, 18, 20, 24, 25, 26, 424: n = A,T,C or G
gcctacgtagncccctgnangttnnnatagattcccagtccgttgttgtcgcaacattcagggcttcatcgaagagtttcttcagatcttcagctccttgctgcaggagaggaggttcctccgggactattatgcactcttccccgaggccgaagacatcagcttgctgcagcaggcctcatcagtcttggacgagacgcggactgcctacatcctccaggcagtcgagagtgcatgggaaggggtgcacagacggaaagccacagatgctaaagacccatcggtgattgaggagtctaatggggagcctaacggggtcacggtgacagcagaggcagtcagtcaagcatcatcacatccggagaactcggaggaagaggagtgcatgggagcagccgcggctgtgggccctgccatgtgtggngtggaactggactctctcatctcccaagtgaaggacctgctg

SEQ ID NO: 12263 - DNA, 453 bp, Homo sapiens
  misc_feature 385: n = A,T,C or G
cgttgctgtcgccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttatgagtagcaacatacaggaattttcctgtggtggaggcaagttggtcaatgctgcatgatgagaggccatatttatgtaatttcttaggaacganttatggaaaatcatccagacaggcactaatgaacatttttgaaaaagattggaaacgatagcgttgtt

SEQ ID NO: 12264 - DNA, 423 bp, Homo sapiens
tcgttctttttgcggagcccgtcgagtcgaattccgttgctggccgcttattactttcatataagaacattacagggttggtttttcttgcatgggtggccacctaatgtttaaggagttctggtacctcttcctattctttattctattcgattccatttctgtgattcttttattaccactgatgttttgcgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactggccattttgaaaatatgaaacttgagtattgaaaatattccaacatggaatggcagtattctaatttcagttagt

SEQ ID NO: 12265 - DNA, 425 bp, Homo sapiens
ggcacgagagaaactggtgctagattttatggatatcagaataggaagttatttgttctgaatcttcaggtggttttccttttctcttaaatgttaccactttcctgcaaatttccatccttaatatgttagactgttcatatagatacattgtgtttacaacaaggaaaaaatgccaccatgtgctcagaacttttttgacaggtattttgagaagagttgcggaacattctggtaatttgtagagatctgttggcatctctgcttcacaaactggaaaaaatcatttgtaagtcttgctaattacttttcttggagaagaaaaaaaatgctacagctgcaacaaatgtatagttttcaaaaagaaacaacttttttgctcccccagttattcttagtttccagcccacgccttgcgatagcgg

SEQ ID NO: 12266 - DNA, 429 bp, Homo sapiens
  misc_feature 1, 2, 3, 363: n = A,T,C or G
nnnatcggcacgagattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagntttgttctacttcctccccttccttccagatgataacatcacatctctacagtaagtgcctctgcc

SEQ ID NO: 12267 - DNA, 425 bp, Homo sapiens
  misc_feature 367: n = A,T,C or G
cgttgctgtcgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcaaagctcangtgtgggaaggtgccaggggcaggggtgcaaaggggctgaggctgaggggggtgcaaa

SEQ ID NO: 12268 - DNA, 423 bp, Homo sapiens
ggcacgaggattaaaatcatacaaatggtggctgttctgagaatcagtctgggtattgattgccttttccagtgactggctccaggccatgtctaatgaccagctcgattccctgtgcagttcagagagcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacaga

SEQ ID NO: 12269 - DNA, 425 bp, Homo sapiens
  misc_feature 425: n = A,T,C or G
cggcagcggtggccgtagctccatcgcattttatgtttctggcgagaagggaacggagttttcatcaggcagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagn

SEQ ID NO: 12270 - DNA, 429 bp, Homo sapiens
ggcacgagggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaagagttgccactgctgaagcttggggtgaattaccttccgtccatcttcatcgctggggtcaattttgtgctgccggcccgggtcaagctcattgcttcactggagggctacactcggaggcgccagatcggttttattcttgtcaagaccgtgtgtctttgccttcgg

SEQ ID NO: 12271 - DNA, 428 bp, Homo sapiens
cgttgctgtcgaaaaaagagaagttcgctttatggacagacttcgtgaatgggaatttgcttataattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaag

SEQ ID NO: 12272 - DNA, 432 bp, Homo sapiens
ggcaccttggcttcccggcaggaggtggacacccatccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacagaaacaggcagggagtggagctaacagcttat

SEQ ID NO: 12273 - DNA, 437 bp, Homo sapiens
  misc_feature 424: n = A,T,C or G
cgttgctgtcgggggaccaaggccgggactgctgtggtgaaggtccgggaggctgagtaaggggacggaagggcacaggccatggaaaggaatgacatcatcaacttcaaggctttggagaaagagctgcaggctgcactcactgctgatgagaagtacaaacgggagaatgctgccaagttacgggcagtggaacagagggtggcttcctatgaggagttcaggggtattgtccttgcatcacatctgaagccactggagcggaaggataagatgggaggaaagagaactgtgccctggaactgtcacactattcagggaaggaccttccaagatgtggccactgaaatctccccggagaaagcccccctccagcccgagacgtctgctgacttctatcgtgattggcgacgacacttgccangtgggccagagcg

SEQ ID NO: 12274 - DNA, 431 bp, Homo sapiens
  misc_feature 313: n = A,T,C or G
ggcacgagacaggttctaaagaagtacccacgcctctggtgcatgaccaagccccctagccggcggccgaagctttacatcgtgaacctgcagtggaccccgaaggatgactgggctgccctgaagctacatgggaagtgtgatgacgtcatgcggctcctcatggccgagctgggcttggagatccccgcctatagcaggtggcaggatcccattttctcactggcgactcccctgcgtgctggtgaagaaggcagccacagtcggaagtcgctgtgcagaagcaaagaggaggccccgcctggggaccggngtgcaccgcttagctcggcccccattctaaggggctggtttggcaggggcttgacaaaacgcacaaaaaggaagaaagtgacgtaatcacgtgctcgatgaaaacaagttgcactttt

SEQ ID NO: 12275 - DNA, 427 bp, Homo sapiens
ggcacgagagacgctctttcggtggctgttgccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcacg

SEQ ID NO: 12276 - DNA, 427 bp, Homo sapiens
  misc_feature 421: n = A,T,C or G
cgttgctgtcgccaactccaaactgacctgggccgaggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggnctctgg

SEQ ID NO: 12277 - DNA, 439 bp, Homo sapiens
  misc_feature 363: n = A,T,C or G
ggcacgaggcggactctaaatgctctggacaaggatgtgcacgcggtgggcaaggctgacttgggcagaggctccgggcccagggtgtcgagggctaaaggcccagggcagcagcgtgccttgggggctggaggaattccaagaaggttgcagtggaggaccccgcaaggggaccgccctctggggaaagatggagcacgcagggcccagacaccagggtgtgtagggcagggtgtgggcactcacccggggcccctggttcctggggcaactggcccaccagccctgccaggtcagggggtttcctgagtgtgcaaagcttctctctccttccttgcgcattcttccctttacacgtgattntagttatttactcaacaagcatttattgccgggcgcgatggctcatgcatgtaatcccagcactttgggagggcga

SEQ ID NO: 12278 - DNA, 429 bp, Homo sapiens
  misc_feature 10, 11, 12, 14: n = A,T,C or G
acctacttgnnngnttggcaggatctcatcgatatcaattcggcacgagggatgctccatccaaagtgaattatgcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagacagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagag

SEQ ID NO: 12279 - DNA, 424 bp, Homo sapiens
gttcggcacgagcctacacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagg

SEQ ID NO: 12280 - DNA, 415 bp, Homo sapiens
ggcacgagctggggggaggcctatagcacagaggctctgtcctttgagggtgactgaaccaacaggggaaagcgaggcatggtgaaaatagccatggatggccaggctggtctcgaactcctgacctcaagtgatccacccacttcggcctcccaaagtgctgggattacaggcgtgaaccacctcgccctgcaggagttgattttaattatgaaccatgattaaggaaggcaatgaccacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatct

SEQ ID NO: 12281 - DNA, 413 bp, Homo sapiens
  misc_feature 413: n = A,T,C or G
ggcacgaggttagaattaaagcttatatttctaatcaacccatttacagtatttcacttagcctataccttattttagcatgagagcataatcttacactttcatgctaaaataaggtataggctaagggaaatactgtaaatgggttggttagaattaaagtttagaactctaaatcttatgcttatttttaaagaaaaaagttgcctcactgtcatgaaatcctgttactttcattaaaaaaaaaaatcttgtaaaatggttaaattggataatgtaagacataatgaaggctttgaggcatttcatactttaccagtttacatttggctaacatactggtaaggattagggttctctccactattggaaaattaaatgctaaacgtcctaagaattacgttgatttcaan

SEQ ID NO: 12282 - DNA, 422 bp, Homo sapiens
ggcacgaggagagagagagagagagagagttagagatagagagagagagagagagagagagagagagagagagagagagagagagagagagagagagagagagagagagagagagagagagagagagagagagagagagagagagagagagtgagagtgtgagagacagagagagattgagagcgccccccccctctttctctcccctctctttgtttttttttttttcccctctctctctctctctctctctctctcttttcttttttctctctcctgaggggtggcccccttctctctcttctctctctctcgcgcgcgcgctcctttttttttgtggctttctttgttgggcccctctctcctctccctctctccctctctcacccctcctcgtgtgtgttcgctccctctctcccccc

SEQ ID NO: 12283 - DNA, 414 bp, Homo sapiens
ggcacgagctggacttaaacattactggaattttgtgtaaatggtttcttacaagatttcacatctttacaattctgatgcttttttaaaaaaactaaactttaatatttccatttaaaattaaaagaaatgggaaattgcctacggagcatattgcttttcagatcataggtatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcatgcgtccaccctgcggctacgggagaagtcttagtaacttggatctggagtcttgaaaaacacaaaccttacaaatgcatctttctttg

SEQ ID NO: 12284 - DNA, 405 bp, Homo sapiens
  misc_feature 114, 351, 352, 353, 354, 356, 357, 359, 363, 366, 369, 370,371, 372, 373, 374, 376, 390: n = A,T,C or G
cgttgctgtcgcaggcacacaggtcccggggcatcaggagaaaggctgggtcttgggaccttgtcctccccagttggcctactgttacacattaaaacgatttgcccagctcanaaaaaaaaaaaaaaaaaaccttcgggggccgtttttttcgtaaaaccaaaactgaaaaaaacccttggggagttgggacaacccccccctaaaagggggggaaaaaaaggctttttttggaaaattggggaagcttttgttttttttgaaacccttaaaacccggaaaaaaaaagtaaaaaaacaaaatggctttttttttatttttaaggttcagggggggggggggggaatgttnnnncnncncccnccncannnnnntncccaaacaaaaatncccaaaaaaaacccc

SEQ ID NO: 12285 - DNA, 406 bp, Homo sapiens
ggcacgagcacagtcagtgttaaagatgtgtatgtatattactatacatataaattgcacagcggagtatacatgtcaaatcatattaatcaaaatttatctagccttcctttaaacaatttatcctataatatggatattaggcctctttttctacttagctccagtttaactacgtctaggctgatggtataaaaatcacatgaaatgcgcaatggcctatttcttattagaaaccttaaatggacatataccaaattatgagaattataaatgtagcacaaaggataggggtgagtctaaatctattctgtaaagatgaaagctcttattttctaaatctattctataaagatgaactattttttaatctataaacctcctttaagggacgcagagcattcat

SEQ ID NO: 12286 - DNA, 406 bp, Homo sapiens
ggcacgagtgtagatctcaattaaagaactaacccaggatacctgaactaaagagaggtggcactgagtttccatagaacttcaaaacaattggttgatttcacttaaaaaaaaaaagtcattcaatatacagaaaattactcccctggtcagtactgttagccccaaataatctgaaaaaatttgttcttaaaaaaaaaaacaatttggaggccaggcatgggggttcatgcctgtaatcccagcacattgagaggtcaagttgtgggcatcacttgagcccaggagtttgagaccagcctggacaacatggggaaaccctatttctacaaaaaaatacaaaatttacccgggcatgggggcgcatgcctgaagccccagctactcgggaggctgaggcggaagt

SEQ ID NO: 12287 - DNA, 407 bp, Homo sapiens
  misc_feature 1, 2, 6, 8, 391: n = A,T,C or G
nncccnanaattcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgcanagtgcattttctgtcg

SEQ ID NO: 12288 - DNA, 407 bp, Homo sapiens
ggcacgagatttcttggtattctgctgctgggaataggcttacttattcttttaacatatattgtgtgactacgcaagtataggtcctgttgtattgcattaatctttaccagtaactaaacatcacaaggttaatattggcttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttggttagtaaattccatgccttattttccatttttgacaccgtaaagtgcattttctgtcg

SEQ ID NO: 12289 - DNA, 407 bp, Homo sapiens
  misc_feature 407: n = A,T,C or G
ggcacgagacaattccggggtaaattaatttcttagaaatgtttcagagaataatactttctgcctcaaaagtatgcatttattatgtatcaaataaaattttaaatttagagaacattgaagaaatatgagatcagagaaatcaaagattattattaaattacatttcttttggtatctcctgagatttctcagttatgcattacttgtattcattcatttattcatcaaatacaatatttatctaaaacctgctatgaccaagactgggtgaggaactggagacatagctattaaaaaaaatagtatttatatttataaatgatgaaacaaaaagaaaaaatagaaggtgaatcggtaggtaaaaagagacaatagactaccagccaatctcaatgtgtgaaccn

SEQ ID NO: 12290 - DNA, 422 bp, Homo sapiens
  misc_feature 1, 2, 3, 4, 5, 6, 7: n = A,T,C or G
nnnnnnnctttaatcccagcactttgggaggctgttgctgatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagcatctatttttctccattatttatt

SEQ ID NO: 12291 - DNA, 168 bp, Homo sapiens
taaaggacttaaacacctatgcgcgatgataaagagggtactattatagcgcttggaaaataccaggaagttgagagagttaacagaagggcgcacgctggattggccacaaaatcgaattactgaggccactactgattaggacacttatggagaacgtgggtagca

SEQ ID NO: 12292 - DNA, 410 bp, Homo sapiens
cgctgctgtcgatagatatgtatgtttgcatataggcacatttagctggatgaagttagatttaaatggtccaatagagaactgtgcatacaattacataggcaaccacaaatcaaccctttctctgggctatctaaaataatcaggtactagaccaaaaaatgacatgctgtctgccttaccttttagtgatgatttgtaggaagaggaaggtaggggctggtgagtggaaaagtagtagaggttgtgagggaatgttctgtatgtctgaagacaaagtctggagattggtgggccagaaggtgtgaatctactctgaaggacaggcaagagtccagcccagggaaaaaggtgcagatgggtaggatttgggtgggtacttgaattaaaaaaatgaatttgcgaggcat

SEQ ID NO: 12293 - DNA, 422 bp, Homo sapiens
caagagactgacccttgaagctcactggctgcatgggaggatatgggtgttgaaaaacatctggaagaaagggggaaaagggagcagagaaggcaaccaacaacagctattatagatgcagattttggaggcagaccgcctgggatttaaaactttgctctactactttcgagccatgtgatcaagctaatgaaactttaaaaaccttactttctttaataagtaaaaaatgaaaaataatacctgctcttgagattgctaagattaatgaaagaacgtatgagtctgtcaaatgtcctggtccacagaagggactcaatgactgtgttccctttgttcttgctaggatgtgcattaggttacagtgtagccacttgatagcatctgaagggatcattaccttgctatatccaacaaatgtg

SEQ ID NO: 12294 - DNA, 406 bp, Homo sapiens
ggcacgaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggaggggggaagggtataaggggggctaaaaatttgaatccttattatttttatttacgggagaatttacaccatctccg

SEQ ID NO: 12295 - DNA, 420 bp, Homo sapiens
acatgatctttatgcaggatcccatcgagatcgcttttaccacggccatatggccagataacttttcaaaagcattagttaaagaattctgattagtttgaattagaaacaaaactcaaagaacatgacctaatttaacaggttaatttgaagtgcatctgccaagtagaagaccagcaagaaaaaaaaaatgggttcctaggaagaggtagtaggttgcatagttttagggcagggattttgcccacaaggaggaaactatacgacctgctgcctttcttagggccttattattcaccgataacctgtttccttgctactttgctttggtgtaagcagagttctttctgtaggttttttcaaatgaaaacattgcacgaatatcaaagagagcagtgtttgcgttagtgattataaact

SEQ ID NO: 12296 - DNA, 420 bp, Homo sapiens
cggcacgagcaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtg

SEQ ID NO: 12297 - DNA, 411 bp, Homo sapiens
  misc_feature 395, 411: n = A,T,C or G
cccaggcactgtactaatttctgaggattcttttgtgatctcaaacagatatataagccttgctcttatggagcttatagtctagaaaactggatgagagtctacatactttccattgctttttagtttttggaagaaagctctgcaggtgaggagaaggacgtacgtgtgtatggtatgttaactttttctgtgagttgggtcagatgaagcagttagacaaaatgagtctcaaaaacatttttggcaccgaaagtttgatgaactatactttttaagaattgctagctttgtttttctcttataatctaaagggaaatatgtccacttgaactgaaacaactaagcacaatatatagaacttttacttcccactcttttgtacttaggtcagngatgttgcaatatctn

SEQ ID NO: 12298 - DNA, 409 bp, Homo sapiens
  misc_feature 370, 395: n = A,T,C or G
cgttgctgtcgcacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtaaacggngtgtgtgagtgtgtgggtttaactntggttggcctcatg

SEQ ID NO: 12299 - DNA, 411 bp, Homo sapiens
ggcacgaggtttattccctcctgcatcatttccataatttgcttttgtactgtcaatttagaggaaatgtgtgatgctggtgttttgtttggcctgtttgtttgatgctgggggttttatgtgttgtaccctttaccccttacattgtgtaatttgaaagtggcaaacaaacctgcagtaaaagtccttgattggcatcttcattcggatgatggagagcctttgtggtagtgtttgcttatgtgaacagcaggcctttcagataagagaagtggcttttccttggtgatgaaggggtagagattgagccatggggatggtttaggttaaagaatgcttttttttggccatcatgaggatctaacaacagagtagaaggaaggatgccctaggtcagcatgcagggtggtg

SEQ ID NO: 12300 - DNA, 417 bp, Homo sapiens
ttcaaattcagttcagtttctggtcatcaaaaaatcaatctgttttaagatctagtcttacccatgaaaactttaataatggtagatatctaaaacatgagttaattacccccaaaatgtttcagttttttcattgttatattgccaaaaaccattctggctatatatatttttaaaagaagccatttgcatgtcctttagtggtagaatagaaatttggttaaaattggatgacatttactttaattatcttcaaagtatgatgaatttttcatgtgtggaatgtgtggtctgataattttttaggaaacaacactccactagagagcgtagaatcttagaattcatctacttcattctcctcctggtactctactttcttctacaacgtcccagccgagctgaggtctgagctgt

SEQ ID NO: 12301 - DNA, 410 bp, Homo sapiens
tacggctgcgagaagacgacagagggatgatctagcctctgctccagaaggatctgtctggctgccatgtgggggacatggagtggagcaaagacaggagcccagtgagagtcgagggagaggtgacctcagcttgggctgcggtgcaggccatgggactggcaggaggcggctggggttacgctgtcttttctaacattcagcattggctcaggggccaggtcagggctcacagactgttgctataaagggctgggtggctttcttccccacagctactcagcctaatgccattgcagagcacatgtagccatggacaacacaaggggcgtatccgtgttccaggacagccatattgacaggaataggcacgaggccagatttggtcctcaggctgtaatttcttgccc

SEQ ID NO: 12302 - DNA, 414 bp, Homo sapiens
cgttgctgtcgtccaatccattatctagttttctgttcttatcttacttgtctgcccctggcactgttcttcacagttgtactcgctcctttttgcttccaaattacattttcctcatctggtactgagctccctgttaactttctttactcttggttttagcatttccatttccttgaatgtgccagagctctgtcctctgggtctttgtacaggttgttccttgggcctacaatactcatttccaaacttttcacttaactaagaattgcaggcctcagcattaatgctacctgaagctttctctaatcctcatttaaattagttctgttacaaactttcaagttgccatattctttcataacattaacacaaattttgtaaacatgtatttggtggtttggctaatttctg

SEQ ID NO: 12303 - DNA, 416 bp, Homo sapiens
cgttgctgtcgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtg

SEQ ID NO: 12304 - DNA, 405 bp, Homo sapiens
ggcacgagatattcctttgtgagaaaagttttgatctttagcctagaatgatgcgtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgg

SEQ ID NO: 12305 - DNA, 416 bp, Homo sapiens
  misc_feature 397: n = A,T,C or G
ggcacgaggagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcanagcatcgtggagacagctg

SEQ ID NO: 12306 - DNA, 411 bp, Homo sapiens
ggcacgagcatgcttcgaaacggagctcccctcaccagactcccgagtgacaagctgaaagcagtcatccccccattcctacccccttccagttttgagctgcggagctctgatcggtcccggacgcgtcacaacgggaaggcagaccccatgaagactgcgctgccccagagagccagcaggggccaccccgtgggcggcgggggcacagacactcagaaattggagaccagcagaaggcctccatctggaacttccactacctccaagagcacctctccaaccctcacgccctccccctcacccaaagggcacactgcagagtcctcagtgtcttcctcgtcatcccatcggcagtccaagagcagtgtgggctccagcagtggcaccatcacagatgaggatgaactg

SEQ ID NO: 12307 - DNA, 411 bp, Homo sapiens
  misc_feature 411: n = A,T,C or G
ggcacgaggtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcn

SEQ ID NO: 12308 - DNA, 417 bp, Homo sapiens
ggcacgagccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaagatgcaggaggaagtaggtgagctgaggggaagctggtggggataggcctggtggggcctggggagaaggatttgaaggctcaagtcacacggtgcaggatgggactcaa

SEQ ID NO: 12309 - DNA, 413 bp, Homo sapiens
  misc_feature 225: n = A,T,C or G
cgttgctgtcgggcgagtctttaaaggagtggctcatctttcctctccctggggcattttggtgtgggagactacaggggatgaggttaaaaagcttggtcggcaggtagaggatggggagagaggttagggccctgggaaaggtgggagatcagccagagacaggtttcccagaacagaatgtctggcctttgtggtgaggagggactgtggtatgagccgcanaagcgggccaggggtaaaccctcctgtgcgtccttccttcagcctggtcctgagggtgaccctttgatcctgggttctccaggtagggctgtgagctgtgagttggatccttttggtgaaatggtctctctcatctggcctgtcactcaatgtggaatagagtgagtgagttctatgggttctaagtc

SEQ ID NO: 12310 - DNA, 407 bp, Homo sapiens
ggcacgagcccaggctcaccctacggaaagagggggttctgttggccccacatgacctcatccctgatgtgctgcagagcaatgacgaggtgttggctgaggtgacttcgtgggacctgcccccgttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctgggggctgccctgggcaccatgcccagcctggccctccttgacctctcctccaat

SEQ ID NO: 12311 - DNA, 405 bp, Homo sapiens
ggcacgaggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagag

SEQ ID NO: 12312 - DNA, 411 bp, Homo sapiens
ggcacgagggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgct

SEQ ID NO: 12313 - DNA, 411 bp, Homo sapiens
gctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgtctctccagagaaaactacctatgacagtgccgaggaggaaaataaagagaatttatatgctgggaaaaatacaaaaatcaaaaggatttacaaaactgt

SEQ ID NO: 12314 - DNA, 406 bp, Homo sapiens
gctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgtctctccagagaaaactacctatgacagtgccgaggaggaaaataaagagaatttatatgctgggaaaaatacaaaaatcaaaaggatttacaaa

SEQ ID NO: 12315 - DNA, 415 bp, Homo sapiens
cacactccacgctgagaaagagtaattaggaggcctgatgaggggccgaggaaaggctgttggggtgtgctggggttggtaccctagcgccttcccctcacctcaaccagagaagagcatccgggtgctttttaaagcttttagcctgccctagcaaggacaaagcatgttagattaaagatgcttctgctgatcgcaagggttcttatttgaaaacatctataatgggggaggtgtgggaggattctttcaaggacctgcacagcctcctgatggagatccaggctctgcgcttgcaactagaaaggagcatcgaaaccagcagcactctgcatagcaggctcaaggaacaactggcaaggggtgcagagaaggcacaggaaggagccctcactctggctgtccaagccgagcg

SEQ ID NO: 12316 - DNA, 407 bp, Homo sapiens
ggcacgagccgggcccggccctggagatggtccccggcgccgcgggctggtgttgtctcgtgctctggctccccgcgtgcgtcgcggcccacggcttccgtatccatgattatttgtactttcaagtgctgagtcctggggacattcgatacatcttcacagccacacctgccaaggactttggtggtatctttcacacaaggtatgagcagattcaccttgtccccgctgaacctccagaggcctgcggggaactcagcaacggtttcttcatccaggaccagattgctctggtggagagggggggctgctccttcctctccaagactcgggtggtccaggagcacggcgggcgggcggtgatcatctctgacaacgcagttgacaatgacagcttctacgtggag

SEQ ID NO: 12317 - DNA, 409 bp, Homo sapiens
  misc_feature 409: n = A,T,C or G
cgttgctgtcggtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcggcaccctgatctgcactccctgaggggctcccactgtccgcggtgtgaggatgtccctggatagtccactgtgtgcagaggcatgggagtn

SEQ ID NO: 12318 - DNA, 410 bp, Homo sapiens
ggcacgaggcagacatgatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgatgctaaaataaaaaatatcatttccacggaggatgccaaggcccgtctgctggcagagcagcagaacaagaagaaagacagcgagacctccttcgtgcctaccaacatggctgtgaattatgtgcagcacaacagattttatcatgaggagctcaacgcgcccatacggagaaacaaagaagatgcccaggcccgg

SEQ ID NO: 12319 - DNA, 412 bp, Homo sapiens
ggcacgaggggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcataagcagtgaaagtggcaaagggttt

SEQ ID NO: 12320 - DNA, 405 bp, Homo sapiens
ggcacgagtggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagac

SEQ ID NO: 12321 - DNA, 421 bp, Homo sapiens
  misc_feature 402: n = A,T,C or G
ggcacgagggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattanagcttattacctaactgag

SEQ ID NO: 12322 - DNA, 408 bp, Homo sapiens
ccatcgattcgaattccgttgctgtcgagagaagccatgaataatcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaag

SEQ ID NO: 12323 - DNA, 411 bp, Homo sapiens
ggcacgagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgc

SEQ ID NO: 12324 - DNA, 397 bp, Homo sapiens
ggcacgaggagagagagagagagagagagagagatatgagagagagagagagagagagagagagagagagagagagagagagagagagagagagagagagagagagagagagagagagagagagagcgcgcgcgcgcgctctctagagtgtgttttctctctcccgctcatttacgcccccccccgcggcgcacccccccccgggggggggggccctctctcttctctggggggagtttctgcgcacacacacgcgagagtctctgttttttttttgcacgcgctctcgcccctctgtctctctctcttttctctctctctcgcgcgcgtgggagactctctttgcgcgccccttttctcatgtgtctatgtgtttgcgcgctatattatagagctc

SEQ ID NO: 12325 - DNA, 402 bp, Homo sapiens
ggcacgagcaggagttcaagaccagcctggccaacgtggcaaaaccctgtctctactaaaggtacaaaaattagctgggtgtggtggtgcacacctgtaatcccagccacttgggagactgaggcaggagaatcacgtgaacatgggaggcggaggttgcggtgagctgagatcacgccattgtacgccagcttgggcaacagagcaagactccagctcaaaaaaaaaaagagggggaaatttttgtgaaggggttttttttttttcgaaaaaaatgtttgggggaccttccgagagctcacaaattttgatgaacgttaaaaagcctagtttgaggcggggcgggggggttatgcgcatgtccccaccctttttggaggccaagggggtgggaaccaccca

SEQ ID NO: 12326 - DNA, 390 bp, Homo sapiens
ggcacgagtcccagctacaggaggctgaggcaggagaattgcttgaacccaggaggtggaggttgcagtgagttgggatctcgccactgcactctagcctgagtgacagagcgagactctgtctcaaaaaaaaataaatgaataaaaaataaaacagcaactcttgcagatttcccgaatgtattggtcccagagaacactgaaaataatgtcatgttgttaacaccagtgggagtttgggaaataattccagctctttaatacttctttcagcttcagattaagtgaaatgagtttcacatatttcaatatatgaaattttatgatgacacataaaacaggccaggggttattgaggacacatctgtgagatagtgggcaatgctactg

SEQ ID NO: 12327 - DNA, 392 bp, Homo sapiens
  misc_feature 392: n = A,T,C or G
ggcacgagaaggtacattccagggttctggggaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaaacgccgtctctactaacaatacaaaaaaaattacccaggtacattggcacatgcctttaatcccagctaatcaggaggctgaggcacgagaattgctcgaacccaggcggcagagcttgcan

SEQ ID NO: 12328 - DNA, 385 bp, Homo sapiens
ccacattcatccccagcctcgctgtacagctataaagtggggagtggccaatcaataaatcagaggcacctgaaaaatgaactggggaaccacactgactttcccccccttcttgattaaaacaaacaacattgcgaaaagtcaacctgtcactctttaggaaagtttgcggcatggaaaggcaattacccaaatgactttttaaaagtatgaaaatttgcctggctgaacgttttttacttaatgccgtgagttaacattaataactattcctagcttagtgagctgggcttgaggggggattaggaaacatttggtatctctggcagggacagatgttgacctggacggtcggcggcttttacaaacctaaggactatagggg

SEQ ID NO: 12329 - DNA, 404 bp, Homo sapiens
ggcacgagaataagagcagtatccttagctctagccaagcatttttctaattcctgcctttggtcacaaagaaggaatagcagagctgtgaatgagttagtggaggtcagtcacatcacagttcatgacctagcgattgctggtgaagtaatattggaattttggtaccatgagaagacttataaaggatttcatcagaagttttcattttttctaaatcctcccctactcaattttcacattggaaattactcttgtatttgtagaagattgtctctaaaattgtggtttaactcacgcaggaagtaagattcctatagcaagacatagtttcattttagaggacccccaaaatcccgtgaattctctggtgatgattctagcctaaccttcaacataaaata

SEQ ID NO: 12330 - DNA, 403 bp, Homo sapiens
ggcacgaggtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgtttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttgagggagcctcgctttgtccccaggctggagggcagaaccacaatcacggctcactgcaatctttgcctcccggtttcaagggattctgctgtctaa

SEQ ID NO: 12331 - DNA, 386 bp, Homo sapiens
ggcacgaggggcatttgtgagaaagatgtccctttcataatatatgcagtatattccagatgttttgagagattacagaataggaggcctgctccacttgcagataagtttattataattctccagaaatgtgcaggatgtgcattagcaaattgcactgtacttttcactccagcctgggggacagagcaagactcccgtctcgggggcttaaaaaaaaaaaaatgctgtttctaaaggaatctgagtatcttgggcccaaatgtgggtttgctccaatttatttaaaaagggcttgtttcaaacgaataggggccctataggcaaacgccttatattttttaaaacgaattttctggagtgggttttcattttaaataagaact

SEQ ID NO: 12332 - DNA, 404 bp, Homo sapiens
cgctgctgtcggactttgcaagattttttaaaaataaaaggaggtataccacctccttgcttggtatcttttacaaaatgttatactttatggatataaaggtgataaagattggaaataaatcttctaaatatgtaaaatgaaagcaacagcaacagcaaacacaattatcgtattctttgggagtaacaaatactggttttcattttaaaactaaggaaaattttatcagtacttaaattcaatccaaaaaaggttttataacacccaaactgtacatttaaaattatgctttcttaaggtaatggctagcattacctagtttgtagttttcttgagctgtaactttttataactgaatcatttcagtgatttagggctgtctcgtagttggggaagagaaa

SEQ ID NO: 12333 - DNA, 388 bp, Homo sapiens
cgttgctgtcgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtaagttactatgaagcagtagtgagaagaacagaagggccatgatggggagaaagtttggccc

SEQ ID NO: 12334 - DNA, 389 bp, Homo sapiens
cgttgctgtcgctaaacgcagataacgtaagagtaacaagaaactaaatcaaggagcattatatagcctacactgcagagactcaatataataaaggtggcgattcttcctaattatcagatttactgcaattccagccaaaatgtttcaggggatttttttgttcgttgttattgcttttggtttgccctttagcttcacaggtttggtctgaaatttatgaggaataaattcttacgagcagcacgaaaaatttcgaatctatttgtagaaactgcatatgatgatggttcatactcagagagagaaagattggatttggtggtattactagaagttcagggactcactaatagtcaggcgagtgcacaattaaatcacattgaact

SEQ ID NO: 12335 - DNA, 398 bp, Homo sapiens
  misc_feature 398: n = A,T,C or G
ggcacgagagggaatccccccaactcataaattataaaaatgacacttccaagccatcaatgaaggaagtgtcatcattaaagtggtagtgcaatataacaaagtgtttacaaacaaaacaccatccaacatacccccaaatgctcctttttggttgttatacagtttgaaaaaagcctacagttagctatcaattccttacagcaatgaagtactaagctaaacaatgcattcagaaatttcttaggccaaatcctgacagtataccaactacgagttggtaaacactgtttttaatcctgctgaagaagagaaacgcgaacaccaagtaaaacttactataaactacaaatatttcaatatttacactcaatatgagttcgacacagtagtataan

SEQ ID NO: 12336 - DNA, 388 bp, Homo sapiens
ggcacgaggggcacttggccatctcttatttctctacaataaggaatacttcatccttatttgtaattcctaaaactagactaaattttatgtacatatgtattcattcatttctttattttagtttgttgatttaagaatattcccacaagttaaacaatgaaagtgatagttatattacagatatgaatgactaattattcctgcccaccacctacatcattttccccccagcttaatggaggttttattgacaaacaaaaattatatatacttgcatccagtcataaaaaagaatgagatcatgtcccttgcagggccatggatggagctggaggccattatccttagcagactaacacaggaacagaaaaccaaatactgcatg

SEQ ID NO: 12337 - DNA, 387 bp, Homo sapiens
cgttgctgtcggggtgaactttttatactatacttttacagatagaaatgaaagtacttagtaataattgaacatatgtacagtaaaaatattatagctgttgttttaaaataattgtattaaattgaaacttaagttagtcttcaggctttttaaggttttcaaatttgaactggaatgcaattcagaatgtgctagaataacatttctccatttctccagtgtcaagatgggaaggcatacattctaagcgtctgtatctccatctatttttcttttttttttttttttttgaaaaaaaaattttgtttttgcacccaggctgggggggcggggtttaattctggcttcttgaaaaatccggcctccagggttaaaccttttcct

SEQ ID NO: 12338 - DNA, 385 bp, Homo sapiens
tcaattcggcacgaggtcccttgttgccattctgaatctgaatgctcttgtggctggacaactggactcagctaataaggcatttctgatgcttttgtgttcttatgcaaggatggaccttttccagcattgtaaatgacagcaggaaatactcaatgggccacaggaaataattaacatcatctgggatagactgactcacaagttaaaagtaaggactttaaaatctgacctgggaattaaatctagttctaacatatgttgattctgtggattagacgagtttcttagtccctctgagtcccacttctctcactgagttgttgtgaaggtgaaatgagaacatgtttgctattagctaagcatagtctttggctagtagaga

SEQ ID NO: 12339 - DNA, 389 bp, Homo sapiens
ggcacgagcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggatctttttctaaaaattattg

SEQ ID NO: 12340 - DNA, 161 bp, Homo sapiens
gaatgttccggtcggtcttcagcataagctgaaatatatgcatgtaaaaactttgacatctttttttttaattttccactttcttcttaactttacttctctttttgtccccccccccatcttaccaagttgaggccaagggagaatggtaggcacacaac

SEQ ID NO: 12341 - DNA, 397 bp, Homo sapiens
ggcacgagataggggccctctgagaagatggaatggtgaaggctgcgagtagtttgtggatatatcagtcatatcttggcataatccaacagcgtactaatggatcaagggactattttcaaggctgagcaggtttaaggaaaacatctaggtgaaacatctaagggctagctagcaataggagagccattatcactctttttttttttttggcaggggaatttcccgggaccttttattggccttttgggcaaacggaacgggaccggtaaaaaccccattggactttccaaaaatgggcaaagaatttccctaaaaaaaatcttctttccaaggtttttttaatggggggccccttaaaattataccctttttttaattaaaaagcgttcacttt

SEQ ID NO: 12342 - DNA, 404 bp, Homo sapiens
cgctgctgtcgcttttaatatggaatccacctcataacaattaagtctaaatttctggaagatggagccatgcttggttttccaaaagctctttgagtgattctaatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggag

SEQ ID NO: 12343 - DNA, 399 bp, Homo sapiens
ggcacggaggagagagagagagagagagagtgagagagagagagagagagagagagagagagagagagagagagagagagagagagagagagagagagagagagagagagagagagagagagagagagagagatagagagagagagagagagagagagagagagagacacacctctctctctctccccctctctgtgtctatatcgcgcgcgcacccccctgtgtgtgtgtgtgtcttccccctgcgacactctctgtgtgctctctctctcacacacttcccccccccccactcttttttttttttttatacgtgttctctttctcaataatatatcctttgtctgtgtgtctctctctctccagacagcgctctctctcttttttacacaccctccg

SEQ ID NO: 12344 - DNA, 389 bp, Homo sapiens
cgttgctgtcgatttttctcatcagcaggatggggtgatggagctggccttactgggtgctggggatgatataaagaggtggcgtgtgcatgtctgtgtgtctgtgtgtgggcgaacatgtttggtaagtgataggctctgcacacgtgcacggcaccatcatggttccctccctgcagcacttggcacgcagtgggggctcagagcacaggccgactgatggcctggggttgcagccctgctccgtgtgtccctgggcacttgcttactgaccaccccacaggtgaacacgggcaggtgggtgtttggaggtgtgaggctgaggagggtctggatcttgcagctcttgcagcctggatagttatggggtctggagggggcttttattg

SEQ ID NO: 12345 - DNA, 387 bp, Homo sapiens
cgttgctgtcggagacctgtaatctcagctactcgggaggctgagggaggagagaggcttgagcccaggagctggaggttgcagtgagccgagattgcgccactgcactccagcctgggcgactgagtggagcggaactctgtctccaaaaaaaaaaaaaaggggtttttttaaaataaccacttttggtaagggtaggggaaggtaaggggggcccaaaaacaactttgtttttttaaatataggcgggaagggaaaaaaatggaatttccttgttttttcccaaaaaagacaaccccccaatttggcagggctaaaaaccattcccgccctttggaaaaaaagaaaacttcaactttgggttttttttggaaccagggaaacccg

SEQ ID NO: 12346 - DNA, 385 bp, Homo sapiens
cgttgctgtcgaaaaaaagggggagttcattgttgagtatgaatttaaagtaaccagactgccttttgtccagtggctgtcagtaatttacttcagcaggcattttttttttttgggggtggtccaataaaaacagaacctttttggaagaaagggccttccaggggggaggcatccggaaaaggggggaacctctttaaggaacccaacccaaaaggaaacctggcccgggaatttacccataagaaaaacggtgaaggggttttgtttacttttaaaaccgcacacacacacccacacacccacacacacacacacatttttttctatactcttaaaaaaccgtagagttttaacaatccggggggaggggatttaataatat

SEQ ID NO: 12347 - DNA, 387 bp, Homo sapiens
ggcacgagccctttgagatttctggctttttgtagggacctcagttccattttcccaactcatgggttctcaataccttaactatcttttatttggcaaattccaagtcctcaactcacccaccactacctgacccactggagtcaccacaccaccctacccactttcccagggatgctttatgattagcttaaatactcaccattctgatttgtaatgccgcccccaccccctttttttgacacctgggagtttccttttctttcttgtaagatcagcattacacaaacaagcacatttttcttattatactttatctagaaaacccaggtgtcagtggcagaagcattcctgaatttatgtagatcattgttttgctggaactgc

SEQ ID NO: 12348 - DNA, 388 bp, Homo sapiens
ggcacgaggaaagggctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcgagatcctgtctttgtaaaaaaactaaccatcctgacccgccagtgctcttggtctcctgagtgtacccaggtcctcccaagtgcggtgtgcaccgagcgcgcctggcctgatgccctggcctgtgagctggggactcctgggccctgtgagcccctatgcggcaggcccagg

SEQ ID NO: 12349 - DNA, 390 bp, Homo sapiens
ggcacgagagatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcag

SEQ ID NO: 12350 - DNA, 395 bp, Homo sapiens
gaaaaacagtagccctcctaccctgcctttaccccactttccttgcctcacagtagtctgtgccaactcttggctgatttgtttgtatttacctccatgtctcaatatgaacatgttttcatgactattccttgatggttttttgtttgcttgttttaagacggtctcactcttccccaggcgggagtgcaatggcacaatcatggctcactgcagcctcaaccttctcgggctcgggtgattctcccacctcagcctcctgagtggctagaaatgctggtgcacaccaccatgcctagctagtttttgtattttttgtagagacagggttttgccatgttgcccaagctggtcttgaactccggggctcaagtgatctgcccgcctcggcctgg

SEQ ID NO: 12351 - DNA, 390 bp, Homo sapiens
  misc_feature 390: n = A,T,C or G
gcagccctggccctgcggcacgccttcacctacaaggtctatgctgacaagaggctggacgcacaaggagctcctgtgctctaagcaaccaagaggaagcatcgaaggttcagcatcactggtctctgtcgccatctcccctccacctcataccctgtgcaatagctggtgatgtgcactagccctccccgccaccagaagccctaaggggttgaaagcagaaccccatttttttagacacccctcgccaaaaaacatagtccaggatacactttattctctgtggaaaaagaaagaatttgactttatttagaaaggctactgaatacagaagacgataactcgcttgctgtaagtcaggaaataaatagattctaggagccgggcaan

SEQ ID NO: 12352 - DNA, 388 bp, Homo sapiens
cgttgctgtcggtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacacttaagacatgtgacacattcccattggtaacaattgctcaccatggcattgtctcaaaaaagactatggtggggagg

SEQ ID NO: 12353 - DNA, 391 bp, Homo sapiens
cgttgctgtcgcaggagagccgctggaagcagtacctggaggacgagaggatcgcgcttttcctgcagaacgaggagttcatgaaggagctgcaacggaaccgcgacttcctcctcgctctggagagagatcgattgaaatacgaatcccagaaatctaaatccagcagcgtggctgtcggaaacgactttggcttttcctctcctgtcccaggaactggcgacgccaaccccgctgtgtctgaagatgccttattcagggacaagctgaaacacatgggaaagtccacccggaggaaactgtttgaacttgcccgagccttctcagagaagaccaaaatgaggaagtcaaagaggaaacacttgttgaagcatcagtcgctgggggctgc

SEQ ID NO: 12354 - DNA, 404 bp, Homo sapiens
cgttgctgtcgcttttttccattgtagaaattatgtatatcacatctctaatgggggtggttttcaaagttatttgaacatttccagtggtagggagctcctgctttacaaggcaaccattatatttttcaaaaactcttaagtcttacaaagttatctcataagaacagccctaatttcttctttccaccactttgtaaacagtaatatactttaaaatgtgtaacatttagcaacttgtagctctgcatgcagtaaaattcaacattttctgaattaatttttactgtgttatgctgacttcatgtattttattttcatgggctggtttaaaaatacgagaatggaaagatgaaagaaaagattagtacatgcaaactatagaagtttaggtagcaacccag

SEQ ID NO: 12355 - DNA, 393 bp, Homo sapiens
cgttgctgtcgagaaaaggggctctgctgacctgccaccttcgctgtgatgagtttctgtgtagcagggacagcgaggcacggtttggatgaggacaagatgtttgttaccctacaaccagggagggtgtcgggtgacaccctgggctcagaccccgcgctcagcacccgtctcccaccgtgggctgccacagaagctacaaggcaccgggtcaaggccaagcaaatgaaacacgtaatgatagctctgtctttctaatttccccctattagaagaaagaacgtgaaataattctttatgggctcagtccctaccgtgtggggcagacctgctctgggtgatgaaagcagtttccctgcctcccttcaggaagtagagaagccgggtgcctgg

SEQ ID NO: 12356 - DNA, 389 bp, Homo sapiens
cgttgctgtcgtttagacgcatcacgattttgccccgattcccaacgtggagaaaccaacggggaaagagacggagaccaacgagaaccatctcactgggagaggcgatgctgtttgacacatcgtccctgtaccttccaaagccactgtcctcccacacctgggcaacagtggcctcaaccccaggcccagccctcctgcaggaaggaagaggactgaatggagggcgtggcaggatgaaaggacgtggcctcctcaaacccattggtaaagggcctctggggccacctggctaagaggggctggcacaccaagaagtggcctcctcccgggagttgagccagagcccaggtgctgtccccaagtggactccagagccaccttttcag

SEQ ID NO: 12357 - DNA, 387 bp, Homo sapiens
cgttgctgtcggtttcaaaggatactgtcatgaagcagacacatgctgacacacctgttgatcattgtctatctggcataagaaagtgtagcagcacctttaagcttaaaagtgaagtcaacaagcatgaaacagcccttgaaatgcagaatccaaatttgaacaataaagaatgttgtttcacctttacgttgaatggaaactccagaaaattagaccgtagtgtgtttacagcatatggtaaacccagcgagagtatctactcagccctgagtgctaatgactatttcagtgaaaggataaagaatcagtttaataagaacattattgtttatgaagaaaagacaatagatggacatataaatttaggaatgcctctcaagtgcg

SEQ ID NO: 12358 - DNA, 391 bp, Homo sapiens
ggcacgagactaggcaagttgctttggcatatatcattctcattaataaaacagacttggttccagaagaagatgtaaagaaattaagaacgacaattagatccataaatggactaggacaaatcttacaaacacaaagatcaaggctcagcagctgatagactcagcaacaggcagccaggagctctgaggctcacagctggcagtctagttccactcagtctctacttgagaaattctttctttggaagtacagcagaggccttagagctgatctctctaatgtattagatcttcatgcctttgatagtctctctggaataagtttgcagaaaaaaacttcagcatgtgccaggaacacaacctcaccttgatcagagtattgttacaa

SEQ ID NO: 12359 - DNA, 402 bp, Homo sapiens
ggcacgaggctactaagatgggaaaaactatcacgacagtggcaccacctgatttcatgatgtaccatatgcagtaacacatgtttgaggtacagaattgaagctgatttttctgcaaaagatgaatttctataaacaatcccatttttatattttattattaaaacaaaaatacctctctttgctagagagtatatgtatgacttaaattattagctatggtttgcatttagtacatggcagattgcctgtaagtctgttcattttaacaacatacggggctgggcacggtggctcacgcctgtaatcccagcactttgggaggttgcgggtggatcacttgaggtcaggagttcgagaccagcctggccaacatggcaaaaccccgtctctatgaaaaat

SEQ ID NO: 12360 - DNA, 387 bp, Homo sapiens
ggcacgaggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgttctctgcctgctttgcgtacgtgcatgcgcgcccctgctggttggcgcggggcccctgccctttttcttgctcgtgccggacgggaccggttaggcctcggaggcacgctgttttctgtgccccacacgtaaccttctgaacactgtggtacaagaagtctcccccaatatcgtgcccctagcgccacacg

SEQ ID NO: 12361 - DNA, 391 bp, Homo sapiens
ggcacgaggaaggcagcaggatggcagtggccagtggggtcaggctgggccatctccctctcagacctcagcacctgggtcctcggggctgctgctcttgttccggaagtggtctcgactccgcttcctgctgccatggaagccaacagtttccaccggcgggagacctggcacagacccactgtggacagaccctgacagtgcctccacctcctgcaggcctccatgggggctgccccactcctcagcctctgggctcccgggcccggccagatgggccagctccacagggccctcgcccctgtctgtggcaggattcccaaggccgcccctgcctggctctcccaccttccccaggaccctcttcctctcgtgtctggcttcgacccct

SEQ ID NO: 12362 - DNA, 404 bp, Homo sapiens
ggcacgaggctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgccaaagcctcacagcaggtgagccaccctgagatgcttgtggccacatggtggccacagtcagagctttgaa

SEQ ID NO: 12363 - DNA, 395 bp, Homo sapiens
cgttgctgtcgcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccag

SEQ ID NO: 12364 - DNA, 393 bp, Homo sapiens
  misc_feature 393: n = A,T,C or G
ggcacgagctaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgn

SEQ ID NO: 12365 - DNA, 404 bp, Homo sapiens
  misc_feature 2, 8: n = A,T,C or G
gngacganaacagtgtgcaggagactcactcccagctgctgggctcttgggacccgtgggaagaaccggaagacgcagcccctgtggccccctccgtccctgcctctgggtaccctgagctgcccacacccaggagagaggtccagtctgaaagtgcccaggagccaggtgcaggcccgggaccccctggggtgagggctggggcaggggagggctgggggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaagg

SEQ ID NO: 12366 - DNA, 402 bp, Homo sapiens
  misc_feature 375, 397, 402: n = A,T,C or G
ggcacgagaggagcgctactttgagccactggtgaaaaaagaacaaatggaagaaaagatgagaaacatcaaagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttanataacccgaacttcagacattntcccn

SEQ ID NO: 12367 - DNA, 392 bp, Homo sapiens
cgttgctgtcgggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagg

SEQ ID NO: 12368 - DNA, 402 bp, Homo sapiens
ggcacgagagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagc

SEQ ID NO: 12369 - DNA, 393 bp, Homo sapiens
catagttcctaaggcatgaccattctgtcctgtggtaccaggctggactaagctcccatttctttaagccatgctgtcccctgcagggacttccaaggtggagctgatgagcaatagttatgagtcattggaggagacatcccaaaggcgccagctcccctctgccctaaactgaaattaagacctggtgctctgggtggggcccctggaaagggatgtgcaactcataggggaccttctccaccttcacccaggagaccccagagggaccatggcagagccggagccctctttttttttggtcgctttttattttattattattatacttgaagtggtagccctcttttaaaaaccaaatgagaataggccaaagaagccaatcgtctttgg

SEQ ID NO: 12370 - DNA, 392 bp, Homo sapiens
ggcacgaggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcaaagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggat

SEQ ID NO: 12371 - DNA, 404 bp, Homo sapiens
ggcacgagaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcatattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacaga

SEQ ID NO: 12372 - DNA, 394 bp, Homo sapiens
cgttgctgtcggaaggcacaggcttttatttatcccgtatctgctctcctgaaataattgtggagtcatgcctgaaatgccggaggacatggagcacgaggaacttaacatccctaataggagggttctggttactggtgccactgggcttcttggcagagctgtacacaaagaatttcagcagaataattggcatgcagttggctgtggtttcataagagcaagaccaaaatttgaacaggttaatctcgtggattctaatgcagatcatcacatcattcatgattttcagattactgacagccctgtcctaggagcacaacgttcgagaaatgctcaacttgactgctccaaattggagaccttgggcattggccaacgaacaccatttctg

SEQ ID NO: 12373 - DNA, 396 bp, Homo sapiens
cgttgctgtcgcccattttagccatggtgtctctataggggtcagacatcatgtgcccagacctaaggtcaggaatgtcatatttttctgttaaaatcattttatttctgtgtatcttacctttaaatcattgtggtttactctgagattctgtagtcctaatattgtatcattgtgctgtctgcaaaacaacttgaatctattttgtttgcatcttttgttacatgtaacgcagctgtactttatgttctttgcaactgtttccattatgagaacgctgtgctatttacaaggttacatttttcttggccaggcgaggtggtcatgcctgtaatcccagcactttgggaggccaaggtgggcggatcacttgaggtaaagagttgagaccagcct

SEQ ID NO: 12374 - DNA, 393 bp, Homo sapiens
ggcacgaggcttattgaggaaatccagaaggaggctgaagaggaacagaaaagaaagaatggagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgag

SEQ ID NO: 12375 - DNA, 392 bp, Homo sapiens
cgttgctgtcgcctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccgctgttaccagcacccttttcccaagaaaagtcaattcccaggtgcttattggacatccttcgagggggaagaggagggaagcggccagctcacccttccgggaccctagtgtggggcgaatctcacggacctga

SEQ ID NO: 12376 - DNA, 401 bp, Homo sapiens
gggacgaggtccagcccgtctgagcttccagcctcccctgcaggtggcagcgctcctgttggcaagaaattggagaccagcagaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcacat

SEQ ID NO: 12377 - DNA, 403 bp, Homo sapiens
ggcacgagggaccatctacagagctgctactcaaaacttatggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgatt

SEQ ID NO: 12378 - DNA, 399 bp, Homo sapiens
ggcacgagtgactattgaaaatgcttagaatgaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttacaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtaca

SEQ ID NO: 12379 - DNA, 397 bp, Homo sapiens
ccagggagacggcaattcagtttaaacttccactatacagacagcggtaccagttcgttaaaaatttagtggatcaacatgagcctaagaagagttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggg

SEQ ID NO: 12380 - DNA, 386 bp, Homo sapiens
  misc_feature 254: n = A,T,C or G
tgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttangaggacctggggagagagagagggccactgtgttaattaagcgaattaatgtggtaccagaccagccttctgagcgtgccttgagactagtggccagttcaaaaattaatagccgctcattaacaatttttg

SEQ ID NO: 12381 - DNA, 392 bp, Homo sapiens
ggcacgagcggtcgcggagctgtggccagctttgggagggccggccccgggatgctacacacaacccagctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggca

SEQ ID NO: 12382 - DNA, 385 bp, Homo sapiens
  misc_feature 385: n = A,T,C or G
ttgagaagatcctcagcactcttgttaaagggacacgcagacctgtgacctgcaagattcgcatcctgccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcn

SEQ ID NO: 12383 - DNA, 386 bp, Homo sapiens
  misc_feature 386: n = A,T,C or G
ggcacgaggccggtttggcccttctttgtatgagagtttcatccgccctgaaatcttcccggtcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccn

SEQ ID NO: 12384 - DNA, 391 bp, Homo sapiens
ggcacgaggccggtttggcccttctttgtatgagagtttcatccgccctgaaatcttcccggtcgttaataactcctcaggtccctgcctgcacagggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcg

SEQ ID NO: 12385 - DNA, 397 bp, Homo sapiens
ctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaag

SEQ ID NO: 12386 - DNA, 397 bp, Homo sapiens
ggcacgagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctactag

SEQ ID NO: 12387 - DNA, 390 bp, Homo sapiens
ggcacgaggcagccttctccactcttccctcccttggagtttcgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatactgaaactagagaccctggagaagaaggaagaagaagtaacc

SEQ ID NO: 12388 - DNA, 387 bp, Homo sapiens
ggcacgaggatgactcttgcctccattggtggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacat

SEQ ID NO: 12389 - DNA, 383 bp, Homo sapiens
actaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtga

SEQ ID NO: 12390 - DNA, 371 bp, Homo sapiens
cgttgctgtcggtccgtttcccatatattgagggataaagaaaattaagcctgcctgtaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacagcagtcattacctagcagccatttt

SEQ ID NO: 12391 - DNA, 383 bp, Homo sapiens
ggcacgagggcagaggttgcagtgagctgagatcatgccactgtactccagcccaggcaacagagtacgactgtctcaacaacaacagcaacaacaacaacaacatctttcacaaaagcttatttcaaggaaaaacacaaagaaatttcacaatgaattaaattaacagccttggtagctaggttaaaaaatttaaagcaaagaaataaaagttgataccaggttagcaaagacaaggtaaaaaatagtactaagacacttcaggacctttaaggatatttgaagaggtttcaatatttagtatctaaggtaaaaagagttgatgcagtattttcaggtaaaggaaatccttgcaaaatcagactgatttgataatattaggg

SEQ ID NO: 12392 - DNA, 383 bp, Homo sapiens
ccacattcatccccagcctcgctgtacagctattatgtggggatttgccaatcaataaatcaaggcacctgaaaaatgaactggggaaccacactgactttcccccccttcttgattaaaacaaacaacattgtgaaatgtcaacctgtcagtcgtttggaaagtttgcggcatggaaaggcaattacccaaatgactttttaaaagtatgagaatttgcctggctgaacgttttttaattaatgccgtgagttaacattaataactattcatagcttagtgagctgggcttgaggtgggtttaggaaacatttggtatctctggcagggacagatgttgacctggccggtcggcagcttttacaaacctaaggacttcaggg

SEQ ID NO: 12393 - DNA, 381 bp, Homo sapiens
  misc_feature 80: n = A,T,C or G
tacggttgcgataagactacagaagggtcggcctcccagagggctgggattacaggcgtgtgccactgcgcccagccggnccctgctttcatgtaccttagaattcagaggaaaaaagagatattaaacaaataaatacacaaatgaacatacaatttcagtgaggtttaagtgccatgcaggtaaagaattaagggtcctgtttcatttacttcttatctgccttgacctgtccttcattaattccacaaatacttactgaccactgcatggcaggctctatgctgagcactgtgaatacagaagtgcatcttgatatggggattcgaactgcatggagctcacaccgtccaacccagattgacatacataataggtcct

SEQ ID NO: 12394 - DNA, 374 bp, Homo sapiens
ggcacgaggctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttgaagatgcttag

SEQ ID NO: 12395 - DNA, 381 bp, Homo sapiens
cgttgctgtcgggccggtggatcactcgaggtcagcatattgagaccaacctggccagcatggtgaaaccctgtctctactaagaatacaaaaagtaactgtgcgtggaggggggcgcctgtaattccacctattcgggaggctgaatcaagagaatcacttgaacccgggaggcggaggttgcagagagcatagaaggagccactgcactctagcctggatgacataatgaggctcagtctatcatggtaatagtagcctgaacctatgtgaaatctaagaacatataacactaatttttcatagtataaattaaaaaatggttgcctagcgctggagattccgggaagggacacagattctctgtattgatagactggc

SEQ ID NO: 12396 - DNA, 380 bp, Homo sapiens
ggcacgaggtcctttccagctttgggttcacagccttctgttattcctgctgtcaattttttgtctttctactgtgcttttcaaccttggttattcatgtatcaccttcatctgtgcgattattaccatttaactgcagcaagtaaagacgttaatagtgaggtttttgggaatgtggtaaaaccgggaggtatatttgactttgtccaagttatctgatgaggcagatcagctaaagcaaaatacagtgggttgctccctactatcactgggacctagagatttcatctacatctctgaaaaatggggtttctgtatgatagtatgggtgagaaggaatgacagcagaactatcaactgttttctgattatcctgatga

SEQ ID NO: 12397 - DNA, 374 bp, Homo sapiens
cgttgctgtcgggagtccacaataagggggcctcatgcacatgattgacagagagccacagcggccttgcattgtttataacaccagaaagggacaatttagaagtgccattctctgcttaacactaactctctttaagcctgatcacctcccacattctaatagggcttccatgccgagttgttttctagaatctttcctttccattttcagggaagcgtgaatgttgctttaaatgcagcgttttaatgtgggtataagctttttatgtgacttaaattacataaacatttcagttgtgctgaatacacctcttattttctagattttcatgttttcatacagctcaggttttgatgtatttgttgtcttta

SEQ ID NO: 12398 - DNA, 373 bp, Homo sapiens
  misc_feature 373: n = A,T,C or G
cgttgctgtcgggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatactttgaattttttttctcttttttcaaaccctctgcagaggtaggaaggtatgaatttcttttttatgtcaagatgcaaaaacaaatcatgatgcttttgttgggagaatttttgtattcagtattttgtatgtaccttttttttttttaaattggaaagcccaattaggttaaacatttaactttgcttgactccagtgtaaaatgaan

SEQ ID NO: 12399 - DNA, 367 bp, Homo sapiens
ggcacgaggtgactctagcttctggtacgagcccttcagttcaccctcctgccctgctcagaaccccctggacctgacatcgcggctttaacacccttgggtcatgtgagaaggaagagtgcccacccaggactttccgaggctcacagattctttgaaatggacgtgagcacaaacgcccagccccgacagccagggatcagatcgggtttcacttcctaggagggaggatgtactgcaggggaggcccacgtggctgccccaggcctggccagcctctgtgacccaacaggactgactgttttacgggatggccacacggtaccctgcaggctcatccatggtgggaccttgatgctcctttgtg

SEQ ID NO: 12400 - DNA, 384 bp, Homo sapiens
gtagcacgaaggcccactccaaggttctggccaggctggactgtaacagcagtaccagcaccaggaatggggccaccatgtgatctttgggtagaaatgacctttttgggcttgagtttgtctttctagaatgcacgtgatcccttatcccagggaggttgtaaagaccacactgtggagatccttaaattgatgacgatggcctatcgaagccttgtgaccgcacagcccctaacagtttacaaaacgcgtccatgatgaggacgggtccattagagcccccaacgttctgtgaagtgggcggcacaggttggggaaggggacttaatggggttatgtaatttgcatgaaaatcacagaacctgaagtggtgggtgagattca

SEQ ID NO: 12401 - DNA, 383 bp, Homo sapiens
cgttgctgtcgcacatacatgcataggtatcctgtgtgtccacatgcatcattattatataaatagaaacttctgaacaccctcctaagtcactacaggatgccagcgcttcctattcttgggtagacagagccacctcagcatcctgatggatgatacaagaaattgttacttcctagtatggaagtgtcttaaggacacgtctccatgatattttggtgaacccaaagtgctttatcctcaacaaaatgttcctctgttcccagttaaagtaatattccctgcttccaagtaagcaagactgttcactaaagaaggaactttttagaaaactaatctcctttatcatccaattttagttctgcatgttccgaggtagccag

SEQ ID NO: 12402 - DNA, 379 bp, Homo sapiens
cgttgctgtcggtctccccagtagctgggactacagacacacaccaccacgcctagctaattttgtatttttagtagagacggggtttcaccatgttggccaggctggtctcaaactcctgacctccggtaatccgcacaccttggcctccaaaagtgctgggtttacaggcgtgagccaccatgcctggccccattaggttactttcattccaccttcatgcttatggccattcctcttatgctgctgggtggacatagagcttcaccaccatcctcctgcatgtcctctgtgtctgctgagcactaactgcgtgcccggcacagtactgagcccattgctcatctcagcaggttcatcccagcaacctgggagggaa

SEQ ID NO: 12403 - DNA, 377 bp, Homo sapiens
cgttgctgtcggaaggtttggtattgtaaatgtgctgttgttccaaagaaaaattagcagaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaat

SEQ ID NO: 12404 - DNA, 375 bp, Homo sapiens
cgctgctgtcgtatagaactaaaatgtcttaaaccacgcttagtttcatatttagaacaaaaaaatccctaaaccattctgtttaactgttagaaaccattctgtaaaatgaagaaaatgggagacatggaaactgattgggggagttaagctttactctcatttttctcagccattaagaagctggaagtatgtttctttaaagaagaaaaattcacagtgtgccatcttatttctcttttctgccactttttaaaaatcttcttattcagaagttcagcaaagtaaaccaagtctggcctaatactttgatttacttgaatacctctacgtatcttaataattcctttaattttacattgtgtaaatatttat

SEQ ID NO: 12405 - DNA, 372 bp, Homo sapiens
ggcacgagattgtactgggaagaatgaagaggtgatacctttactagatccttcagacacatctatgagaagatttgttcatttaaaagtctgcccactgaggatagggaaaggattaaggatttttccacctcctcttagtaactcctgaattaccaacatcaacttctttctctccgttcctgaaggaactttggggaatcatcttcatccgtagttacgctttcctgaaccttctcagtggtttacatgcctctgaaactatgtgcaatatttttggttgacacttgtatccatccttaagaaattagtgcagattgcagatgttctgtcttccatcccaaacaagcctgccatgaggtaggatcctag

SEQ ID NO: 12406 - DNA, 155 bp, Homo sapiens
ggcacgagctccgcgcggcctcggtcccctgcgccgcccgccccacaacaaaactcagcgcagcgctcccgggcgcccggttcagagcgacctgcggctcagagcggaggggagactgaccggagcgcggatcgggacagcggccgggacagcgg

SEQ ID NO: 12407 - DNA, 375 bp, Homo sapiens
  misc_feature 365: n = A,T,C or G
cagctcatatctggctaacagtggcactatgggagtttatatgatctgtgcattattctgtggcatcaccttctaagagcagagatgtgacccaataccccttgttttccttaaagataaccattaaattatatccatgaatttatatcaccgtccttgactttatacgtagatttttctaattctgtcaacccttagggtaatgaataacttaaatggccaatgcctctgaataacatcatacttccttttgtttctccaaaaattgaatcaagatgccagggcaactaagattttcttcaatttgctaagttaaaggtcagtgtattcattagccaatggttctgtattttattcattttagnttttattcgg

SEQ ID NO: 12408 - DNA, 379 bp, Homo sapiens
gcggattgtgacaaaatctttcattaacaaggggagtttcggtgaagtggaggtttggggaaaggcgaggaagtcggtctggagcaagcaagcaaagtgcggaagctgtactgggattcttctagaaagtggggtgggaaaggaggtagggagggcgtgtgcagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatg

SEQ ID NO: 12409 - DNA, 372 bp, Homo sapiens
  misc_feature 372: n = A,T,C or G
catctttggcgtaggccatgaaagacaggatgctcattgggtgttctgctgagtgaggaatgctgcctattccctcgcagtacgccctacccagggatgtgtgttgaagagccctggaggaaatggacccagttttgccacatatcagtattacgctgaagatcaggtgactggtatgccccacctcccatcattgcctcccatagccattctgttcagtcagctcatccacgctggattcctgagaggtttgcaatttgggaagccatgaaaaaggcttttatatcttggaaagatggagagagggacataggatcggtgactcctacatgacatgaataggctggagattgggaatcggccatccaccan

SEQ ID NO: 12410 - DNA, 375 bp, Homo sapiens
ggcacgagaaactgtcagcccattaagtgttcatctctaatgtgaaatttctagatgaaggcaatttagcttaatttgccaagacatctcttcatgtctgggagggctgctgggggaagtagagctggaatccattggagccaccaatctgcagaagtctagaacacaaaggacacagagtgggtttggtgggtcattgtggcatttgtcaaggaaaagcaacattgccctctaaatgactcccacttctgttctggaaaaaacgcatcatcattcatgccaccatcccaatagacataggaagcaatttctcttcaggttttgagatggtgcaagcattgacttttctttctacagagggctgggatggggggg

SEQ ID NO: 12411 - DNA, 382 bp, Homo sapiens
accgcacgagggaaaatcaaacttcttggttgttctagctttgaagcttttgcttcagtaatatttgtttaaagaaccagatcacataccatttatcaaagtctttacttaagccagactactttgcagacatacatatttggaaaacagactgtttcttgttcactagatagaatctgtattgtagtaagaaactacttacaaggtggctttctttctgctttgctactctatgtataactcaataatatatgtatgggcacagggtccctggagatggtttatttctttatgacagacacatgagtatgcacctctctctagtcctctgatgtcactgcagctacagtctcttctcactctgtttttgagagccttcaaa

SEQ ID NO: 12412 - DNA, 375 bp, Homo sapiens
cgttgctgtcgtgagaacgcaatgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcacg

SEQ ID NO: 12413 - DNA, 371 bp, Homo sapiens
cgttgctgtcgaaagttccatataatgaattaaaagaaaagtgctgtgaagaaaacaaattcaggatgggaataggaggtccaagggagtgcaaggtgttttcattttgaatgtggtggtctgggaaagcctcactaaaatttgagaaagacttgatgaaagagaggagtgagccatgcagccatttgggggacaacttccaggcagacggccggaggcagcagtgcatgggcgtagtcggggcagtgtgtatgcctcctgtgtagcaaaccccaggcaccctttattaagccaactattagggtttccactgtttggaggtggctcctgttcttggagacccccaactctgatgtttttttggaattgct

SEQ ID NO: 12414 - DNA, 368 bp, Homo sapiens
ccgttgctgtcgggcgagtctttaaaggagtggctcatctttcctctccctggggcattttggtgtgggagactacaggggatgaggttaaaaagcttggtcggcaggtagaggatggggagagaggttagggccctgggaaaggtgggagatcagccagagacaggtttcccagaacagaatgtctggcctttgtggtgaggagggactgtggtatgagccgcagaagcgggccaggggtaaaccctcctgtgcgtccttccttcagcctggtcctgagggtgaccctttgatcctgggttctccaggtagggctgtgagctgtgagttggatccttttggtgaaatggtctctctcatctggcctg

SEQ ID NO: 12415 - DNA, 378 bp, Homo sapiens
  misc_feature 365: n = A,T,C or G
ggcacgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcaaaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctgggngaggggtcctggg

SEQ ID NO: 12416 - DNA, 384 bp, Homo sapiens
cgttgctgtcgatttgtagaccagactggtatccacagtttaattgagggtttgctccagtattcctggcccaatgacaaagatcctgtggatggtccttttcctactatgacttttgctgaggtgctggccacctatggaactgataaacctgacactcgctttggaatgaagattatagatatcagtgatgtgtttagaaacacagagattggatttcttcaagatgcacttaataagccccatggagctgtgaaagccatatgtatccctgaaggagcaaaatacttaaaaaggaaggacattgaatccattacaaactttgcagctgaccattttaatcaggaaatcttacctgtattccttaacgccaatagaaactgg

SEQ ID NO: 12417 - DNA, 371 bp, Homo sapiens
cgttgctgtcgccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagca

SEQ ID NO: 12418 - DNA, 377 bp, Homo sapiens
gtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacct

SEQ ID NO: 12419 - DNA, 346 bp, Homo sapiens
tttcgtttgcgagaagacgacagaaaggcaaggaactagtgtgtatcaagccatactaagctggagtttagcaggacaaaggcaaactaaatgtagaacataacatatcagctgaatatgtctatccaggactgtttttctagaacataaatcatggagctccttgacagtgtatccactgtttttggggtttaataaaaccaactagaatttagacttacaaagaaattattattccttttggttgtccacataaagcagtccagggctatcatatggctaaaatcaagatatttggttcatctctgggatgtatttataaagtcaacttatcagccattaagat

SEQ ID NO: 12420 - DNA, 344 bp, Homo sapiens
tactttctgcgagaagacgacagaagggggcggaggggcaccttacttacctcagggcaactcccccaacactggagacagttcgttccaaacaggagtgggagacgagactgaatggagtttggataatgaaaaagaatgttcgggaccaatttaatagtcatatccagttagtgaggaacggagccaagctgagcagacttcctcaaatccctactcccactttacctccacccccatcagagacagacttcatgctttaggtgtttcaacccaggccctctctggctcctcggatgcccttttccattgggcaggtcacaatgcccatggttatgcccagt

SEQ ID NO: 12421 - DNA, 338 bp, Homo sapiens
agggctatggctgctagaagacgacagaagggataaccaaacctcctagactaacaacacagtcattcatcttacctccaagaaaaacataaccccaaccagctatttgccctgctcccagtagaggcagacacacctgaatgtgctatgaagagacaagccttaggggagaaacagtgtgatttggacaaatcattctataacagcgaaacctttcgatgtgttcaacggctgcagaaagcacaccacaggtgagagaccagaaagtgcccaaggggttttatacaaaaaaactatatttaggtatagggcacagtctacgtagaaaacctttcaag

SEQ ID NO: 12422 - DNA, 335 bp, Homo sapiens
tacggctgcgagaagacgacagaacaaaacccctctgctctcatctcgcagaggtcatccctgagtcagggtggcagtccctccccggggggcagaggagagtgcctatggttgaggctggggactctgcaactgggggaggcacggtaaaattaacacctgctgatcccatgggccttggacaggtttcttgactttttgggggccgctgtcaaaggttgagtataataacctcctccccacagcaaattaataaatggcatgtgcacatacagcgcttgcctcatgtctcacatgataaacctgatttctgggcactggctgagcgactatgg

SEQ ID NO: 12423 - DNA, 475 bp, Homo sapiens
  misc_feature 11, 12, 13: n = A,T,C or G
acttgaacttnnnaaggatcccatcgattcgctcagatctccaactcctcctccttcttctaagccatcaagtattcctcggaaatcatctgtggatctcaatcaagttagcatgctttctccagctgccctatcacctgccagctcatcacaaagatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggct

SEQ ID NO: 12424 - DNA, 446 bp, Homo sapiens
  misc_feature 12, 19, 20, 37, 38: n = A,T,C or G
gacaattctcanggccttnntggaagatcccatcganncggttgcggcacgagaatgcttttgccattatacctatattttttagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggaggtaatattctttgttttaatttgataattggatatggttgatttatattgggtttaaactgcggagctttcatgtttactggtaattagtcttaaaatattttttac

SEQ ID NO: 12425 - DNA, 444 bp, Homo sapiens
tagctccatcttatacgcacgacccgctcgattccaagatcgctgctgtcggcatggaaggatgcatgtatgactgaggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttat

SEQ ID NO: 12426 - DNA, 431 bp, Homo sapiens
ttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccc

SEQ ID NO: 12427 - DNA, 433 bp, Homo sapiens
  misc_feature 385: n = A,T,C or G
cgttgctgtcggccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacggnggccattcagcaactgggtggggtaattgagggttttctgagcaaaga

SEQ ID NO: 12428 - DNA, 425 bp, Homo sapiens
  misc_feature 425: n = A,T,C or G
tagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcacagggagaggggtggtggctaggaagagggtcagaaagaagctagagggaggtcaggagaagggtaacagggaggatgcaaagcagacatctaccctggtcaccccaggatcaggatatctgtccttggttcatgttgaatn

SEQ ID NO: 12429 - DNA, 423 bp, Homo sapiens
ttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggc

SEQ ID NO: 12430 - DNA, 421 bp, Homo sapiens
cgcacgagagagagagagagagagttattttgagagagagagagagagagagagagagagagagagagagagagagagagagagagagagagagagagagagagagagagagagagagagagagagagagagagagagagagagagagagagagagagagagagacacaccctctctctctcttcttcagtgagtgagtgagcgagtggtgtgtctccccccccctctctctctctgtgtctattgtctttttctggcgcgtattgctttatctctctctctctctctctctcacatacatattccccccccccctctctctctctcacacaaattttttctttttttgttcgtgtgcctctctctctataaaacccactctcttctctttttctctctgcgtgtgtgcgccttctctccc

SEQ ID NO: 12431 - DNA, 422 bp, Homo sapiens
ggcacgaggccaaatcctttgagctgttaagatgataatttcctgctttcctcctacatcttctcctcccactccctcctttggtgtgaatattggcttcccaattaagaccttttttttttttttccaagttggtttaaccaaataaagggttggggagaaccttgcccttttggaaattttaaaaaaattttttaccctttcttaaaataagtttctggtttttccaagggtttaatggaaaatggggaacaaaagaaaaaatttggagcggattttctttttccctggtaagggggggagattttcccaaaccggaggggcccccccctggtttggaacctggaaccacatccccggggggtgggaaagggaatttccccaccgggaagccttgttctttggttcccagggccttgggg

SEQ ID NO: 12432 - DNA, 422 bp, Homo sapiens
  misc_feature 399, 410: n = A,T,C or G
ggcacgaggcagccggaccaggagttgggttcgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggcaaagtccagggagaggctgtccctatgcggngcgctggtggngctgagggacat

SEQ ID NO: 12433 - DNA, 422 bp, Homo sapiens
cgttgctgtcgaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagt

SEQ ID NO: 12434 - DNA, 166 bp, Homo sapiens
tgtttggtctgcactcttacccatgatgccagttgccttcattatattaactgagttttaaatttgcgggggggaagctattttaccttatgcagggaacttaacaaggcctaatattaacctttattttatttttagggagttacttttggctgcaggacctcgg

SEQ ID NO: 12435 - DNA, 415 bp, Homo sapiens
  misc_feature 38, 39, 40, 41, 42: n = A,T,C or G
ggcacgaggagagagagagaactagtctcgagagcagnnnnnttttttttttttttttttttggggttttgggtttgggccaataaaaaaacttttttttttacaacaattttaccccccccttttacccccttttttccccccggggttaaaagggggaaaactcttgggggttttcccccccccttttaaaaaaggaaaccccccctttttaaaccgtgtttttttccccccctccgaggagggggaattttactccaaaaaccccttttttttaaaaaaaaaaacccctgggggaattttttttttcccgggtttaaaagaccccccaaaaaaaaaaaagggttttcccccacattttgtggcggggaaaaaaaacccccccttttttttttccccccctcaaaaggggccc

SEQ ID NO: 12436 - DNA, 416 bp, Homo sapiens
  misc_feature 416: n = A,T,C or G
cgttgctgtcgaagaataggagagaatagattatgctcttttaaacctgagagagggttgctctccttaaatagtgatatagagccttaaatgcatttttgttgttgttgttgatcacttacagaaatagccagaggtaatggtattcctcttaccaaattgaaggattagctctgtagaaatgttgaattttaaatgttttccttgtacctgatagaattgcatagtgttcctgcatcttatatgagaggcagtttaaggtgcttcatcaactgtggatggaatcctcaaagtccagtctctgattggctgccaggggcctaaacaggttgaatattttaatcaactatacaggagtcaaccatcccaagagttaaagaattgcatagatcctttagtttaagggaaaaaaaatn

SEQ ID NO: 12437 - DNA, 413 bp, Homo sapiens
  misc_feature 378: n = A,T,C or G
ccatcgattcgaattccgttgctgtcggcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcangaggatgaggcaggagacctgcttgaacctggagg

SEQ ID NO: 12438 - DNA, 416 bp, Homo sapiens
ggcacgagattttaatcagctatgtcatttctgcgtctcgttgtatactcctggaaggtcttagagaaatcctgccaagaaaatatcccctggtgaatcctcggggcactagtccacgccgcactgtcagcaagtatctgctgaaacaagtatttttgaatctttagcttttctgtagctccagtctttttaaagtacttcttttgaccttcaagtaacaacgagcacttgctttaaaattctgacagtcttccaagccttttaacattcttattccactaaataagctgtcgccgctcactgggacaggcagcacagttgcttgaacgcccggcttgaaattccacgaaatgtcacctcctctgtgaagccttctacaaggcagacttgtctatttcctacttaattttactatg

SEQ ID NO: 12439 - DNA, 413 bp, Homo sapiens
cgttgctgtcggaagaattcgcggccgcaggagttttccagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttg

SEQ ID NO: 12440 - DNA, 166 bp, Homo sapiens
atataccctgtctcactttccagaggtagcagtcactaatactggggtgagtgattttactcaaaggaaatcacactattaagcagcttggttttgacatgttatgttggggtcatcttttcatgtcaatacatagattaatcttttatttcaaatgtctacataa

SEQ ID NO: 12441 - DNA, 413 bp, Homo sapiens
  misc_feature 338: n = A,T,C or G
cttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacaggcctttatatttcataccatctctgccttataagtggnttagtgctcagttggctctagtaaccagaggacacagaaagtatcttttggaaagtttagccacctgtgctttct

SEQ ID NO: 12442 - DNA, 416 bp, Homo sapiens
  misc_feature 316, 392: n = A,T,C or G
ctggggtgaatgcacgtcagtggaggcagaatcattctgtctgaatgaatggagtttccaggcccccactggccctctgtgtgagggtctgcagggtttggcaggacaggtctttctctccggcgagagcacccaccctgaccggctgctggatgagggcaccaaagctcgctagggagggctctgtccttagggaggagctgcggaatccctgcagctgtgcccccaggccctgccttgcacacttcctgcagccagggcgcccctggggaggtcagggcaggccggggaggctgaggcccacctgccatagtgngcaggtgcgggagccagggcggcagtggcctcggggctgggtggggcgccttgcctctggtctctggagtagtcangggctctgcagatgctgagaggcc

SEQ ID NO: 12443 - DNA, 414 bp, Homo sapiens
aaaagtaatctttatgcctcagcctcccatgtagctgagactacccacaccttggtcccagctagttgggaggctgaggtgggaaaatcactttgcccaggatataaacgccgcatggagctatgattgcaccactgcactccaggcaacagagtgagaccctgtcttaaaaaaagaagggagaaagtgtcaaatggtgatgaggtctgggggggaaatagagaatggggatcacgagtgtggatggtggtattccctcaccaagatgtgacatgtaagcacgccgctgggaggagagggtgcgacccgcgtggaatttccacaaccaccctccgtcgtgaggccacacccaatgcagaggccgagaggcgggcaccccaatcccccggaactgggattgtgaaggctaggtcc

SEQ ID NO: 12444 - DNA, 413 bp, Homo sapiens
ctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtgggggctttggggtgctttctctgtaccccccagcccatgtcccaagttgtgccaagggaatgcct

SEQ ID NO: 12445 - DNA, 416 bp, Homo sapiens
cgttgctgtcggttaagtgcattcttttggtggctcgatgttaccctcatattttcagcactaattttagggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatcagtggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttg

SEQ ID NO: 12446 - DNA, 408 bp, Homo sapiens
ggcacgaggcgagaggccgcttgcatgaccctgacatcggcagcgggagcggcggccagactctcttggaagtttaggatatttcacagttctgaatgttagccactgaaaatgccagtagatgatgaagcctctgaagatgacacggattcatttttctcaaacagcccaagaacctttattttccaataagagaatataacaatttctgtacactatggaagagtttgacttggtgaaaaccttacacaaaacttcatcttctgtaggatctgatgaaaattctcttcattctcttggactgaacttaaatactgataggtaagaatgggatttaaaaaaaatgtaccaaatcagaataaccttatttgcatacgtttatcaacttatccaaatagtgtcgtagtg

SEQ ID NO: 12447 - DNA, 409 bp, Homo sapiens
ggcacgagattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgaattttttttcttttttcttttttttttccttttttttttggaataaacccccttgaaaaaccaattttgctgcctgaaaaagaagggaaaaaaaaaccccagtgctttttttaaaaaaaaaccttttggaagggatttttgggttttccttaacatgaacccccttgaaacgtttggcgggccaacctcaaagctgggacaaaattttttttttttggaaatgga

SEQ ID NO: 12448 - DNA, 408 bp, Homo sapiens
ggcacgagaacaatatgaggtacagaaagaaaatgacaatttgataactcccattacaaagaaaagaattactgagttcataggctgccattcaacgtgttaggaacagggtagagctgtgaggcacctttattgctgaggaaatggaagagttgaataggatttagggatgaggatactgtggagaatgggatcacccaagggagttgagttgattggatttgagggcttgggagaaggtcaaggattactccagtttccttctagagcctctgggtgcaggtaggggcagtcatgttgctattggagtgtgacagaagagagaatgtgaggtttagttgtggcacagaggagaacctgtggagtggagttgtgtctacccgtctaggcttcagggagccgaagact

SEQ ID NO: 12449 - DNA, 165 bp, Homo sapiens
ctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggattta

SEQ ID NO: 12450 - DNA, 409 bp, Homo sapiens
ggcacgagaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttggtccgatctaattctattgtattggtgatgataagtgttgacattgggtagtgtaaagcaacaagcatgtcttgt

SEQ ID NO: 12451 - DNA, 409 bp, Homo sapiens
ggcacgaggtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagt

SEQ ID NO: 12452 - DNA, 412 bp, Homo sapiens
ttttcggcacgaggagagagagagagtgagagagtgagatatgagagagagagagagagagagagagagagagagagagagagagagagagagagagagagagagagagagagagagagagagagagagagagagagagagagagagagagagagcgccccccccccccctctatacacccacacgcgcgcgcccccccctatctctctcttctctctcactcgcgcgacttttgtgtttctttcgcgcgcgcgctctctcccccccccccccctcactctcgccccccccccccccttcctttgcgcgcccccccccatatatctctctccccccccccccctctcttttctgtgtgtgtgtgagagagggatatttttttttgttccccccccccaccctcgtttctttt

SEQ ID NO: 12453 - DNA, 411 bp, Homo sapiens
cgttgctgtcggcgctgtgtctcgcctggggtaggggtgtgtcctgtcagccgtgggggctgctcttcctggtggtggaggccaggtcccagtccttccccacacttgtagaaacatgcattctctggtagggcctgcaaacctgccctaccaaacctgaaagagggtcggctcatctcggaacccgctgcgtgccaagccaggcacgaggaggtggcaggcatcccgacccccgtggggcctgtgttctagagtgcagagacagaactggctgggaggtgcggggcattggattgtaccagtgctggggaggagagcaaagcaggggaaggtctcggcagcgccgaggtgtggccgagagggttgtgctctgcaccatgctgggatgcagaatggaggcctgtgccgccc

SEQ ID NO: 12454 - DNA, 406 bp, Homo sapiens
  misc_feature 404: n = A,T,C or G
ggcacgagcctacaaagtttgtatagcaagcctctttctccccttgtgtggtgcctcctgaccgaggttctatgtctttgacattctacctccagtattgcctttgtacttcagagatctcttctgttgttagagaaatggctgcaaagtgaacatagggagttctttgttgttgttattaaagatatgtatatttcctgtaaacagctaagtctgtttagatcctaggacatggcatttatatagcagaatattatttaaaatattttcatctcgtgacccattagccaccaagtatgcttccttaggtaatttttacatagtagtaccatgcccagctggatagagttgccttgaagaagtgatatttacaataaaacaaaattttacaatatttacaatanag

SEQ ID NO: 12455 - DNA, 404 bp, Homo sapiens
  misc_feature 35, 36, 37, 38, 39, 40: n = A,T,C or G
cgttgctgtcggaagaattcgccgccgcatgagannnnnnttttttttttttttttttttttggggtttttttttaaccaaaagggccttcccccgtttttttttaaaccggttttgggggtttacccccagcccctttttttttgggaaaaaaaaacccctccctctttttaaaaaaaacccttttctttttttttttttttaaaaaaaaaaaaagggggggggggaaaaaaaaaaaaaaaggggggggccccccccccccccccttttttttaggggggggcttttgtttttttaaaaaagttttttcccgggggggccctttttattttcccctttaaaacccccattggggggggaacggcccgccccccaaacagaggggggaaaaatttttttttttc

SEQ ID NO: 12456 - DNA, 403 bp, Homo sapiens
  misc_feature 403: n = A,T,C or G
ggcacgagggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttn

SEQ ID NO: 12457 - DNA, 403 bp, Homo sapiens
ggcacgaggcagaatgtactgagccacccccttctttttctttttaccctttttgggttcattttcacttaaattgcttacttccaagaggtagatggtgcagtgagctgagattgagccattgcactccagcctatgcagcacgagtgagactacgtcttacaaaaaaaaaaaaaaatctcggcccttaaaacctttatggtgtgttttaagttcaagcggaagtgggaaaagtcctttgttggtttgggaccaaccacacttaaatgccggcgaaaaaaccgcttttttgggaaaattggggaccctatggttttatttaaagcccttataggcgcgaaaaaacaggttagcaacaaaagtgtggttcttttaatgttccaggttagggggaagggggggc

SEQ ID NO: 12458 - DNA, 406 bp, Homo sapiens
  misc_feature 18: n = A,T,C or G
ggcacgagaactagtctncccagcaaccgttccgtgttttctttttcttcttttaaaaaaaaaaaaaaatgaagtttttattttttaggccccaatgggggccggggaggtggccaaaaccggggcccccagaaaaacccgagaaaatttttgtgttaaaaaacacaagattttggcccccccccagggtttttgggggtttggccaaaacctccccttctttgggggggcccttccccccccccggggttttaccccccaaaaaaaaattggggggggggagggaactttcccttttttcccccccgcggggggtttttaaaaaaagatatggggggggggccccctcctcctaccccaggaaaacctttgggggccccccttaaaaccaggaggggtcagagcc

SEQ ID NO: 12459 - DNA, 405 bp, Homo sapiens
ggcacgagcaaaaatacaaaaattagccaggcgtggtggtgcacgtctgtaatcccagctgctcgggaggctgaggcaggagaatcacttgaaccagggaggtggaggttgcagtgagccaagattgcaccactgcactccagcctgggcgacagagtgagactccatcttggggggaaaaaagtatatatatatacacacacacagacacacacacacacacatatatctctaaatgtgtgtatagaaccttttatcagtataacattgatttataattaaatgtgggtgaggaagaatgtgtggagtgtttcagaaattttgatcctaaaagccttttcagaaactcaaagctttcagaaattaatagttatattaatagccttctaaacagcattaagtttt

SEQ ID NO: 12460 - DNA, 403 bp, Homo sapiens
ggcacgagctatctttattttgggcacactatagcttttgttaattatttctttgcacttgttagaatctgtttttgaaaaaaaaaaaaaaaacctttggctttgattcggggggactcccccttcttaaaaaaccaattttaaaggatattaggatggactttcaaacccaatatcttgaaaggcgatttttaaaaaattttagctcctgcctcccaaattaggttaacttggaccagaaaataggcggagagcccccaaatagaggttaacttacctatttaaacgtgatctttcgactttaaaaaaaaatgaaggccccgtcaaagcttccttagagggcgcttatgaacaaaaaaaaaccttaggatgtccaaatctattcctgagaactttctaagat

SEQ ID NO: 12461 - DNA, 407 bp, Homo sapiens
ggcacgagatgtgatgatagtaactctgaagcttatgtctgtagcttttgcagtgttcacaggttggagacttaaacttttttaagtaacatagttcagttgtttttttttttgaaaaaaacccttggcagttggaaggacttttcccaagggccaaaggggagtggaagtccaaccggccttggttaataaccattacttttcccccagggaaggaccaaacggattcttttttctcctcctcaagcctcccaaacaaaaggtaaaccagcctgggcctattttaagttggacctggccaaaccaaggatttttttaataaaaaatttaaaaggtccaccattagaacccggataatttttaccccattttctttggcccttattttttaaccctcccaagaagcg

SEQ ID NO: 12462 - DNA, 406 bp, Homo sapiens
  misc_feature 3, 5: n = A,T,C or G
ggnangagttccgagccgccgtaagactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgaatgttcgcatcttaccacatacagttctttacatggctgattcagaaactttcattagtctggaagagtgtcgtggccataagagagcaaggaaaagaactagtatggaaacagcacttgcccttgagaagctattccccaaacaatgccaagtccttgggattgtgaccccaggaattgtagtgactccaatgggatcaggtagcaatcgacct

SEQ ID NO: 12463 - DNA, 403 bp, Homo sapiens
  misc_feature 1, 2: n = A,T,C or G
nnctcggcacgagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctcc

SEQ ID NO: 12464 - DNA, 403 bp, Homo sapiens
cgttgctgtcgaagacctgcctcccatcctggcagcccagcctgagaccgttgcattgaggcaggcaggagcggcagggtggctgctctccaggagcccacctgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccac

SEQ ID NO: 12465 - DNA, 404 bp, Homo sapiens
ggcacgaggccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatacccagtccacctccgaggcgctgtgctcaccacgcgggggtagtgcctcaaggtggcggacagctgtgggtctttggaggggagtttgcctctcccaacggagagcagatctaccactacaaggatctctgggtcctgcatttggccaccaagacctgggaacaagtcaactggccatgtccacgaccaaatctgccttta

SEQ ID NO: 12466 - DNA, 402 bp, Homo sapiens
ggcacgagataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcgcacttgtgtgaatgcccaagagataatacttgtacaaggaaatttttcatctatgttgcaattcaagtcataaactctttgttctctgcaacaggaggtaccacatttatcttgttgactgtgaagattgctcaacctgaattgaaagcacttgcaatgggtttccagtc

SEQ ID NO: 12467 - DNA, 399 bp, Homo sapiens
  misc_feature 199, 200, 202, 203, 204, 205, 206, 208, 212, 213, 218: n = A,T,C or G
cgttgctgtcggtgtgggggtggagtggctcttgcccacgcctctcacctctgccttcatttgtgctgccaccctgcccctccctcgtcctcctctcccgcttcctcctctctgtgtgcctcagtctcctgccggaagaaatgggttgagcccgaaaggaggctgtctgaggaagggagagggagggcctggggtgttnntnnnnntntttnnttttntacttttcttttttttccttccttcccttatttccttctctttcttttccactcctccccttctccttacttctatctccccctgtttcttcttgcccttcttaatttacctttcattccctctttttccacttcaactcacataattaattttctctttccataactttaacccatgtat

SEQ ID NO: 12468 - DNA, 398 bp, Homo sapiens
cgttgctgtcggccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaag

SEQ ID NO: 12469 - DNA, 401 bp, Homo sapiens
  misc_feature 401: n = A,T,C or G
ggcacgaggtactgcttcctccaaccaggtggagaatcctggcaagcactacctcagccagagatttaatgttgatagtaaatgcatgtagaaatggatccatctggaaacatagagataggaaaacatgattcttttactttttttttttttttttaagggaaggggctaattttgtcacccaggctggagggcaggggcatgatctaagctcatggaaagggccctttcctaggctaaaagggcccttccacctaagcctcttgaaaagtaagggataaatggaaaggtttttttttattggatcttcttattgggccacgggggaccctgaaaaaaattttcgggccgggctggggggttaacacctggggccccaccacttggggaggctggggcgn

SEQ ID NO: 12470 - DNA, 395 bp, Homo sapiens
ggcacgaggaggcatgtgtgatagtgtgtttcgggctcttcccacgaaactcggctctgcacagtgagacctcatttcctggttctgtttgatgagtgagcgaatgcacatggcaggcggtcatgtcccttgggcctgtgaggtgaggaagggtccctgagccctgtggggatagagactcttccaccattctgacatgatccgagttagcaggcagcactgtccagatggaaatggggatgggagacagaccatctctctcagcgggtccagccatgagccagcagactgtttcccattggcccccatctttcagagtgggatgatctttctaacaaagaaacccacacaggaatttggcgtgtgtgtgcatgtgtgtattacctttgaggatg

SEQ ID NO: 12471 - DNA, 396 bp, Homo sapiens
gagtgatagaacataccaacgttaccaagaaatttacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcatagagagtgtgtatggctttgatggcactggtt

SEQ ID NO: 12472 - DNA, 398 bp, Homo sapiens
  misc_feature 303: n = A,T,C or G
ggcacgagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttanaacatttttaaaaagagagtatatggatcgcaagaaaaatgaagggttatcatacttgaaagataagcacatagttattgctgaatataatgtgg

SEQ ID NO: 12473 - DNA, 395 bp, Homo sapiens
ctcaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaagagaaggactcttgggttttgtgttgccatgttaagcatggagagggatg

SEQ ID NO: 12474 - DNA, 398 bp, Homo sapiens
ggcacgagccaaccccggaacccctggtgtgtacgggtcaggcagacacatgtggctgggcggctgggctggggaggggacagccgccacctcagggttatatttccctctccccttccctccccgccaagagctctgccaggggcgggcaaaaaaaagtaaaaagaaaagaaaaaaaaaaggaaccaacccccctctacatattatggaaagaaaatattttggccgatcctaattcttttataattatgcggggaaaaagtaaacccattaaacgattccagttggaaacaaaaaaaaaaccctttaaaactatagggggccggtttccgtaaacccaaactggataaaaaccttggaggagttgggccaacccccacctaaatggcggggaaaaa

SEQ ID NO: 12475 - DNA, 398 bp, Homo sapiens
ggcacgagccaccatgcccagccaatccatgaaatcttaatggctcaactaaacaaacatttagttctcattcacactacatggccgtggtgaggaagaccactctgctccatattgtcactcagagatctagacagatggagtctttactatcttatgatgttgctgtctcaacacacagcttctagagttcctgtggtgggataaggtgtaaaaaacttaaactttctcttaaatgctttggccctggctagcatcagtcctatgaatcttcctcagtgctagggagttgggatgtgcagtcctccctgatgcccaaacagaacaggcaaaccagatattactgagtgcaagaaatccctactatgtgtactgaggaacaggattcaagctgtatt

SEQ ID NO: 12476 - DNA, 401 bp, Homo sapiens
cgttgctgtcgggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagactccatttcaaaaaaaaaaaaaaaaaaaaaaaaccccttggagcctgggggggggtccaaaaaaaacccccattttgctgaaaggggttttttaaaaacttttcccacgggttttttggggaaaagccacttaattaa

SEQ ID NO: 12477 - DNA, 400 bp, Homo sapiens
ggcacgagacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatcttt

SEQ ID NO: 12478 - DNA, 400 bp, Homo sapiens
cgttgctgtcgataattttttattattttagggtagaattgacatctttataacaaatgagtgtttattcccctttgtttaagtaatctgttatttctgtcagtaggtttttatgttttcttcatacaggtcttatacagttctagttgtttatatctacagattttatcttttttgttgctgctagtaaatgtaagtgggttccttttttttttacattgtatttcattggccccccaacacccctcccacatttgattgatagacttcttgatcccttttgattcctcttccctacccccaagcagggatttgaatattaattttttcattgagatataattcacataccataaaatcaatccttttaaagtatgtaattcagtaggttttaatatag

SEQ ID NO: 12479 - DNA, 396 bp, Homo sapiens
cgctgctgtcgatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggctcagacatccgagagcatgaccccaactgccacttcagagacttatttgaaagctttggccgattgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcacagcttttttcaaggagcatacctg

SEQ ID NO: 12480 - DNA, 397 bp, Homo sapiens
cgttgctgtcggcgcccttggccttatgacccaacttctctcaccgccatggagttcgacctgggagcagccctggagcccacctcccagaagcccggtgtgggggcgggccacgggggagatcccaagctcagtccccacaaagttcagggccggtcggaggcaggggcaggtccgggtccaaaggtaagtcgcctcatcaccggctgcggagaggcgggaaggctggggttgcccctgaccccagggtcctgccttaggcctccaacttcagggggctgggtaaggggcgccgcctcactgccacaccttcatccagcaaggacaccacagctcttccgactccagcagcagctccagcgattcggacacggatgtgaaggtaaggggctctcgc

SEQ ID NO: 12481 - DNA, 401 bp, Homo sapiens
ggcacgagggacctcagtggaaacacgcccctcatttatgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaag

SEQ ID NO: 12482 - DNA, 391 bp, Homo sapiens
  misc_feature 290: n = A,T,C or G
ggcacgaggttaatacaagtaaaatacttaagacagtacatggcacatagtaaatactgtttaaatattaactgcaattattattattatcatcattattgcagtctgagatatctggcctgaatttatcaagttaggaagctctgtcattgcacagaaataccttgttctcaggagagtcactaaccgaagtgcttctgtaaacaagggacataagcagagaaggggtatgtaagtacagaaaactcatgattacctggggaatagttaaatagattttaggtattagntggtttttttttcctctctctctctttgggggaatttttctgtttactgagtcattcttcattaaggggtgaggtgtcaaaaattagacaaaacaaactag

SEQ ID NO: 12483 - DNA, 394 bp, Homo sapiens
  misc_feature 362: n = A,T,C or G
cgttgctgtcggcaatggcgtgatctctgctcaccgcaacctccgacctctgggttcaagagattctcctgcctccgcctcccaagtagctgggattacaggcatgcgccaccacgcctggctaattttgtatttttagtagagatggggtttctccatgttggtcaggctggtctcaaactcctaacctcaggtgatctgcccacctcggcctcccaaagtgctgggattataggcgtgagccaccgcgccggctgccttaaatctatttatctgacgttcccaactaggaaattttttgtccaaatgagtatatgtgattttaaagtagaaatcgaaggtaaaataggatttatctcagntcctatctcccttcaatctattcttcatattg

SEQ ID NO: 12484 - DNA, 393 bp, Homo sapiens
  misc_feature 393: n = A,T,C or G
tacggctgcgagaagacgacagaaggggtaatcccagcactttgggaggccgaggcgggtggatcacctgagatagggagttcgacaccagcctgaccaacatggagaaatctcgtctctactaaaaatacacaattatccaggtgtagtggcgcatgcctataatcccagctacttaggaggctgaggcaggagaatcacttgaacctaggaggcagaggttgcagtaagccgagattgtgccattgcactccagcctgggcaacaagagcgaaactccatctcaaaaacaaacaaacaaaaaaattgcaaaatgtagtcaccctgttatgtttcatgactctgaaagtgttatgtgtttttttaacagtaaacagtcacttcaatagtttn

SEQ ID NO: 12485 - DNA, 394 bp, Homo sapiens
atccgttgctgtcgattcagaaactgattttacttttattgcagtacaaattatattattaagcagggttcttgttcagccatgaaatgcagatgggctgtttaatatgcacatacatgacattttttattaattttggtggtcattacaatgagttgaatttaaaaagtgggttaatgctttataatattgtattttgaacaacaccactcttattcattttaaaaatgcccactgtgacagaaatattacaatttcatgtttagttaagcaaaataagcaaaactgggagaatttaaggtggcatcttatttactgctttccagtaggattataattaaaaatttactgaatgaagtggtataatattgataaattaactgattttctttct

SEQ ID NO: 12486 - DNA, 391 bp, Homo sapiens
ctgaggtcacctcctggagtgagggtctggagtgaagcccagcccgccagggtcatctgggcccacagaccacaccccggtaccgggttgcaagggtctcctgccgggagtttccaactagtcactggtgtggctttttctttcatgcagcgagtctgacagtgacctaaagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccct

SEQ ID NO: 12487 - DNA, 392 bp, Homo sapiens
ggcacgagccaaccccggaacccctggtgtgtacgggtcaggcagacacatgtggctgggcggctgggctggggaggggacagccgccacctcagggttatatttccctctccccttccctccccgccaagagctctgccaggggcgggcaaaaaaaagtaaaaagaaaagaaaaaaaaaaagaaccaacccacctctacatattatggaaagaaaatattttggccgatccttattcttttataattatgcggggaaaaagtagacccattaaacgattccagtgggaaacaaaaaaaaaaccctctaaacctatagggagccgttttacgtaaacccaaactggataaaatccttggaggagttgggccaacccccacctaaaaggcggg

SEQ ID NO: 12488 - DNA, 393 bp, Homo sapiens
ctcgggaggctgaggcggcagaatcacttgaatcatagaggtggaggttgcagtgagctgagatcgcgccactgcactccagcctgggcaacagagcaagattctgtctcaaaaaaaaacaaaacaaaacaaccccccaaaaaaacccaattaacattctttcaccccggatttcctagactttattttagctataacaagcaaaacacctctttccatccttctaaaagcgtgttcctgaaacctcacttggagagttttacggaaatgcagcgacaggactggaaataatgacagcaaagccaaacaagttgcaagcaaaataaaagaacaaaccttgaacgacaaagttttcccccacgacctgaccgtgtcgctataaagacgggaggg

SEQ ID NO: 12489 - DNA, 393 bp, Homo sapiens
ggcacgagtctagatcacattttatatatgctgcatgccaaaaaaaaaaaaaaaaaaaccgccttttttggggggggggggaaaaaaaaccaaattttcccccttcctagaaaagtcaaaacaaggttttcctggaaaccttttcaagaaaaagtaaaccaggttggtttttgaacctttggccattttttttttttaaaaaaagcaaaattccagccccaatccttttgaagggtttggaaacccccaaacccccggagaagccctccattttggaagggggaatttggagaaaaacctgtttttccccgaatttggccaaataaagggagggttttttcaattcgggccctaaaaacaagggcccccgtttgttctaacccataacaattt

SEQ ID NO: 12490 - DNA, 391 bp, Homo sapiens
ggcacgaggccagggtcagcgcacgccacagggccagttttggctggagaggcctctgagaatttgtgactgaagtccaagtctgtggcatcagggtctgcagagcccagatgcgggagaggtaggaatgtacctggtgatatgaggcaaggacaggggagctggggcaggtgatgcaggcaggtggcatgaggagctgtgctgggtgggtgcggtctgagtggctcatgttgggtaaagggccagagacctgggtctacagggcagacatcaaggctgagccagtcagacagtgtttgtcaacactgggctctcaccaggctccctcaggccgaggtgagcagccagggatctgtcatgtgtgaggaaagtgtctgttcaggttaggtgg

SEQ ID NO: 12491 - DNA, 394 bp, Homo sapiens
cgttgctgtcgtaaaaacatctcttaaaataagaggagcaaaatctattaaaacctattctcctgcaaaggaggcagagactttctctctctcttttttttttttgggggccctaaaaataaaccagggcccctctttttaaatattccgggtaccccaagcgggccagggggttttggggtttgccctttggggggcaggcttaataaaaacaaaccctatttttggccccccaaaaaaccccgccctaaaaaaattgtttgaggggggaaaggcccaaaaaggcctggtggtttattctccatagacgggaaagccagccccttccccttgtaaaaagggggagccaaaatttcctgacctcttgggggttaaaaaaactcttacggtgggg

SEQ ID NO: 12492 - DNA, 391 bp, Homo sapiens
cgttgctgtcgaatacctgcctcccatcctggcagcccagcctgagaccgttgcattgaggcaggcaggagcggcagggtggctgctctccaggagcccacctgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtg

SEQ ID NO: 12493 - DNA, 391 bp, Homo sapiens
ctcaggcccattagtgatgactctgaaagcattgttgaaagtgtttcaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattggtttgcctgaatttgagaaaaccg

SEQ ID NO: 12494 - DNA, 392 bp, Homo sapiens
ggcacgaggggcggcggagccgggcgcgaccgccgggtctgtcccgcaggaggaggagtaccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagaggaagctgcagcagatccaggatgccagaaaccatgtgagccaagccatttacctgcttaccagcg

SEQ ID NO: 12495 - DNA, 391 bp, Homo sapiens
ggcacgagagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcat

SEQ ID NO: 12496 - DNA, 392 bp, Homo sapiens
ggcacgagggactaccgagattggagcatgaatctttaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgagatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggagccaagcccagcgtggaggcggtaggcat

SEQ ID NO: 12497 - DNA, 392 bp, Homo sapiens
ggcacgagggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtgggtcctgctaatctataaaatcagctatgccag

SEQ ID NO: 12498 - DNA, 384 bp, Homo sapiens
gcacgagacagtttatattgacctataaccaagaggcaggttcattatgtttaattgcattaaaagataaaagaagtagagaaattgaaaggaaaaagagcccagagattgttacctttttatcaagcaacagcatgccacaaactttgcataaataaaaaataataacctgagcctttcatcttgggaatctaatgaaataaatgtgtgctgttttccccattagccctcaccttagccagcccttacattgtggacagaggagtgatgtcattatttgtgagctagatgactggctcagtaggtgccgtgtggttcctaagaagattgtaggtcttgccattgcgtcttgtgtctcttgctgtacaggtggaaacatctgtg

SEQ ID NO: 12499 - DNA, 385 bp, Homo sapiens
gttgctgtcgggtttggcctgtgggtttttaagtggttattgaattggtatcaggagatcctgaggctggtaggggaaggtgattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggt

SEQ ID NO: 12500 - DNA, 388 bp, Homo sapiens
cgttgctgtcggtgatctggcagtacatatattcctagtaaattcaatcattcattcgttcattcatgcagcatgaattcatatttcccgagcttatggtatgcacaatactaggaaaagttcaaccatgagcaacattccttacatcttaatggagggaaacagagcttaaacaaatgactacagatttggaaggaagcagtgctgtaaggaaacctgaagtagtgtaaagagagaaagcttagtgggaaaggccctttcttttcatttggtgtcttgttttctactcttgctcatgaaatgttctgagtagcttcaaatatgttttaaattgaattgtgtagagtccagtacctctgagaggtaactgagtgcagctattctaggg

SEQ ID NO: 12501 - DNA, 384 bp, Homo sapiens
ggcacgaggatacaagtgtctccttgtcataacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttg

SEQ ID NO: 12502 - DNA, 156 bp, Homo sapiens
  misc_feature 1, 2, 156: n = A,T,C or G
nnctctgatttgagaaaagggaggaggggaagatagtctgaatggaaatctgaaatacggaatgttttagagaaatatgtcacttgcatatagaatgttttaattgaggtataaaataatgagacaaagtgaaaaagaaattatattcagataggn

SEQ ID NO: 12503 - DNA, 389 bp, Homo sapiens
cgttgctgtcggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccgg

SEQ ID NO: 12504 - DNA, 386 bp, Homo sapiens
cgttgctgtcgcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaagcgggctgcaggctccctgctctccccctg

SEQ ID NO: 12505 - DNA, 385 bp, Homo sapiens
cgttgctgtcgctttccaaatactgctattttcttcaaggtgttttttttttgacatctactttggaagtttgattatatcctgaaacctaaaatcacatccttattgattctgagtctgctaaaagttatttcaactaatttgaatattatcgcaaaaagtttacttgagaaaacaagttgaaattgaaattttgacttgctaaaattacattttttaaacggtagttttgaatgacattctaaaggtaatttagttggactttgtgtttatatggccaatttggggaatggccctgtatgttttttgtaatgccataatgggagctgcagtgttgtgcaggtatcaaaaagcttcccagttttcatgttagtaaacttggaag

SEQ ID NO: 12506 - DNA, 387 bp, Homo sapiens
ggctcgagacctggcctctctgggaaggctaccagtggcaaaaaggacagatgcaggggcagagcggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctcca

SEQ ID NO: 12507 - DNA, 384 bp, Homo sapiens
ggcacgagggactccgaaagcctgcgcattaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaa

SEQ ID NO: 12508 - DNA, 389 bp, Homo sapiens
ggcacgaggccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacct

SEQ ID NO: 12509 - DNA, 379 bp, Homo sapiens
ggcacgaggttcataccaacatttattaagacttatttttcagtggtcctcaatcacagaacaattaagcaaccatatacaatttaacatacctgaatatgagaaacacatttaaattcattgttggattaaacacatttcaaaatggaaagacaaatattttatttactgacctaaaacaacactacctatgaaattcatgcactattgctttcagattacttacaggattatatcaatttaacatttctttgtgagattaagcatttgaaatccatagtcagagaactattttaaatatgagccactaattaacaaaatatacatatagcttctacatttccatcaggttatgtattttctagagactacatgaccc

SEQ ID NO: 12510 - DNA, 379 bp, Homo sapiens
cgttgctgtcggctagagtgaatgagcctcaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgc

SEQ ID NO: 12511 - DNA, 380 bp, Homo sapiens
  misc_feature 266: n = A,T,C or G
ggcacgaggagggcttgagcccctcagcccagcgggggtcccttttcatcccttctctgacagattgctttgtaaactttcttaggccttccccccacccctttgccccagtgctttaagcccttctttgtcttcttgctgtttcttttattcctcacgcctgcggggcgggggcggggtggcgcccaggacgactccccgggctcagcttggctgcctgcctccttctgtaagtgctttttttttcttcacctgggaccctctanaggttggaaagagaagagaggctgggagcggatggaaagcatgactgcatctggagcccctggggggagtggggaagagggagtggaaggacagtggctgaggggcttcctgtt

SEQ ID NO: 12512 - DNA, 381 bp, Homo sapiens
cgttgctgacggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggcataatccttgttaaaattttgggttggcctcctctttttcccccaatatagttgcaaataaatgatgtctttcagagttgacattaatcctggagcttgaatgg

SEQ ID NO: 12513 - DNA, 380 bp, Homo sapiens
ggcacgagccaagactcctgtatgtaatgtagcagctacctcagctgggccctgtggtgaaggaacagagctgacatctgagcctcaaaaatccagcccatttgtaactagagtaccagaatatcctccgcattctgaaaacattcagtattttcaagatccaaggactcagataccctttgaagtcccacagtacccacagacaggatactatccaccaccttctcctctgttcagtgtaaactttcttgcggatttctcagagagtgtgagtggtacaaactttgaagaagatcatctttcccattattctccctggtcttggggcaccatcggctcctgtataaatgccattgattcagagcccaaagatgtcattg

SEQ ID NO: 12514 - DNA, 382 bp, Homo sapiens
cgttgctgtcgctgctgaactgttttttgtgcttcctctaagcttttcttttgggtacaaagtttcttaatttttcatttgagatttaatctctgcttaatttatttttttaaaaatataatggtcaactaaatgtttccttatgaaagtgaaattgggaaaagtcaagataaatcctagaaactattttgttttaagcaaaatgagggcttaaaacttgcaacttcttttccatttgaaatttggcttgctgtggtgctttgcaaacttttggttgtgatttatcctgtcattcataaattatggcacatatgctggagccaaatctgccattaaataaattctcacataattccctacattcatttatttcactaatcat

SEQ ID NO: 12515 - DNA, 379 bp, Homo sapiens
  misc_feature 379: n = A,T,C or G
ctccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccan

SEQ ID NO: 12516 - DNA, 375 bp, Homo sapiens
cgttgctgtcggtggtgatctccttatctaatggatgaatgtcagttatctccagcttttgcaattatagcagtaaatgtagcaaatacaaagccatattgggcttgttgaaaatatctgtaagataaattccttgaaattaaaatgattacgttctcttctgtggatcttagctggcacattccccttacacacattttggcatccttgccttctttctgcctctcattttctgttcctactacttaatgccattttgcttccatcttctgtcactactgcctctacttccacttaagctgcagaattgagggtgggccttagacctggtatgtggaggagagaatgattaattatacctggttcatgctttag

SEQ ID NO: 12517 - DNA, 378 bp, Homo sapiens
cgttgctgtcgctggagtctcttaaaattcacacttgtaccagagccaggcatcacagagcacatactaacttttcagcatctggattccttatatatcttttctctcaccatgaacagttaagtgtagcagttcaaagttccagctctggaggcagagtcctgactctgttaggcaggttcttaatctcaactataaaatgaagttacaaacattgagtgcctcatagggccagtgttaagattaaatgaaataaatataaaccatttggcatggttcctggagcgtggttaagtgctcagtacgatgatgtccctgagatcagagatgtgccttagatatctttttgattcagtaccatcacataacctcagagag

SEQ ID NO: 12518 - DNA, 374 bp, Homo sapiens
cgttgctgtcgcctagttagtgttttaacatgaatgtctaattcatggccaatcttatttcatctgtacttcttccacatccccattcttacaaaattatttttatttaaaagaaacatttttaactttttatttttaaaatttgaaaattaatgattaaaaatgttacttttataaaagtgttaatattcagtatttaaaagataattttaaaaataaccacaatacaattttcctacctaaaaaattttaatgagtttcttagcaaatatccaagccatttttgtatttctctgatagttttataaatctgtatgtatgtgtttagtgacttttttgaattaagattgaaataagattcataaaatcactat

SEQ ID NO: 12519 - DNA, 375 bp, Homo sapiens
  misc_feature 327: n = A,T,C or G
ggcacgaggggaggcccccaggagggtctcaggcagctttgctgggagtgtccacatcaccctgacccccgtgaggcctgacaggaccccacgcccagccagcccaggacccagcctcccagccaggtccccctccccaccccaccgcaggagactggccgtccctgccagcctcgacgtttgtgacaactggcttcggccggagccccctggccaggaagcccgagtgcagagctggaaggaggaggagaagaaaccccaccttcagggcaaaccagggagacccttgtccccggccaatgtccctgctctgcctggcgagacggngacctccccagtcaggctgcaccccgactacctctccccggaggagat

SEQ ID NO: 12520 - DNA, 377 bp, Homo sapiens
ggcacgaggtcctgctccgtgtcattatcaagcgttaataaagcatactggcaggcaccagactacaggcccttgggaacagccttctgagccagcatttattcacactgcattaccgtgtcctccatgtcaagtccctattcctacggaatgacttgggaaacatgaggtgagtccactaccatgccatgctgcaggaccctactcttgtataagagtttgtggaagaatcttgcattgtcagaatcacacatgtatgacagaatgccacaaagtaactcatgctgatggctgcactggataaaacaaggctgtgccagaatgccttcattgtgaggaagggagctccaagtcacggccactaggttgtcttcacc

SEQ ID NO: 12521 - DNA, 372 bp, Homo sapiens
gtgggcatggtggtgctaaccgacctcaaggtggccacctccctgctgctgctgctcttcgccatcttcatgggcctgcgggcctccaagatgttcgggcagcggcgcaacgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcg

SEQ ID NO: 12522 - DNA, 371 bp, Homo sapiens
  misc_feature 371: n = A,T,C or G
ttcaattccgtgctgcttacattttctatcctttataggaggccgagctgcaggggggggcctgtcttctggggggagagggtcctcaaaggagcggaggcagctggagacccctggaggaatcttgcagggctggggacgtaagacagtcccatggaacaaataagatggaaacagctgcaacatatattttttccttttagagatccaaccttattccatttataataaactgagaagttctatatcaaatataactgcctgtaacattttaaattgcttcaatctgagtttaacacccacctttcctttcatctcttagcaaataatcttaaagctgtatctaacatgcagtcagaaaaattacaatn

SEQ ID NO: 12523 - DNA, 353 bp, Homo sapiens
tatctgctgcgagaagacgacagaagggtaggtgttacgagattgggagacttttctcagcatatctaacagaagagggtatccgaggtgagagtgtaaggcctgggcaagggttgggaggcagttctaatactgaatgttctgactgtggtttactatgtatttcaggttattttgtttaatctatccagtaatcctttcatgtaacaattatgatgtgtgtgttttaggtggggctactaaggctagtaagtagtgaggctggatttaaacttaagtctccagcttcgtggcccaggttctttatacttgactccacactgggcttattaagtgaatgacaaggagtttgg

SEQ ID NO: 12524 - DNA, 342 bp, Homo sapiens
actacggctgcgacaagacgacagacgggctagctaacggtcgctccacccatagaaaccaaagtttttttggcggtacagggaaattataggatgttactgtgccccccacccccattattagctgcgctatccgcagtgacatgaccatgtgtcctttcttgatgggctaagtaccagcagatgcgatcatcagtgctaactcaagacaatatctgaaggctgggggtgctgcttttgttcacattttttttttttaaataggaaaaaaacttggaagcttgcagaaatcttcctgtaacattttattggctggattataccacatgcttatttctatac

SEQ ID NO: 12525 - DNA, 335 bp, Homo sapiens
tacggctgctagaagacgacagtagggctcatgaggaagaggaggaaaagagcattaccgctgtttgtcacatgaggattcatttgcagatagtatgaaaatggaggcaatttttccagtctcaagaatggtaaaaggcacaggtgggacttgaacccagactcttggcttcaagtccagagttttctcatgcaccagctacccctcaacaggatttgactatcctgcagtaaccctagaggaagtttagtccttgggacgcttggcctgccagtctctgaaaaaaatatgatggggatggtggtggtggtagtgcacgttgggttgaggggaca

SEQ ID NO: 12526 - DNA, 331 bp, Homo sapiens
ttacggctgcgagaagacgacagaggggatgagccactgtgcctgacctaggttatcattcttgagaaaagtttaaacatgccatataaatcaaaatattgatgacattaattaatagcacttaattctgactttgactttttttcaatcccattagtttactttcatttcttacctaaaatttgtttagtggttaatagaattctgaacctaatatatcatcttattattttctgctcaatgtgtaacactagtctgactattttattctttttttttttttttttttttggaaaaaagtttccacttttggccagggttgaaacgcccg

SEQ ID NO: 12527 - DNA, 457 bp, Homo sapiens
  misc_feature 15, 19, 20, 21, 22: n = A,T,C or G
attgcgatatgtcantcgnnnntcgtcggatcccatggacgggaattctgcacgagagttagcacagccaacggaatttgattgaaaattgaatttgatgaaaatgatgggccaagcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttataagttcaagccgatgtccaaaaggaaattttccccaaagacacagccagtcttggtgcaattagtgacaacgcaagcactcgtgctatggccggttccataatcagttcctacaacccacagg

SEQ ID NO: 12528 - DNA, 429 bp, Homo sapiens
ctggacattcaggaggcaagccaatcttttttatttccttataaaattaactcttcaaaagccgttaaacagagagttatcttaatttttattgcagtaggaggaaatatatttaaaatatttgtagatttatagcaaatagagactcgttatttaaaagttaaataacaatttgttcttttgttgtttttgccagtttagggcagaagctgcttttgtcataaatatcttcctaccacatcaaaaatgctgcttttaaaatttttgtttataaattgagaaggaattttctctctataagattgctgcattgaacagatcaccattaaaaagaatattagaatccagcatgaagataatggctaataaaaatgaggtacatactctataacaccattaatcagatttgaatgaggaatgcttcccacc

SEQ ID NO: 12529 - DNA, 425 bp, Homo sapiens
tgatcgcaggaacccaccgagcttgctcgcttggtcctttgcccgaagcggcctacggctgcgagaagacgacagaagggctgtaatcccagctacttgggaggctgaggcaagagaatcacttgaacccgggaggcggaggttgcagtgagccaagacagcaccactgcactccagcttgggtaacagagcgagactctctcaaaaaaagagcaacaacaacaacaaaaaaaaccatagccatatggcttgagtaaggaaagacagagttgctatttgttgagatggggatgacagtgacaagagcaggcttgcggtggtggaaagtgcaaatgtaagtgttcgattttggatatacttaatttgaaacgtcattatacaaccaagtggagatcttgcatgtacactggagatacatggcaaaa

SEQ ID NO: 12530 - DNA, 420 bp, Homo sapiens
caggtaggggggccaccttgagtgggtggcccagagactgcctcagggctccaaggtaacggggtgctcaggttatcttgggtgctgccctcccaggttctgggggagcaaaggctgggcgctggcccaacttacaggaaacactcacctttgaactgccattggcaccatctgggcagtacacagccccacccagggcctctagttcttgttctcggcttacaatctttgtgtttctgcctgagaagccactgcctcctagtttgtggtctctacagatatagccaggttggacttccggctccgtcctttgataactgcgtgctcttgggcaaatttcttaacttgcaggttcttgtgaggataacatgagttaattgagggcacttaacactacctggcacagattaagctcatctg

SEQ ID NO: 12531 - DNA, 419 bp, Homo sapiens
  misc_feature 398: n = A,T,C or G
ggcacgagaacaagctgacattatgcactgagccagaagcttctcagacttgcccagagttacacagcaagtccagggtatggctgggaattcaactcaaggctgttggactctgaagcttttggtttttgttttttttcctccactacacagtactgcatgccatgtgagcaagatcccgacacagaatgaagtaaccagtatctttaaggcaaacaagcagatcagtagaatctgatgatttcagggtcaaagaaaagaataattttaatgcaatccctcattaccacagccatggcactggcctcatatgggtaaggagatttgggcaaccttttgcaggctgatgaaattttggagcctaaattgtaaagttactgggcctccctgctgggtanaattcttttggaatttctgag

SEQ ID NO: 12532 - DNA, 420 bp, Homo sapiens
  misc_feature 379: n = A,T,C or G
ggcacgaggagagaactagtctcgagactagttctctcctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagncagtattggagaggcaagcagagggcagtgggtctcccaaa

SEQ ID NO: 12533 - DNA, 414 bp, Homo sapiens
ggcacgagcccatctcctgttctcacaatgtagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacag

SEQ ID NO: 12534 - DNA, 414 bp, Homo sapiens
  misc_feature 277, 280, 281, 282, 283, 284, 285, 286, 287, 288, 289: n = A,T,C or G
gacaacttgagaaacaaatgagaagcccaaggaactgtgagcaattaaaagcaaaccgcgacaccgtgtgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaaaaaaaaaaaaaaaaaaaaaaaaaaaaaaaaaaaaaaaaaaaaaaaaaaaaaaaaaanaannnnnnnnnnttcggggggggcttttttttaaagcacccagaggaaaaatagcttggggggggtgtgccccacccccaaaaagaggggggggaaaaaattttttttttttggaaaaagggggccccctcttttct

SEQ ID NO: 12535 - DNA, 402 bp, Homo sapiens
  misc_feature 402: n = A,T,C or G
cgttgctgtcggtatatactcagttcccaaaagtggagtgggtacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttacattcaattaaaataactcatn

SEQ ID NO: 12536 - DNA, 409 bp, Homo sapiens
  misc_feature 409: n = A,T,C or G
ggcacgagattacatagtgacatatattatcttttcgtccacatttgataacattgctaatattttcttttttttttactgaagctctttgaatttaaagttttctctcatttaaatttattaattaaaaacatacctttactctgttccctttagcatttcaacctgatgttaaaagatgtgtatgcgtgatatgtgtgtttgaaattttaactttcatcttgaagtatttaattctctgaagcagtgcatgactcttgctcttcagcctcttgagagtggccctggtttatattcctgatgatacaaaccctggaatttcttgtctgaagtgttaacactttatttccaggtcctaatttgatttgaatagtggaagttcagattcaatgcattaatgacagattcn

SEQ ID NO: 12537 - DNA, 406 bp, Homo sapiens
  misc_feature 272, 274, 276, 277, 279, 280, 281, 283, 284, 285, 287: n = A,T,C or G
ggcacgaggaaatctatgtagttaatctcaataaagaaatcattttggataatttaaaactgttattagtggtattctcttacggtcttactaaactttgctgtaacagtaatgctttggttgctttaactaatcctatcattaaaaatgaaaatgattttgctttttaatttgcgcaagtagcactaaagatagaagcttaattaatgaaagctaatgtcaataaggggtagatagagtagtatatgtgggggtgggagggtatgggagtntnanntnnntnnncnactgatgttctgtgttattggaatgttgaactaaatttaatatagctacttaatatagagcgtttctgagacaaattattaccgatgatgatgacctaggtggaaactttcaattacat

SEQ ID NO: 12538 - DNA, 402 bp, Homo sapiens
  misc_feature 402: n = A,T,C or G
ggcacgaggtctgaaacagcactcaagctatctttccttttctcattctgtttaatttaaaaaggcaatagtaatagagcatttcaaatcactttgttgtggatttataaggatgtttcttcgttgggacaagtcattcctcctgtggaggaacactacctcatttttgcattaagaaaatagtataaagtttctggtgaaagattagacaattattctcattcatggatctacaaggccatcatgtcaaaacatttatgaaaatgttccgttcctcccttttccaaaggccagaagtttacccctgtatgtggcaggagatatgagtttatccttgtttttattatttgataaatggatttaagttaaaatatattgcatttagcaaaattatagtataan

SEQ ID NO: 12539 - DNA, 412 bp, Homo sapiens
cgttgctgtcgctcctcaaaaaatgatatagttcccaaagagaggtgtcagtgtcttgaaccgtcaagttcaagaggccatcagactcaatatttactcattccttcatgaaataagtacttaacaaaaagctgctgcatgccaagtcactgtgctaggcattgaggattcagctctacacagggctgtcttggtccttgctatcttttagctaaaatgtagacacataaataaacaattacatatagtgtgacacattctacagtgggggaatccagggttctcaggcagattgtaggagagccacttcatctagatcacttattttcagtgcttcaactgtgttttcaatgaagatgtcactttgaaaataatacttctaatttatgccccaagtgtattgcttttactt

SEQ ID NO: 12540 - DNA, 403 bp, Homo sapiens
ggcacgagatccaattatttctataaatcccattgatttcagggaactgaatttgatagccaggaggcattccactggcttcttaaaggacattattggttttcattttgttttgttttgatttcaattgcaactcaaacaatgaatcttccaaagatggttaccctcactctacaaaagtgctaagttaatattctttaaaataaatacaagcatttcttggactagataccatcaactttaattttatttttctcacataaatgttaaccaaaaactaaatgataatttccttctgtcacacagcaattccactgtggtggaacaaagtgttatctcaagtttcacagagcaattgttcaatcattcctgttggtggctcctttccaaatcttcgagaatg

SEQ ID NO: 12541 - DNA, 404 bp, Homo sapiens
gattccatctactttaagtttaaaggattttcagaatcaccttaagtgtcaaatttgttagcaggattaattgatatgaattcacttattaaacagtaaactcaaataacatagacatcaaataacagacatctgctctagttcatgataaaatgttgatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatg

SEQ ID NO: 12542 - DNA, 408 bp, Homo sapiens
cgttgctgtcggatttgtaaggaaaactgactgtttttaactgtggtgcttttcaaaagtttaaaattgcgtctgtgtgctttttgttgtattctagcccttatgtgggtttacagactgagttcatgttacctatattttattaaaaatttcaaaccattgagcccaggatatcgaggatacagtgagccaagattgtgccactgcactccagcctggatgacaaagcaagaccctctcttgaaaaaagaaaaaaaaatttcaaggcattgaattctgggtagccaagaaaaatggatggatgcctaaacccacatctccctacataaccttccaacaaaatatagaacagcaaaatcaaatatatctactgttgactcttgaacaatgtgggagttagggatgctg

SEQ ID NO: 12543 - DNA, 409 bp, Homo sapiens
  misc_feature 409: n = A,T,C or G
ggcacgagagtaatgctaaaaaaatgcactttattatcctatggacttttccaaatgccatagctaccaatagagtcatttgcattacacatactaatagtattatttcttctgaggagatcctagctgtagctacagatatagaaaattctaccattgaagatcttgtataaccttacttcagccactgaaataatttaaattataaatattacatgtgggtttgactatcacagaaaataaaatgattatagatcctaaaaacataaattcctgaactttgcaaccattaattcataggtactactaatactcttactacagattttataagtacttccacttatagacagaagagcattctcagaaaattagaattaatctaaattatgagatagtcttaaagccn

SEQ ID NO: 12544 - DNA, 416 bp, Homo sapiens
tgagtgcacacagtagttggaaatggcagcttgcttggttggaaagttgcttaaaagtggatgggtggaatgttccagtcactccaggtggttcagaagttaaatccatggcagcatggcgcttgtgtcctcctggacttgaattaagtagaaagttactacaactcagcaacaaaaagactacacagactgggaaccgtggctcccgcctgtaatcccagcactctgggaggccgaggtgggtggatcacctgaggtcaggagtttgagaccagcctggccaacatggtgaaaccctgtctctactaaaaaaacaaaaattatccgggtgtggtggcaggtgcctgtaatcccagctattcaggaggctgaggcaggaaaattgcttgaaccccaggaggcagaggttgcaggga

SEQ ID NO: 12545 - DNA, 414 bp, Homo sapiens
ggcacgagaacaagctgacattatgcactgagccagaagcttctcagacttgcccagagttacacagcaagtccagggtatggctgggaattcaactcaaggctgttggactctgaagcttttggtttttgttttttttcctccactacacagtactgcatgccatgtgagcaagatcccgacacagaatgaagtaaccagtatctttaaggcaaacaagcagatcagtagaatctgatgatttcagggtcaaagaaaagaataattttaatgcaatccctcattaccacagccatggcactggcctcatatgggtaaggagatttgggcaaccttttgcaggctgatgaaattttggagcctaaattgtaaagttactgggcctccctgctgggtaaattcttttggatttct

SEQ ID NO: 12546 - DNA, 418 bp, Homo sapiens
  misc_feature 418: n = A,T,C or G
ggcacgagggttccagcacagtgcggttgtgtcgttggtcttttttagtatttcctatttccaattttctaagaaaagacagaattaaaaaaaaaatctcctagttttttattggcaaccaattcagaattgtttaaaacattgtgctggccaaaacaaaaaacatgtttgccagccagtagtttttagcctctgcttccagagtgttaaggacaggcctaaacatcctggccaagctttaatggatttgcatttttgtactctggatgtaagttttattctgcctctcctctaagactacttttagatgtatcttcctcctcattcctaaataatcctcagggattacttttcctcactcagtaattttccccctgcaggcagctattgcttccagcttcacatatatggcttagan

SEQ ID NO: 12547 - DNA, 407 bp, Homo sapiens
gttcaggcaggtgcttagcaattttacaattttcacaagcttctgttcagctcaccatttcggtggatgaatgtgtcatttacaaagaagtctgaaatgggaagctgagtttgaacaggcttagccattattcacctcaaattggaccttattatgactcaaattgaaatactaaaaggtataatacatgattgtataagtggcgtgccttaatgtgattctttagaacaaagtgctcttgagagaactctggctgaatgtcaggtactgtgtttttgtttctacaccaacaaaactgtgactaacccaattaaagcaacagccatgaataatattggccctgaccttgctgaattcaaaaacaaggttaattgatacctaccataaattctacctgagggttttta

SEQ ID NO: 12548 - DNA, 405 bp, Homo sapiens
  misc_feature 389, 405: n = A,T,C or G
ctcttagtataacttttaaatggcatctacataacaccagtgctcaaatttgaaaccttgaaggctgtctttttccatcaacttgtgtgaatactgactccttccctgttccccttcatcttgggtttactttcttgtttttattatatgctgatctgtctcccctgttaggctgtaatcacttttgaaagcagaaactagttgtgttccgctttttcttatctcagaaatttgccttccagctcctggcaccattctctttgtgattaacatccagtaaacatttgttaaatatgtctcttaaaatatgtatctttttaactatttatacacctccaagtggatgacatgccacattttatttcttctcagtttgttatcattctttntgcccactagaccaan

SEQ ID NO: 12549 - DNA, 403 bp, Homo sapiens
  misc_feature 27, 47, 89, 90: n = A,T,C or G
gcttctcttttgttgatcccggcgatncttatctcttgctgtcgaantggctctgcctcttttgtttcaggttgtgaccgtgtatgagnngggtctgatgtaagatgaaggtgtggatttatcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgagaagagggaacgtgaggctgcggaggat

SEQ ID NO: 12550 - DNA, 411 bp, Homo sapiens
  misc_feature 407: n = A,T,C or G
ggcacgagatgaagcccagattaacttttctgtgaatatggcctgtgaactgttgctggaattaaattggagtctagcacaaattaagttaatctactctgtattaatcattgggaaaaagaaaagcttcatttgaaaacagtctttttccttcacccacactaatagaaaaaggagagtaatttgttcatactgtattccacgtgggatgaaaagcatgttttgctctttgtttctgggccggtgtgatccgtgtgttggtgcctgagctggaggaaggagcttcttgcagggaaacagccactggggccacattgagggccagttgggaccttcctttccagtcacactctgtgtcctcacgggccccttcacagtctagataaggagcctagtttcattctcanagaa

SEQ ID NO: 12551 - DNA, 413 bp, Homo sapiens
  misc_feature 413: n = A,T,C or G
ggcacgagctgccctcgttccgcgccattcaggacgactgccaggtcatcacggcccgcctggcccagcagctgcggcagcgctttatggagggcggctcaggcgccccggagcaggcagagtgcgtggagctgctgctggccctgggcgagcctgcggaggagctgtgcgaggagttcctggcgcacgcccgcggccggctggagaaggagctgagaaacctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagn

SEQ ID NO: 12552 - DNA, 402 bp, Homo sapiens
cgttgctgtcgcattccacgggttttctgtgcagttatgggagcatgacaggggaggctccaaaatggaggttgagctgggtcttatagaataaataagtttgctgggaccagagacatgggtgtgcacagactcagaggcaagaaagttgtatgatgagggtgggggggtgtgcggatagaggttgaagcccaaaagccctgaaagttcagtgttgaggctcagggtggggaccctagagaggcaaaagatgcccagccagatggaattggtggtgtgaattgccaggactggaaagagcccaaatgggggctgcagcatgggccttggttgaagcctctaatcctgtaagggctgctttggcccaagaggccttagaaacccggtgtaagccttaatcgg

SEQ ID NO: 12553 - DNA, 418 bp, Homo sapiens
ggcacgaggttggaaagaagaaaagaattatagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaa

SEQ ID NO: 12554 - DNA, 409 bp, Homo sapiens
  misc_feature 383: n = A,T,C or G
cgttgctgtcggacgagacagcgagaggaacagcgtccggggcgacccccagtccaccgcgggggcctggcgcgcttggggcaaaggccctaggagaccccttctggccacaaaatcgagtatgacagaaaagggccagcgggggcgctttccttccagggccacttgccggaatgtaagagggacggagagacgtccggaaaaggctgccacgctcggagcgctgcgccaggccaggcacctaggccaggggagcggagacctcgtgggagcgggcagggggacctttcccctctcccgggcttccacccaggcgcctccccgctgtgaacgccgccgcccaggtgaaggggaaaccggccacgtttccggacctcggcggngcacacggtctccggttttcaccggg

SEQ ID NO: 12555 - DNA, 403 bp, Homo sapiens
cgttgctgtcgggcaatctccatggctttttggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtagccgggctgagaggccctgtgctgcgcctgcgggagccgctgggtgtgctggctgtggtgtgtccggacgagtggcccctgcttgccttcgtgtccctgctggc

SEQ ID NO: 12556 - DNA, 389 bp, Homo sapiens
  misc_feature 44, 305: n = A,T,C or G
cgttgctgtcggaagactagcatccttttggctccctggttggntgtgaaatacacacacgcacacacacacacacacacacgctcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaatcttggagtgggaggagagggggtggggtgggagagaatataagatgtatcttangctaagtggaatctatttataaagcgagagactctcatctatttttatgagaggagagggtttttaatctaggggaggcagccg

SEQ ID NO: 12557 - DNA, 396 bp, Homo sapiens
tacggctgcgagaagacgacagaagggggctcatgcctgtaatcccagcactttgggaggtggaaaacctgaggtccggagttcaagaccaacctggccaacattgctaaaccctatctctaccaaaaaatacaaaaattacccaggtgtcggtggtgtgtgcctgtaatcccagctagctacctcgggaggctgaggcacaagaatcacttgaacccgggaggcggaggttgcagtgagccaagatcatactgctgcactccagtctggtgacagagaacgattttctttggaaatatatattaaatactaaacaaggctgggactgatcttcattgtcattcctggctgcccatattactcaaggctgacgattaaccatttgttttaatacat

SEQ ID NO: 12558 - DNA, 393 bp, Homo sapiens
cgtggctgtcggagagcttggatttctattgaccttatactggtaccaactgtaccagctaatcatgtgtcccttgagtctgtcacgtgacctttgctttcctctgaaaatccttttactcagtaggccagttacacccatttataataattaataaaatcactatgtttgacttcaagcttttcccttaggtttatgattttttaaaagtattatccttttttggcatttaggaaggcatctatttttgttttaatggttactttgatgtaatactttttttttctgctcttgagcattgactcccgctgtgagtgataaatcagacatttaccttttcttccccctcctctctttattttccatcatataacttgaaagattatccttttt

SEQ ID NO: 12559 - DNA, 393 bp, Homo sapiens
ggcacgagactcacttctaatagaatctagtgtcataaattatacaaaactagaagcagcagattgtaggagaatgggggaggtgtgggagatttttatgtggaatgacatctgtcaggaaaagagaataaaaatttcctaaaagactgtcatattaagcccctttaccttttccttgtgccacctcattacatagatagatcatcattgtatcagaaaaatgttaatttatattattaatgatcactttgtaagtatgttttttcaaccatcctaaacacattttcagaaatgtttttctttaaagggtgataagttttaaaaatttttttataaagagttaggcttgtgttattacttaatgaggagaacctcattccctattaatgttaa

SEQ ID NO: 12560 - DNA, 384 bp, Homo sapiens
ggcacgaggagagttatagccttattttttttacattcttaggaatttatgaaaatgtatgaagtttgatgaatattacatagaagtattacaagcttatgagcgcctagaaatcaaatcatatttttgtcttttgaattcattaaaccttaaaattattggagttctgatttagtgcttcagaactattttggtatttgtgtatcttgttttggacagggttagcatgtatttgacaccctttagccctttaagggatattttgtctgtgaagattttctttcttttttttttttttttggaaaaaaagtcttactttgttccccagtttggagtgaatgggcttgacccaaaatcgtttcccatgctaaagaaattttctgg

SEQ ID NO: 12561 - DNA, 392 bp, Homo sapiens
  misc_feature 356: n = A,T,C or G
cttaaaaaaatatatagaaagaaagaaaatgcttttcaattttgggcccagccatttttacttaaaggtaatatccatatattcctattagactcaccctttccctatagctaaaattaaattcttagagaagaaacttacatcagtttaatgaatacacagcctgtctataccaatttcctcttctagagtcactacattcaaagcttggtgggtctcaatagggatttactgctgactgggtaatctgggttcctgtgtgcagtgacatcaagcaagagatttaccaagagaagtggatgccatgacaatgcatgtaaccatggtgtgaccggcctccctgacatggctctcanaagctttccctctgtgaaaacagaagcctgtttgca

SEQ ID NO: 12562 - DNA, 391 bp, Homo sapiens
ggcacgagtgataatatagtaagccaaaattggtcagtgtaggataagcaagatggaataagtgcaagtgtagtaattttctcatctttcattatgacaagtcatcacttactatataagaaattttaaaatacggtaaaatagtacataaaattacaaagataaccaccaaaagatcctagaatagactataaacctttggaactatcagaataaaaacacacaataaagaaaacaaataccatatgggaaaataattgtgtgtatttgtgtctttaatttgtttgtgagtgtctttaatttatgtgtgtataacattataaaggaaaaatataactaaacataatccgtatgattaaatatttctcctatatccagaaatgtaaattta

SEQ ID NO: 12563 - DNA, 389 bp, Homo sapiens
  misc_feature 389: n = A,T,C or G
ggcacgaggatacccccagcactcatatggtttctataccaacagttattgatattacaggagagtatgtaattagtaatgctaaaaaaatgcactttattatcctatggacttttccaaatgccatagctaccaatagagtcatttgcattacacatactaatagtattatttcttctgaggagatcctagctgtagctacagatatagaaaattctaccattgaagatcttgtataaccttacttcagccactgaaataatttaaattataaatattacatgtgggtttgactatcacagaaaataaaatgattatagatcctaaaaacataaattcctgaactttgcaaccattaattcataggtactactaatactcttactacn

SEQ ID NO: 12564 - DNA, 387 bp, Homo sapiens
ggcacgagcccatctctactaattatacaaaattagccgggcatggtggtgcatgactgtaatcccagttacgcgggaggctgaggcaggaaaatcgtttgaacccaggaggcggaggttgcagtgagccgagatcgccatatatatatattcatatatatgtatatatacacacatatatattcatatatgtatatatacacacatatattcatatatatttatatatacctatattcatatgttttcataatatacgaatatacctatatgttcatatatgtatatataatattcatatatgcatatatgtatatataatattcatatatgcatatatgcatatatacctatatatgcgcacatacatattcctatatgcatatg

SEQ ID NO: 12565 - DNA, 386 bp, Homo sapiens
cgttgctgtcggtgaactgtgatcatccagattttggcagcttataggttcttagttgatataaaaaagaatgccaaagcatgggtaaaaatacatgacataactatgtaaacaagtagaagaacttagggttcttctaagtagggtcagagccaagatgagctagcaaaaaaccttgttacttttttttttttgaaagggagtttggtttggccacccaagctggagggcaggggagggatttcggttaattgaaacctccacctctggggttaaagcaattttggggcctaaccctcccaggaagctggaataacgggggcatgccaccaccccgggttaattttggtttttttagcaaagacgggatttcaccatgtgggcca

SEQ ID NO: 12566 - DNA, 396 bp, Homo sapiens
ggcacgagaaaatatataacaaccaaagtgttgtattaagataactcttaacctctgttagtagtaacatgtttcattacagtatcaaatatataggtaaaatttggtgacatgaaaacacttgtggtctgtatgtctatcaaacattcatgaaaaatttgaagactatcaatttggtacctacaaaagatgatgcggtagccatggaaatgcatcacccagatctcctcctgtgagaagcagagttgacagaaccctagctgctaccccatgggatctaccactgtattcctgctgttcccagccaatgagtgagaatggcaggactattaacactgacccagtcccctgatgggcaacattggctcaaggatttcccattagattgcccagaat

SEQ ID NO: 12567 - DNA, 387 bp, Homo sapiens
gacttgctgttcttaacctaccaaagcaggcatgtagacgcacatgtgttttacacacgtcattggaggaaggctggcaataccagcttggttgcaaggaaagaggcaattgagaggactccttctcacactgcagtaatttgctgagtgaccttgaacaaggatcttaatgcatcaaagtctgtttcctcaaccccaaaatgaagggattggaccagatgccctcaaggttcctcaagggtcagctgtcacagttctccaaagtgagttttcaggcacacatagagttagccagtgtcgcctcaccaggacattctgttttctgaacattgggcctctgtggtttgtcacatacacccacgggactgggctcataactacctgaag

SEQ ID NO: 12568 - DNA, 398 bp, Homo sapiens
cctcaccccagctgcctgctgcttctgacggatcttggtgctcaggctgcctggctctccgagtgaggacgcagcctccatatttggtgcactcaggcatggctgggacaagccagctgccccagggttcttcccctggtgattctcgcctgctttctcatctcaggggaggcagtggcacctccctctccctgctgacatgaagagagctatgatatgccactgctgccaactcatcctctgcccccacctcgaaacccacagtccccagtggagggccactactcatccccattggtttcccaggggaggggtgttgtctggaagggcaggttcagatgcagccttccagatttagaggcactgggaggacagtggctgagtggaggcgcccacac

SEQ ID NO: 12569 - DNA, 387 bp, Homo sapiens
cgttgctgtcggtttgatgatggtgatgatgatgatggcagtcatgaactgaggagtgagattcatgccactctacatttgaggttctttctccagccatgtaactctggcaatggagtagaatagggaggagggggaaggtgagaacgtaggtagaaagagctgttgggcaactgtagcaataaaacagaaaagagatgaatgtttgcacataggcaggggcagcaggaatgcagaagggcaggtgtcagagagcgtccacgtggtaggacccacaggaccaggtggctgaatgcagaggctgaggctgagcagggcggccagtatggctcctgtgttctgatggcgtgtagtggcgtgaccagccagggtctggaagaaagagga

SEQ ID NO: 12570 - DNA, 400 bp, Homo sapiens
ggcacgagcatacttttacttaaataattattataaagacctcaaaggaaatgtatcaggtgctgtaagataatttaacaggtggttttgcttagtttgaggggaaaaactttaggggcatgaggaattagaaagagctagtgaaaagaaagtgtagcagccaaagagttaggtgaagaaacaaatctgtggtacattaagaaaccaagaaggaggaatttccagagcatatttgtggtcatgaaagtcaaatgctgccaagatggaaaggaagatgggagttgagactggtttgctacatatggtgatgaaaactgttctagaaaagtttcaagttaataggaccaaacacagcttacaggtgattaaaaaatgagaaggtggtgaaatcctaagtact

SEQ ID NO: 12571 - DNA, 389 bp, Homo sapiens
ggcacgaggcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacagctggtgggcgtgatcactgtgcccgttttacagacaaggccactgagctctgagaggttatgtgacttgcccaaggtcaccccgcctgcaggtctcaaaggtgggatttgagcgagggtccggctgactgcagagcctgtgtgtgagtccccgtgtgacactctgcacttggacccttgccccgggga

SEQ ID NO: 12572 - DNA, 397 bp, Homo sapiens
ggcacgagcggcctccatgctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgtcggcctcccacgccggaggcccagagcgaagaggagagatccgatgaggagccggaggccaaag

SEQ ID NO: 12573 - DNA, 398 bp, Homo sapiens
  misc_feature 398: n = A,T,C or G
ggcacgagaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcn

SEQ ID NO: 12574 - DNA, 386 bp, Homo sapiens
cgttgctgtcgctccctcccaggtctgggctgcgcagtacctccccctgccttagagcaccccactatctctgtaaaggctctctctctcttttttttttttactaacccgagctaaaaccaattcctgttgataacaactaaacaacctcattaccggagaggactttcgtttactttttgccttttaggttccactttttttttgggaaaggggatttaatttgttccccagccccgacatcgactggtataattttgtttaagagcacccttgagcctcctagggaaacaacattccccggctgcaccctccaaagatttggggataacgggatacccccccccccccccacctatttttgtgtttttatgaaaaaagggcgc

SEQ ID NO: 12575 - DNA, 399 bp, Homo sapiens
ggcacgagcccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggattc

SEQ ID NO: 12576 - DNA, 395 bp, Homo sapiens
ggcacgaggaaaaaagagctgttgaatgttagatcatgaacatcagtatttatctgaggaacatcctgcggaggaatccctttccccatttattaaacacaaaattgccagtgtttcaagtagttctctgatcgatagaccaacaactgaaattaaatgcttttagtctcaagtgcccatttttattaaaatgtaattatcatgaacagaaaaagcaatacaaggcgtgtgttcttaataattctgccattctctttttgacatttaaaggaagagcctaggctggatgtcttgatcaataacgcagggatcttccagtgcccttacatgaagactgaagatgggtttgagatgcagttcggagtgaaccatctggggcactttctactcaccaa

SEQ ID NO: 12577 - DNA, 388 bp, Homo sapiens
cgttgctgtcgatcgggcaacccaaggacttcctcactggcatgtgcctcttcctgcagacgctgaggcaaaaacagcctgagcggctgtgctcatgccctgtccttgagggcaacgtgctggcggacccatttgcccgcatgcggccataactgcatcattggtcccaatgggagcctgggacctgtcgtgctggtcgaagatggtgtgtgtatccggcggtgcacgatgctgcgggatgcccgagatgcgctcccattactggcttgagtcctgcattgtgggctggcgctgccgcgtgagtcaaagagtactcatggagaacgtgacagagctgagtgaggacgtcataattaatgaggagctctacctcaacggagacagcgtg

SEQ ID NO: 12578 - DNA, 378 bp, Homo sapiens
  misc_feature 36, 37, 38: n = A,T,C or G
ggcaccaggagagagagaactagtctcgagagcagnnnttttttttttttttttttttttttttttttttttttttttggggggcccccaaaaatttttttttaaaaaaaaaattgggggggggcccccccttttttaaaaaaagggggttttaagggggggattttttccccaaaaaaaaggtggttttttttttccccgggggggtggggccccccccccaaaaaaaaaaatccccgggggaaacccccccccccccccccggggggggggccccccctttttttgggaaaaaacacccccccccccccccttttcctggggggggggggaatcctcctcggagagggggggggggggggcaacaaaaaaacaaaa

SEQ ID NO: 12579 - DNA, 382 bp, Homo sapiens
cgttgctgtcgattttccagttgttttgctatattctgcaaataaaaaccgtgtttccttttttcacttaaactttggtaggaaacaaactaaagcagacaaacatttcttgttatgtttgttgctttctttaatccaatggataaaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattg

SEQ ID NO: 12580 - DNA, 373 bp, Homo sapiens
cgttgctgtcgggaactttaaaaattatgtctgtagttaaataactaaatgtaagaaagcctttaatatagggtagagttattaaatagcacaattaaaaaaattttagaacttacaaatacaaaggattattattttctcaaaattattatctttattgctataatatttatttaattgagcttttttgttcaatgcacttttggaatttttctttggaaattactacatgatgctttggacagcttttaaatattttgtatatattcagtcccttagattttaaatatttctgtttcttcatcttttcctctgttacatgggtttccatgtaacctcttcatcatcttggttgtctttttcttctaatgct

SEQ ID NO: 12581 - DNA, 373 bp, Homo sapiens
tacggttgcgagaagacgacagaagggccttattttgaaatcagaataatggaaattattacaattaaaaagtcactagaaaaacagacctattgtacaaagattccagtcttacctttctcaagtctgcttactgatttttctcttatgtctctattctttccccttccctttgcccttcctttctcccttctgctctttgaccccaaactcatcttttcttcttagtttattaaataaaaaccaaactatattactatcaatatatttttactatatgcagttcatatagtctcgtgattggccaaagtctaatggttcccaataggtcctcaatctttaaggcccagtccaaaccttccacaatgaaggg

SEQ ID NO: 12582 - DNA, 378 bp, Homo sapiens
  misc_feature 378: n = A,T,C or G
tacggctgcgagaagacgacagaagggaaacctcgtctctactaaaaatacaaaaaaactagctgggcgtggtggcatgtgcctgtaatcccagctatttgggaggctgaggcagagaatttcttaaacctgggaggcggaggtttcagtgagccaagattgtgccactgcactccatcctgggggacagagcaagactccatctcaaaacaaaacaaaacaaaagatggcatagaatccttcttggaaccttgtgcagagggaagagtaaaaagacctccacacggcccactctgtccaccatctttgctccaaaagtccctaccctggaagtaccggcaccagaagccgtatcctcagggcactcaacgctgcctn

SEQ ID NO: 12583 - DNA, 378 bp, Homo sapiens
cgttgctgtcgattcagggatcactttggaacttgctggattatggtgatggtttttggatagtatgtgcttcattattttatttggggtagttacagtgttgtagttttttgttaacagctacacttttggtactattttccttttaaatttttggtgtctaagatttaccactaattactaatatatgcctttccaattcacttaaaaccttaataagtgaaatgttcaggtattgctagggtaaatgtgtcttttcctactattgagattttaaaaggctgtgattaagagagactttattaatttgatctgaaagaagtagaaacctctatgaaacaatttttattttcctttgcataataccttagaaatgtg

SEQ ID NO: 12584 - DNA, 373 bp, Homo sapiens
tacggctgcgagaatacgacagaagggatgagagtgaggatgacatgtgatcccatgcctccaagagcaaagccactgaggatggtgaagaagacgaattaagtgctggagaaaaggagcacgatagtgatgagagttatgatgactctgattagaccccagataaattgttgcctgcttctgtgtctctgccagcctgcgatcattttgtgttagagtttgaaatccgctgtttgcctttcttactggtaggatccttttttgcccctctttttttttttttttttttttttaaaagagggcttcctttgtcttcccaaggcgggggggggcggagaacatttgggtatccggaccctcctttccccaggta

SEQ ID NO: 12585 - DNA, 376 bp, Homo sapiens
ggcacgagggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatgggtctcaattggcttagcatcaaaacacctaaggagtg

SEQ ID NO: 12586 - DNA, 382 bp, Homo sapiens
cgttgctgtcgggcagctcagggaaggtcaggagatggggtgttcccagtcatgcccatggcatctctgcctcctcgggccccacctgcctcgccctgtggcctgagtcccttcagctgtgtgggcctccctgagtgccctgagtgaggtggcataaggggtgagaggccatggtgtctttggggctggtggtccgggtctggccatctgtcacctctcaggcgtgcaggcactaatccctccaagcctcagttggccacagtgagaaggggcctggtaacactgtcctggatgccaggttgttgtgaaggtcccggcttagcctctggcaggaaggaggtgctcaggaggtgggcacaggcagagggctggctgtgggggg

SEQ ID NO: 12587 - DNA, 371 bp, Homo sapiens
  misc_feature 371: n = A,T,C or G
tcgaattccgttgctgtcgcatttcacgggttttctgtgcagttatgggagcatgacaggggaggctccaaaatggaggttgagctgggtcttatagaataaataagtttgctgggaccagagacatgggtgtgcacagactcagaggcaagaaagttgtatgatgagggtgggggggtgtgcggatagaggttgaagcccaaaagccctgaaagttcagtgttgaggctcagggtggggaccctagagaggcaaaagatgcccagccagatggaattggtggtgtgaattgccaggactggaaagagcccagatgggggctgcagcatgggccttggttgaagcctctaatcctgtaagggctgctttgn

SEQ ID NO: 12588 - DNA, 378 bp, Homo sapiens
ggcacgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctagagcag

SEQ ID NO: 12589 - DNA, 373 bp, Homo sapiens
  misc_feature 373: n = A,T,C or G
ggcacgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggagcctggccctgcctctgggacagagtctgcccacttcctgcgggcgcactcccgctgcggccctggcctcccaccaccccatgtatctagtccccagccaaccccaccaggtcccgaagctaaggagccaggcctgggggtggacttcattcgtcacaatgcacgagctgccaagagagccccccggaggcattcctgctcactgcaggtcctggcacaagtgctan

SEQ ID NO: 12590 - DNA, 376 bp, Homo sapiens
  misc_feature 48: n = A,T,C or G
ttcgaattccgttgctgtcgggcttatctgatgtatctccgggtgcangaagcggtggagtccatggtgaagagtgtggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgg

SEQ ID NO: 12591 - DNA, 370 bp, Homo sapiens
tacggctgcgagaagaccacagaagggggggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccg

SEQ ID NO: 12592 - DNA, 355 bp, Homo sapiens
tacggctgcgagaagacaacagaagggtttggatcatttttttctgaaagtgggcaattatttcaaaacaaaatggtttcaatagagcgccatgatatttttctgacattttctttgaaatagttgatactccttctgcaaattttgttgacagtgcttctaggttccaaaaagaagggtaacgccactacagcacctttgccatctgaccagcagcaattctaagatgtcattgattctaagatgcatctcaattcccaagatgttaaaatgaacaaaatacatcacttaggatcataaacacattttagttggaatagacacatttgaagaccagatttgaacaatgatcctg

SEQ ID NO: 12593 - DNA, 361 bp, Homo sapiens
gcctacggctgctagaagacgacagaagggatttaaaagaaaagcatataacataaaataaaaaagaagattcaatacgtaaccataggagatacaaacattcaaagagcaggttaaggaaagaagcctgagaaggaccgttcagagagacacgataaaagaaaacccagaagagaagtgtaaatctgacgtcacaagaggaatgcactttagaaaataggagggctcaatattaccttacagagagaccaaataagactaaattgcacaaagttcttgaggaagtgaagactcagattatagactatatttttgagaatattgggtatgaaaaagggtgacttgcgcactcaccagtttt

SEQ ID NO: 12594 - DNA, 356 bp, Homo sapiens
tatccgctgcgagaagacgacagaagggtacagtttacacttttttcttaaaatcatgaaagcgggtttctatcttaagcatatattgtgactactattaacagactgatttgtgtagatattaaatgctttaagctattttaccttttcaagaagttgtgtttttttttctccaagtcataaccaattcctgcaaagaggcttcccatgacttgtgattataaagtagacaaccagggaattgcgcgagacacatttttatttaattcttttttttacggaatgcccctgagccggaatagattaaaagcggttcctttcctttttcacatttaaaacaggatggtttctgggtt

SEQ ID NO: 12595 - DNA, 366 bp, Homo sapiens
cgttgctgtcgaaataatagagctaaataatgtcctgtcacttccattataagaaatctggattcatatctaagtgtatatgtataatactgtacagttaagagttcagaacaagtgggaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaattttt

SEQ ID NO: 12596 - DNA, 367 bp, Homo sapiens
ggcacgagccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaa

SEQ ID NO: 12597 - DNA, 349 bp, Homo sapiens
tacggctgcgagaagactacagaagggatcaactttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactacattactttcactt

SEQ ID NO: 12598 - DNA, 337 bp, Homo sapiens
gctactgttgttagaagaccacagaaggggtctcaggtgtgatgcatttctagcaagaccaggctggaatggagagggggtaaggacatccttcattcatgaggggaacaaagagtgtttcccatccccccatcccctcctcatcaaaaacttgaaaataatgcataaaataaacaatccatcaatcatggggaaatttgaatcacatgtagcataatgcagggcatatctgtaaaagtatcagtagaggatactacaaatcccccaaagcccaccatagccagagtgatcgtcttaaaccactaataggattacttcctgacccgcttcaagcttt

SEQ ID NO: 12599 - DNA, 470 bp, Homo sapiens
  misc_feature 11, 12: n = A,T,C or G
gttcttttttnnaatcccatcgattcgaattcggcacgaggtgcaacgctggcaagtctcaaagtcgccacagaaacatgcccctgattcagtgcctctgcttagctgtaacatgttaatcagaactacctggcatcttcctgaacaagactttcaataggggccagtatgcttcgcttcatccagaagttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaat

SEQ ID NO: 12600 - DNA, 420 bp, Homo sapiens
  misc_feature 24: n = A,T,C or G
cgcacgagagagaaaacaggtggngagggtctgattaaaaactatgcacaagtaggtttaacaaaaatactcatgaaaatgttcggaaactgaaatttaaacaactgtaatattaaggaaaccagaatcaataaatcactgtcttgccagcacagctacagagtaacatgattcaggggaggaaaagttccttacagttacttttataattcttttttttttttcctcttaggttaaaaactctaacaaatttaaactttatctttttaaacttatttgaacatactttagaatattgaacctctaaacccaaatgtttatagataccctcttatccataaacaaaaccctgctaagccatggctctattttttttttggcttatagaggccggtaacagtttttttgcaccaatatatg

SEQ ID NO: 12601 - DNA, 440 bp, Homo sapiens
gcaggagcccatcgagctgcttgtttgggccgaagcggcctacggctgcgagaagacgacagaaggatcctgaatgtgtgtgctactttccaccttcaccaccaccaccctagtccaagcctccacatcactctctgctacgatcctccagcctctcccatgatggctttttttctgtcgctcagctcccagttctctgctcttcacactaatcataacatatcatttctacctccatgcctctgtgtgatctcttccccaagtctagattgctcatacccctggtccacacacagctcttcttgacactcagatcctcaacagtgactttcctgaccacccaaactaataaagatactagaaacttttctcattctccccccaccacctttttttgagacgcttttttggggtctcactctgttgcccaggctggtgtg

SEQ ID NO: 12602 - DNA, 427 bp, Homo sapiens
  misc_feature 15, 17, 21: n = A,T,C or G
ggcacggataatcgntntttnttaggatcccatcgcttcgaattccgttgctgtcgctcgatccaaatctcgggagatacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttatagctacagattattggtttgaatctttcgcatacggtgctatgttcacatttatgtgcgggtgcacaacatttttctgtgattatatgggtaactatgactgaatatacttatgaagccgagcacgacattgtaaccaatatgtgtagaggttattgctttt

SEQ ID NO: 12603 - DNA, 468 bp, Homo sapiens
  misc_feature 17, 19, 22, 23, 24, 150: n = A,T,C or G
gcaacagagatgtaccngnttnnncgaagatcccagcgattcgttatttcgttgctgtcgggaaaactgtaagaagtttaccccactctgattattccaccattgccagagaagtttatagtaaaaggaattttggaacgctttaacgangacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatat

SEQ ID NO: 12604 - DNA, 419 bp, Homo sapiens
ccttggagttattttccaccaaatgtgacaaaattcaattcatttgcaattcatggatcaaaagataaacgaagttatgaagctctttatcctgtacctcagcatgaactgcagcaaggacaaaaacctgatttccattgcctagaatacttcaagtctttcaattttaacacactgcttggagaagagtggaaacaaccggaatcagacctgtggctaatagagaaatgtgatatataggagtaatagataaccataccgatcattttttcctctataccttttaagataaacaaaaaataaatatcaattttttaagatgtcatgcatacatttcaacaacaaatatcttcatagaagtcactgaaaatatagtatctgtggcaaattgtatatgattaacaagaaaatatatgatt

SEQ ID NO: 12605 - DNA, 428 bp, Homo sapiens
ctcagaagagcttacggcattggggatccccttcttgagtcgtggggctggcttcttcatctgggttgacttgagaaagtacctgctcaagggcacctttgaggaggaaatgctgctctggcgccgctttttggacaacaaggtgctgctgtcctttggcaaggccttcgagtgtaaagagcctggttggtttcgctttgtcttctcagaccaagtccaccggctttgcctggggatgcagagggtccagcaggtgcttgcaggcaaatcccaagtggcagaagacccccgtccctctcatagccaggagccaagtgaccaacgcaggtgagctggtcattgtctcgtggccagagggcccagcagccactgtggacctggggcgttctggcgctgcacaagactgactgtggatgtgccatttgcca

SEQ ID NO: 12606 - DNA, 426 bp, Homo sapiens
cgttgctgtcgggatctctgaatacccatgccccctccaccatggccagccggggtgggggccggggtcgtggccggggccagttgaccttcaacgcggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacgga

SEQ ID NO: 12607 - DNA, 397 bp, Homo sapiens
cgttgctgtcggtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggcg

SEQ ID NO: 12608 - DNA, 391 bp, Homo sapiens
gtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgcttttttttttcttttggacccatgggtattataataaaaagcattttgtacctgaggggccctaatggaaaaaagtgctgctcaaaggaagtatgaagttatatattaaattttttaattttaatttttaatttttttgctgtgaagg

SEQ ID NO: 12609 - DNA, 416 bp, Homo sapiens
ggcaccaggtgtgtgtgtgtgtgtgtgtgtgtgtataaaaccaaaatgtgtgacacaataaatgctggcacagctctgatttcttttaaaaagaaaattaaaataggagttctggttctaattattagctattagctacttctgaaattcagaaagtaccataattaggctaaagggttatataatatgtagtgaatcttcaatgtaataccatatactctgctatttttctttttctaattagttgtgttacattagtaaccaggccatgccaacacaagtattccagtccatgtgatgatatttctcaatgtaaattaataaactgaaattctaatggtaaacattttttcataaatgtagttagagacccctctgaaagacaaagcagcttttgccatgctgaccaaattaga

SEQ ID NO: 12610 - DNA, 412 bp, Homo sapiens
ggcacgagggctagagtaagatgataatataggtgagggattgtagggataagaaggaaagaggagcaggggaggaaagaaccctgaggaaccaaatcatattaggagacgaggtgaaaatggtactgagggagtctgtaggaagcttagcaggaaaatggtgtataagaacttagggaggagagtttcctgaaggaggggcagtaattgcagtatcaaatgctacagagaggagaggcatgatgagaccttacaataagcctttcattgtatttgctctttgggggccagtgagaagggaaaactgagggtggtggaggctggaagctagatcatgatgagctaaggagtgagttggagttgagctatttagactagttagagctttgatttaaatatttggtagtcatgg

SEQ ID NO: 12611 - DNA, 368 bp, Homo sapiens
tacggctgcgagaagacgacagaagggaggaaaggtcagtcagcctgcacttgcaatatcagaatcagcttgctcctagtctagtgacaatccttctcactgggagatctgggctgcctttctgagggcacactgcaaaggccaccttctcatctccctctggcctgcctgtcagctctcagagagctgaatgggccctgccaccaacagtctgttgtgcctttctgactgtgacacgaatgcactaccacgcaaagaagggctccgtgtcacgagcgctcctagctggctctccgtctcgggtgtcccaccacgggaacttgagaagaagctgaacctctcaaggcttccggtactgctctttaaac

SEQ ID NO: 12612 - DNA, 388 bp, Homo sapiens
  misc_feature 95: n = A,T,C or G
gtgaaaagtgctcatctgtgaactctatagcaaattatattttagaaaatactttgtgaggccgggcatggtggcagagcgagactccgtctcanaaaaaaagaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttt

SEQ ID NO: 12613 - DNA, 377 bp, Homo sapiens
tacggctgcgagaagacgacagaagggatgaacagcagaagagaattattctacaataagaaatcaattggtctctcaactgagaatcactagcaagaaactggtaaaccaaccaacaagtgggtaaaggaaatgtgaaattatataactaaataaatacacacaaacacacacacacacacacacacacacacacgcacacacacaagcacacaccatagaatactactcaaccacacaaaggaaggaaataatagcatttacatttgcagcaacctggatggagttggagatcattattctaagtgaagtaactcaggagtggaaaaccacatctcgtatgttctcacttataagtgggagctaagctataagga

SEQ ID NO: 12614 - DNA, 380 bp, Homo sapiens
ggcacgagagacagtctccccctcagatgccatgctcccactgtaccaccatgtactgcttcctgagatctctgcttccttcagtcgacccagctgacacctgtttccttcctaactccaactaattaattccagctaatggaattgactggaattagtgacattaatatttactgagcattccccatgtgtcatcagagctgtgctaaatgctttacaagaataattacctgccataaagcaaccctatgacataggtgctactatgcccattttgtagatgagacaggttcaggggagttagtatcaccttcaagtcatacagtggctaacaatctgtggtctcgctgaatgctgggcgcctgctctgctaagtctac

SEQ ID NO: 12615 - DNA, 399 bp, Homo sapiens
  misc_feature 399: n = A,T,C or G
atcggcacgagattgattgctgttgcggaaacttgaggttacttacagaatgaagcacattttttacatacagtacaaatgagtgtgtgctttttaaatggatttaaaattcaaatgcaaatctgcagtttaatctcccaagtgctgatttttctatgtataaagtaggagagtgcaacagcgtatcacaatgaggggctagggagaacgtgtatgtgacctctagtacctggcatgtaacagacactcagtattacactcctgctatttctccagagcaggtgaaacagacggccaggaagcacacgaagagacactcagcatcactgcttgttaaggaaggtgcaaatcaaaaccacagtgagacgccacttcacacctacaagttcggctagatan

SEQ ID NO: 12616 - DNA, 408 bp, Homo sapiens
cgttgctgtcgctggagaagcagccttatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgcagcctctgcctcctgggttcaag

SEQ ID NO: 12617 - DNA, 406 bp, Homo sapiens
ggcacgaggcaagcatttacagttttaaatttcccagtcagaataaattcttattgagggcaatacctagcctgtcttcatcaaactcataggtgaatctttgtcaaacctataggagagagatgcaggccatagagatggtcttgctgaaggtcttatagctaaattagttcagatccaggaaccagattctggaactgattgcacctatattatgttgtgtgtcagacactcccaggacctgtttggtaataattaggacagctgacatacttgttgctaattttgagatctgggcaacaactgtgtaggctgttctttcaacctctttcttcttacttctttacttttccttcacagaggagaaagccacccctggggtatagccaccgctccaattctgact

SEQ ID NO: 12618 - DNA, 374 bp, Homo sapiens
tacggctgcgagaagacaacagaagggctctcaaactaatcaatcaaacaaacaaacaaacaaacaaaaaagacactttctagaagagatagtaacgatatctacctcatgaattaaattacttggtgtgaattaagtgcttactagggattaccacatcattaactattattagtaatcttacagtcattattatcaaatatgtctcaaaattaatgcaacctgtcagtctagtcacatcaaaagtgccacagtgctttttggaaattaaacaaaacaattgcttaaatgtgcatcatacattcagagtaattcttattcaagcaagctggttttatattcatgacaagcattttcaattttaatatgtttgt

SEQ ID NO: 12619 - DNA, 406 bp, Homo sapiens
  misc_feature 40, 41, 42: n = A,T,C or G
ggcacgaggagagagagagagaactagtctcgagagcagnnntttttttttttttttttttttttttttttttttttttgggccccccccccccttttttttttttttaaaagtcccccccaaaaccccccgggggggggggggaaaaaaaacccccccttttaaggggggggggaaaaaaaaagttttttgggaaaaaaaaaaaattttttttattttggggggcccccccccccccccccgggggggggggggggccccccccccccctaaaacccccccccccgtgggtttttggggggcccccccccgggggcttaaaaaggggggggggggggggccccaaattttcccaaagggggggctttatggcccccccatccccaaaatgtgggggccggggggg

SEQ ID NO: 12620 - DNA, 395 bp, Homo sapiens
ggcacgagatggtctcaatctcctgaactcatgatccacctgcctcagcctcccatagtgctgggattacaggcaattagaaggaccatgtgactaatctatatcattttcttagagataaagctgagatccaggaggctatgctaaagagacataggtaactgtggccaagctacagccagattccatgttttaagactctcagttctatttttctgggtggggaaggggaatgaaattataactttgcaactatcctcacttcttcctacctacccaaatagaaagtagttcacgttcacaggacagtggtctcatggacttgtttcttttttctttcaaatgaaatcctttaagaaatctaaaaacaaatgagcacagatgctctggctcaa

SEQ ID NO: 12621 - DNA, 394 bp, Homo sapiens
tcacaatccaatatctgtggaattcattgtgtatgtttgtgtatttgtgtgtaggtgtgtatgtgtgtgtgtgatacatacatacatcacgtatcacaagacattgaccttatatattatgcactgtgatgtttttccgtctttaattttaaaaaacatactgatcacaaccacaatttggaaaatgttgctccataccatcccataccaacactcaccacctgcaaataatagcattactaggagctgcagtcacaatgaataaatcaacaattcgctacaagatctaggattatttgtgtattttgttgagagtgcgagcgcgttggcgtgtatctaataccattgtatctcattgttgagactttgttacaaatagggtttctggtttctt

SEQ ID NO: 12622 - DNA, 376 bp, Homo sapiens
tacggctgcgagaagacgacagaagggattatcctacttattatttatgttttacctcctgtgtccaacacacacacacacacacacacacacacacacacacacacaccccttagaatggggctccttaagagcagggactttatgggtcttatggagcaagactttatgggtccctgctcttatgcagggcctgttcacctgcacctccagaacctggaacagtgttaggcacaaaatatctgattaataaatttgcgctgaaagagagaatactccaaaaggttctcgtatgagtgaagtgagattattatctataaagaattttgtggaggcatggcaccaaataagcaccacacacacagtatttccagta

SEQ ID NO: 12623 - DNA, 407 bp, Homo sapiens
ggcacgaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatac

SEQ ID NO: 12624 - DNA, 389 bp, Homo sapiens
ctccagcctgggctcaaaaaagaaaaataaattaagggcccgttctttctcaaagcctttgggggcctccgggggccctcagaaaaccataaaggggcctttgaaaaactggggcctcctgggaacctttggaaaaaaaagtaaggggtcctttaaaggggatcctgttttgaaaaaatcgcccacttcggggcccccactttgaaaaagggggccgtgggttttccttacagggctccaaaccaatttttttttccctaagtttttttttgggcctcggcatttaatattccaccggggttttccaaggcggggttaaaaaccacccaaacctgcccagggccaggggctcccccctgaatccccaaaactttggggggctaaaacgg

SEQ ID NO: 12625 - DNA, 376 bp, Homo sapiens
tacggctgctagaagacgacagaagggcatttagaatggggaatattgttgcagccaactttgaaaaatagcttctgccacagacactctataagaagtaggttctgtgaggatgggatcttcttatggagtgttagtcatcaatggagtggaaagaatgcagtcaaatctgacacctgagactgtatagtagtgaggctgattccttaaaaatcacaccagaactcggccaggagtggtggctctcacctgtaatcctagcactttgggaggccaaggtgggcagattgcctgagctcaggagttcgagaccagcctgggcaacacggtgaaaccccgtctctactaaaatacaaaaaaaaaaaaaattagccgg

SEQ ID NO: 12626 - DNA, 375 bp, Homo sapiens
tactgctgcgagaagacgacagaagggtatgtcaaatcctactttaaatatgaaagtaatcaggatcagagaaattacatgccagaaattcacaggatttataggtacagcaaaataggtcagaaatctatacactccagaccgagaatatatcccgaagtcagcagtttatatgaggagtcaactggaaatcattgcaagtaaagaagagctagattaatcgctatccttaaagaataaactaggcagaaacattagaacagctgctttcaaatgttttcagaactaggtataatgggggaaagaagctcaggtattttagaggtaatactctttttttattcctattcttatttaagagtaattaacagcgag

SEQ ID NO: 12627 - DNA, 413 bp, Homo sapiens
ctcctacgtctcctatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaac

SEQ ID NO: 12628 - DNA, 395 bp, Homo sapiens
ggcacgagacgtcattggaatggtggttttgtttaagcatttctggctttccatcatggttcatactgaaagtactgtagatgctagctaacctctgccctttttaagaataaaccttttttttaaacttaagaactaaagctgagattctcctattctgttgttgaggggcttcctgcatgcccgcccattttatcacagcaatttgagaagttttctttttggtttctgacaacaagcatttggggagaaagccaggcataaattagttacgatagttggggtttaatgtttctccagtgaaaatttggacttttctttttcccttatagaatgcataattaaaacagactattattttgaaatgaaatattgaatattaacaaaaataaaat

SEQ ID NO: 12629 - DNA, 383 bp, Homo sapiens
ggcacgaggcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgt

SEQ ID NO: 12630 - DNA, 386 bp, Homo sapiens
cgttgctgtcgggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactggttttctcatctatgttatgaagataataattccggccctaaccgtagtatgcttgcgagaatccaacaatatgatgtttctgaa

SEQ ID NO: 12631 - DNA, 382 bp, Homo sapiens
tagggaccagcgtagtccctacctttttttttcatgagacaagcgaagaccacagaggaggtgtggcttcatcaaaaacccactgagaacgagtgttagaatcaggctaggacacattggactcctcctccagggctctctgacatccaaggccctttgaaatctctctccacctgcgaacagatttctagacttctgatggaggtgatctgagatgaacaggctctaaaagcagcctctgcgagcctcttagagcagccgggacctgctggagaacagaacatggcctatgagcgcaacagccaagtgttcagcaccacggacagcttctctggcctattgctggggaggccacaggtggggaggctggttgtccaacacg

SEQ ID NO: 12632 - DNA, 409 bp, Homo sapiens
ggcacgaggagagagagagagaactagtctcgagagcagctttttttttttttttttttggggggggaaattttaaaatcaaaaggggggggggggccacccttttaattgccgggccgggggccctcttattttattattgcctgaaaggttgcttgaacccaggttttcccccatcccttaggagggatcccccccctccctgaaagggggggccccacccctaaaggggggggggggggggggaaacaaaaccttgtcgttgcagcccctgtgggttttcacctcacttggggaaccccataaaaggggccgggttaacaaaccctggttaaaggacatttaagaatggaaaagggggttggccaaaaaaaacccaatattttctcctgtggcgttcacccccccc

SEQ ID NO: 12633 - DNA, 408 bp, Homo sapiens
ggcacgagctgccctcgttccgcgccatttaggacgactgccaggtcatcacggcccgcctggcccaacagctgcggcagcgctttagggagggcggctcatgcgccccggagcaggcaaagtgcgtggagctgctgctggccctgggcgagcctgcggaggagctgtgcgaggagtttctggcgcacgcccgcggccggttggagaaggagctgagaaacctggcctggccgagttgctggccaatgtggccagctccatcctgagccacattaaggcctctctggcaggagtgcaccttttcaccgccaaagaggtgtccttctccaacaagccctactttcggggtgagatctgcagtcagggtgtgcgtgagggcctcatcgtgggcttcgtacactctatgtg

SEQ ID NO: 12634 - DNA, 377 bp, Homo sapiens
tacggctgcgagaagacgacagaagggctaaggtctgtattgccagtagtactgaattgaggtcttaaattccacaagcgtaattacacaactatgtgataaactgcaatatttatccattcattaaactgtaaactctttgcagtctcaccacagtttctcttactaggatctagaaatatttcctattgtaggctggttgcagtggctcacgcctgtaatcccaacactttgggaggctgagaagggtggatcacgtgaggccaggagtttgagagcagcctgtacaacgtggtgaaaccctgtctctactaaaaataaaaaaattggccaggtgtggtaacacacacctgtaatcccagctacctgggggctga

SEQ ID NO: 12635 - DNA, 388 bp, Homo sapiens
ggcacgagggcacatggtagcgggtcagcgaaaagcccagtgctggaccgtgggacaaaatgggaacagagcagctagcactgtggagatgagaaggggctgagattagaccgagggaaggagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcg

SEQ ID NO: 12636 - DNA, 396 bp, Homo sapiens
ggcacgagggggaactggggtccggaggacgccccacgcctcttggccagggcctccctgatcatgctcccgtggccactacccctggcctcctcggccctcaccttgctcttcggggccctcacttccctgttcctctggtactgctaccgcctgggctcccaagacatgcaggccctatgggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccacgccctgggagaggc

SEQ ID NO: 12637 - DNA, 386 bp, Homo sapiens
cgttgctgtcgagcgtgggccgcagcaccaccagggccgaggtggacctcgtcgtgcagggcctgaagcaggccgtggcgcagctggaggaccaggcctagcactggggccgccttccccaccccgtttctgggaagcccgtggcagggcacagggttgtccctccagttccctcctgagggctgtgccaggatgactgtctcatgccccctctgcattttgtcctggagtgccagcgagtgtgcacccccagtttccttccctggaaccctgcagagctcacagggcccaggacaccaacgccgcataggaccgcccacatgggaacgcccacatgggaccgcccacatgggaccgcccacatgggaccgcccacatgggaccgc

SEQ ID NO: 12638 - DNA, 371 bp, Homo sapiens
cggctgcgagaagacgacagaaggggtctagaagctgaattagttgcactatcccctgatcagaagggtagtttaggcaggcattttccccctggttttggatctcttggccccaaagccatgctgaggacaggtgcttccctgcctaggctacctctcccggcctgtccctggctccctccctgcccatccctggctctctccctgccccagggtagaggtggaatgagggtatgagagaatagcctgagacacaggcaagggcatggttgggagggcagtccaggagggtgggactgatcttgaccctgagtctgtatgtcatggttttttcttcctgacttcttgtcaggaactgctgtgggtttttg

SEQ ID NO: 12639 - DNA, 389 bp, Homo sapiens
tacggttgcgagaagacgacagaagggtcatgagtcaacttacatagatgaccacaggttcccgcatgggatcttgacatttagaatattctgttggaaagtggaggcaggaccatagcagagggatgaagtcataggacaacgaaggcctgttctcgactacacagtggccaattcctgtttctgtgggagtgaccaccagccccaccggctgggagggagtaagtggtgatggtatccagcagaagtttcctgagaaacccgtggagtgtcctgatatagccttgtggacctgctccgtgtgtgtgccctcacctttgtgtgtgtgattttgcatgtgtatgtgtgtgcctgtgtgagtgcacatgtgtggtggcatgtgtgcatgg

SEQ ID NO: 12640 - DNA, 404 bp, Homo sapiens
ggcacgagggttacagggctccagatcagggagggccttgtgacttgtgactctgagtgagatgggaagtaactggggaggctgatgcgaccagagatgttttaacaggttccctctggctgccgtgttgagaaaagactgcaagggggaagggtggaagcgaggagagcagtttggaggccctttgcaggaatacaggggagaccagggggtggcagtgggagggtgagaagtggtcagcccaggcccaccacagaaccacctctggcactacaattcctgtttgatgcaaggatggctgcttttcttacctgtcaccctgtgatgtgaaatcatgcatttagagcaacttggtaaatattaatttgtcaacaaatattagctattaatatcagtattaagcc

SEQ ID NO: 12641 - DNA, 384 bp, Homo sapiens
ggcacgagagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagaga

SEQ ID NO: 12642 - DNA, 403 bp, Homo sapiens
ggcacgaggagagagagagagagagagagagagagagagttagagagagagagagagagagagagagagagagagagagagagagagagagagagagagaccccctctctctctgagagtgtgtgtcactctgagtctgtgtctctctgtgcgcgagagacccccccccccttctcttgtgagcgcgcgctctctctatagagaggggcgcctcgcaccccccctcctttttgtgtgtgcggcgtgctctctcgccgggtgcgctctcttttgtgctagagaccgccctctctttttcacacgcacccccctcttttttttgtgccccaccctctctctcgtgtggggtgtctctctctctcccgcgaggggtgtctttttttctcttcgaggctctctctgt

SEQ ID NO: 12643 - DNA, 397 bp, Homo sapiens
gaggatcaaagtctggtgtagaaataacagcggtgaagagtttgactgtgctttccgcctggcacaggagggattatattcattgtatccatttattaactcattaattattactgtatcaatggaagatgatttgatactgttcacccaggaaaatcccttttttagaaaactcagcagtaagacctacagatcagcaaaggacctgacaaagggaaccatcgtgctgaagtatgaaccagattctgtcaatccagacgctctgcagagtcccatcgtcttatgcggatggcgatgaaaggcctccattccaacttttgtgccctagaatgaacggcttcattatctcaagatgatggagctggaggtattgggagaaaagaacaatgaaggagtg

SEQ ID NO: 12644 - DNA, 392 bp, Homo sapiens
ggcacgaggctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccctggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcacgatg

SEQ ID NO: 12645 - DNA, 402 bp, Homo sapiens
ggcacgagggttactcccaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaagggatggagcctatagaggtgcctcttgaggaaaatagtgaacggactcagattcgccaaagcagggtctgtgctgacagagtaagtacttatgattgtggagaaaaaatttcaagctggttgtcaacattttttggccgtccttgtcatttgatcaaacaaagttcaaactctcaaaggaatgcaaagaagaaacatggaaaagatcaacttcctggag

SEQ ID NO: 12646 - DNA, 411 bp, Homo sapiens
ggcacgagagccaatgaggcttttgcctgtcagcagtggacccattccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtggtgagtgggcactgaggagggggtgctgttactctttc

SEQ ID NO: 12647 - DNA, 402 bp, Homo sapiens
ggcacgagatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaagctcgaagattatcttccgggtggccctgaccttaattaagcagcaccaggg

SEQ ID NO: 12648 - DNA, 359 bp, Homo sapiens
tacggctgcgagaagaccacagaagggtaagcaccatattagaaagctctgaatttccatgtgataagtttgtaggctaaaggggcaaatgctttaggaaaatttcgtagcaatatgtttggtgtttaaagtagggaaggtctgagtgagagattgcagctaaaagctgtttattactaaagtgaaggccagttatcaggaggatctgaacagggaaggaaaatgggctgaaatcacaagtttgagttgacagctgaatgtttctagggagtcaaatatccctaggattcacattgagttaactgggagtggcaagttgattgatagtagtgaggacagagagacagtcaaagaaaggt

SEQ ID NO: 12649 - DNA, 347 bp, Homo sapiens
tacggttgcgagaagacgacagaaggggttttgtttttttaattctaaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtggtagttagctcctctctgaaaatg

SEQ ID NO: 12650 - DNA, 342 bp, Homo sapiens
tacggctgcgagaagacgacagaagggcagattaatgtggtttttcaggaaaggacttaggtgaactgaggtttttaccacaggcagtgaatgaccttggttcaccaaatttgcctctgttttgaggggcttggtccagagtgacttgttaatttactctaacttccttgtgtgttgatgggtaagtacactcaaacactgaatacaggtgtgtgatgggtagatttcacagcccttctactaatagtgagtgtgaaggcaagcttgatgcaaaacctcctgacctttcctacctgaagagccctttgacttctaggaagaaaggtcaaaaatgttatcttt

SEQ ID NO: 12651 - DNA, 335 bp, Homo sapiens
tacggctgcgagaagacgacagaagggattgaataataaaaatttaacccattgttgtgaaggagcctcagaatattttgatgttaacaaaagagttctgtatttacaaagttggagaaacactcatcaagagttaggagtaaggcccagtgtggggttccctctggtaataccagcattttgggaggctgaggtgggcgaatcacttgaggtcaggagtttgagaccagcctggccaacatagcgaagccccatctctactaaaaatacaaaaattagccagctgttgtggtacgcacctgtaatcccagctacttgggaggctaagggaggag

SEQ ID NO: 12652 - DNA, 345 bp, Homo sapiens
  misc_feature 345: n = A,T,C or G
tacggctgcgagaagacgacagaagggctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagctggatgaaaaaagatggcaattaaggtaagttacaccatttttgtttctaaaaaatccctaagaaatttcttggaatgagtctttggcctcagagcctctcaaagtgtccacttcaaggggggatcatcctcattagcacacagattttn

SEQ ID NO: 12653 - DNA, 336 bp, Homo sapiens
  misc_feature 336: n = A,T,C or G
tacggctgctagaagacgacagaagggtgtgaccttgggcaagtgacttcatttttctaagtctgttttgtcttttatgaaatgaggataataatagcactaacctcatggtcattgggaggattgagataatgctaaaagcatccttagcacagggtctggtaatttaataaaggtttaataaatattaccatatgattcttattactgtgaacagttaagaaatagtaaagtgatacataatgggtgagtacgaggcatgagaacacaggccaacgtgatgaattgccccatgaatagtgctgtgtataaccctctccaggccaggtgtcatgn

SEQ ID NO: 12654 - DNA, 356 bp, Homo sapiens
ttatcggctgccagaagaccacagatgttcttctccactggcagctgaaaagtctttgcaaagatccttgaccctgggctcttccctatgatttgccacataacacaggacagcacccatagacctacacaacaaaatgtacagttttccccccttatccatgggggatatgttccaagacccccagtgaatgcctggaagtgtggatagtactgaaccctagatatgcagtgtctggatagaaggaagaggataagagtaaaagggggaataaagaatgtggaaggcacagagtacagagagtaaatgaagggaaaagaagcaagtggatatgatggagggtggtaaaaggaaaa

SEQ ID NO: 12655 - DNA, 351 bp, Homo sapiens
  misc_feature 351: n = A,T,C or G
tacggctgcgagaagacgacagaagggagggtggggggagctcaggtcctaaatgtgagcctcatcacagttcttgtcttcagcagcccacccaaagccctccttcactgcctgtcaccattttcataccctctagagtcacttatcacaaaagtaacaatcacaatccttggaaaggtgtcactataccttaataaataagcaggtatacatgtgtggatttgtacatcccaagaggtgggactgatgagagacagcagcaccccattcccccacaatcaatgaacaaacctggtaaatactctctccatcccctgtgcccttcagctcaaatattgtgactctcttttn

SEQ ID NO: 12656 - DNA, 344 bp, Homo sapiens
tactgctgcgagaagacgacagaagggaggagaagataaacagttacaagagccccagtcgcatgaaaaaaaagtccagaatgctctgctcagaggagacccaattttctgaatactgagccctgaggaatttcaccactgggtttcccataaatgagaccccctgtgacctggtgggccccatccctcggaagtgtaccctggcatttccataggactgcttccttctgggcctcttagtgcaagccagcagtgcaatgccacatccaagtttggtaaatcaattctaagtgagataaattaatgccttttttgggggaagatgggaaacagagtgggtttgt

SEQ ID NO: 12657 - DNA, 353 bp, Homo sapiens
tctacggctgcgagaagacgacagaagggctggtctcgaactcctgacctcaagtgatctgcctgccttggcctcacttctttattttaaaccatctcatccaaccttacaaaatactttcaattcagtgaccgcagcagtcccttcaatgctgcatgagcctggtgcatgagcctgtaactgttttccctcctctaagagcagtgtccgtttcttcctcatcctagagtctctgttgcctagcacagtgtggctaatagaggtgctcaagaaacatttgttgagtgaattgcgtaaatggttataatcacatctgaattaataaataacttaaaatgccactgccgagcttg

SEQ ID NO: 12658 - DNA, 342 bp, Homo sapiens
tacggctgcgagaagacgacagaagggatgtgtattatactcatatgtattacacaaatatacatattctacaaacaaaaaaccctaacagccaccaagtaaatggggaccttgtaactaactgctcaaccctaaagaaatcctcaaacccaagtatccactaaggctggattcaacaaatgtttttagggccacagtaaatatttcaggtttggcaggccatatagtcacaattactaaattctgccatcacagcagcaaaagcagccacagacaatacataaacaaaaaaacaaacgggtgtgctgcctgtgttccagtaaaactttatttatggacatt

SEQ ID NO: 12659 - DNA, 336 bp, Homo sapiens
ttatggctgcgagaagacgacagaagggatcagctttcttagttcaggccacctgcaacctccttctagtagcaatcacacccccagcagcctggaactagagtattctgccaaagcagaaaccctgtcactctactcacctatataatgattttctgtgaacttaggtatgaagttgaaaatcctcaacttgtcatacaaggctctttatgttgctcctgctttagtggccaccaatctaccaccccattcactctcccactcccaaccctacacatgcacaccctcttcacattcaatttcttctcctttctccctctccgctcagcaatactg

SEQ ID NO: 12660 - DNA, 341 bp, Homo sapiens
tacgtctgcgagaagacgacagaaggggtgtgtgctgtacaaaggaatgcagagatatacgtccgatgcagctttcatcttttgggacttggcttggccattacttctgactttcctcactcgtcctctccttgcccaccccgccccgtgtgcacccataaatctggtgtgcacccacagatcctatgccgctctgcatcccgagtgtcctgcagctgtgtccagtgtgtgacacactatcctggcagtgtgcaggcccatgttggacagggccctgccgcttccttggcaccttgtatgctttcagtaagcacttgctggacaaaggcagaaagggctgt

SEQ ID NO: 12661 - DNA, 340 bp, Homo sapiens
tacggctgcgagaagacgacagaagggatgaggtggtggtcctaggctgggatggggtatggtgcagttacttgtattgacaaagcttaggttgtggatatgtagatgggagatggaggaggaagaatcacaggccaactgaatgtggagtcagaccacggtgttcagtggatcttttgtgtgcatgttgaaattgccacaagtgatgatggaagtagttagtgggtgtggaaaggacagtgaggggatacaggaattaaatcttgaaggaatgcttctggataatgagtttaatccaaaaactcattggactaaatgaattttgtccatcgcttcaaag

SEQ ID NO: 12662 - DNA, 420 bp, Homo sapiens
ggcacgaggcggacggtgggcaccggcccggccgccaccacctcgctcacaatctggccacttgggaagaaaacgtctatttttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagact

SEQ ID NO: 12663 - DNA, 438 bp, Homo sapiens
tgcaggataccatcgagctggttgtttgggcctaagcggcctacggctgcgagaagacgacagaagggcttgggtggttgaataggtaatcagacaaaaactaaatgaattttaattgttatgaatatagactcactaaatcagtgagaacctgtgtagacacaaatcaagattttgtctaaggatggtaaaaatacatatctgggcctgtggctgcctgaaagttaaatgagagttacatattttaaatactgaataacttttgaaaccagcacgacactacaactaccattattactaatagctaactttcaccgagtacttacttgagccaacattgatctaaaccctttacattgatctgagcccatttacccagcagatgcaaacaggatcagagaaagcacaaggtcatctttcctccctaggtcaactgaa

SEQ ID NO: 12664 - DNA, 420 bp, Homo sapiens
ggcacgagcagaaatgaaactgtcaaaacatcgatcagtacaaggaagggacacagggcttagaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagagga

SEQ ID NO: 12665 - DNA, 424 bp, Homo sapiens
tgatcgcatgaacccaccggcttgctcgcttggtcttttggccgaaacggcctacggctgccagaagacgacagaaggggcttctccagcacccagtgtctaatctccttggcctggaatacgaggcctccggactgggaccctgctgcttctgcagcacctggtgtctaagtgcctccttcttgatgtctgctcttcagtcacaaggagctgctcatctctccctgaggacacacgtgcacaaacacacacacatgcacacacaagtgcacacacagagaggagcgtgctcttctactccttctccctgcagtccctggaatgcaccatctgtcctaaaccaaaggcccaccccctccctgaagtccaccctggtctcaccaatcacaggtccgatatgcaaaaacacagatataacttagag

SEQ ID NO: 12666 - DNA, 343 bp, Homo sapiens
tacggctgccagaagacgacagaagggcactgaatgaactttaattggggttgttaaaagacagaattaacgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtaggctttatccctagaatcaattctctcagcatcaccaaactgaattggtgaaatagtgctaagattctgggcaataggaagattagtgaatatgatacattgg

SEQ ID NO: 12667 - DNA, 337 bp, Homo sapiens
tacggctgcgagaagacgacagaagggtcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcacct

SEQ ID NO: 12668 - DNA, 406 bp, Homo sapiens
  misc_feature 36, 37, 38: n = A,T,C or G
ggcacgaggagagagagaactagtctcgagagcagnnntttttttttttttttttttgggggggaagggcttttttttgaaaattgggggaaaaattttcccggccccccgggaaaaaacctggtcccccggggaaaaccttttaccccaaaggttttaaccgtgggcaattaacccgaacctaaaattttgggaacataaattggtggggggcccaaaggaagggaaaaaaaaaattcctttctttttttcccccccttttttttaaaaaaaaccccccccccccccttaatattttttttaggggccgccttttttttcggggcctttgaaaaacggcttttttttttcctttccccccggaccagggaaaaaggggccccttgtgaaaatttagggaaaattg

SEQ ID NO: 12669 - DNA, 371 bp, Homo sapiens
tacggctgcgagaagacgacagaagggtgtgttagctattactgctcctcctcctgactgctgtcatttgttgagcatctgttgcactaagtgctttctatattcagtaatcttttttaacaaccctcaaccctgaaagacagttaatctgttaggtgcactgttactttatggattagtttatgatttggttcattaagcctttattaagcaattgctaaccgccaggcatctggatacttgactaagcagcaggtataaaagttaaacgaagtatagtccttacagtgttttagaagagattatagtctcatagactcgggtaggttaagcaaattactagtcacacagctaataagagacagctgagg

SEQ ID NO: 12670 - DNA, 340 bp, Homo sapiens
  misc_feature 340: n = A,T,C or G
tacggctgcgagaagacgacagaagggcagactttgctacttagtacacaaacggggttcccttttaaatttgttcactctagttagcatttgcagaagctgtgaaaaattacagagagatgatgtgttgggtaagagatggtttaaaagtccagcttgctgtttttcattaagtgtcttgaaaatgagtaagtggcgttcctggaggggaacaatcatataattccgcagggtgggtctaaacttgttttctgatagtgtttagcagctcatggctctgagggcacctgataacacagcagccaggcgctgatgagaagtgtgtgccagacagacccgn

SEQ ID NO: 12671 - DNA, 397 bp, Homo sapiens
ggcacgagcgagaagtcacctttctccagatcactctgtagagtcagtggactcaatacagtggcagcaggattttaatataaactggcagactgattctaaaatttacatagaggccagccgtggtggctcacacataatcgcagcactttcggaggccactgcaggaagatcacttgagcccagaagttaaagaccagcctgggcgacagacacttcgtggcttatttttttttaattattaaaaacgaaatttaaaccaggtgtagtggctcacccctgtaatctcagcactttggaatgctgaggtgggcagatcacctgaggtcaggagttcgagaccagcctggctaacatggcgaaaccccgtctctactaataataccaaaaaaaaaaa

SEQ ID NO: 12672 - DNA, 350 bp, Homo sapiens
gcctacggctgcgagaagacgacagaagggcagctgcatgcctctctgcctcctctgtctgcccacctcctcctgcagtgtgctactctgctctgtgactgctcctcatgcagctcgcagccatgtttcctctctgcttcttgatttgcttcagctccttctagtgccttgaaactgaagctggcctgtagttgggatcaaagatggagggagaggggagattgtactatggatagtgtagggcaagaagtgaattcttacactggaatgataaaaggaacctgcttcctgagtttcttaaaattgtgtctggaactcagatttgcactgcctagtatagtagctgctgg

SEQ ID NO: 12673 - DNA, 381 bp, Homo sapiens
  misc_feature 381: n = A,T,C or G
cgttgctgtcgatttatatatattatacaaaatattatttgcatttaacatattctgaaccaatagtcttttctacaagcagaacattaatattcttgtcactctgaatgtaggcacagatttttgtcattctttatcttttttgtgtgtgtgtgacagagtctcactgtcaccaggctggagtgcagtggcgtgatctcggctcactgcaacctctgcctcccaggttcaggcgattctcttgcctcggccttttgagtggctggggttgcaggcgcgtgccatcacgcccggctcatttttgtatttttggtagagatggggttttaccgtgttggtcaggctggtcctgaactcttgaccttgtggtctgcccaactn

SEQ ID NO: 12674 - DNA, 388 bp, Homo sapiens
  misc_feature 388: n = A,T,C or G
tacggctgcaagaagacgacagaagggatacaatcagctagaaattacacttatgccatctcctaaaaaataccatgcaggattttgtgaatgaattactggaaatccatctaaatgtctggaagacaattctaaatgcataactttctcatggtctaaggttgtgctgttcactatggtaaccattatccacatgtggctgtttgtgttaattttttacattaatttaaactcaattacactagccacgtatcaactgttaaataataaccacatgtggctagtgcctattacactgaacagcataaatagagaatatttccatcttcatagaaagctctcttagaagcatttgtctaaaatgtcatcttcatgtatgataaatagn

SEQ ID NO: 12675 - DNA, 368 bp, Homo sapiens
  misc_feature 359: n = A,T,C or G
tacggctgcgagaagacgacagaagggttgagagactttgcattcctctctcccccagcattgaacatagaagctctgtaatgttagagccatgaaattgacccaatctggattgatgataaagacagctgcctgaaaaagtccctgatctaagcatgaatgaaagataaactttatgtcttaaattattaagattttgtctttgtaacagaagcattagcctatcctatcctgactgatatgaagccatttacagcttttaggtagacatgtaacaaggtcagatttgcatttttaactatcactttagctgtagcatggagaatggatgagagggatatgaagtcggtaggtgttcnactacctcc

SEQ ID NO: 12676 - DNA, 369 bp, Homo sapiens
cgattcgaattccgttgctgtcgagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattgggga

SEQ ID NO: 12677 - DNA, 405 bp, Homo sapiens
ggcacgaggccacttgtaaaagctgaactctagtctgtgtcctccattctgcccccgcccttcctccccttatttgttaaatgaagcaacatagtgagacgtcgtctctacaaaaaaaaagaaaaaaaaaaattagccaggcatgcgaaacgctgaggggggaggatcaaatgagcttgggaggttgaggctgcagtgagccttggtcatgccactactgcgttctagtctgggcaacagagtgagaccttctctcaaaaaaaaaacccaaaattgtaaaattacttctatagctatattttatgataaaaaagggatggtttctcaaaatcgcattttaaagacgttttatggaacttgttggaatggggacttaggagttttgattttgataaaaaactggaa

SEQ ID NO: 12678 - DNA, 399 bp, Homo sapiens
ggcacgagattttgccatgttgctcgggctggtcctcgagctcctgagctcaagcgatctgcctgccttggcctcccaaagtgctgggattacaggcgtgagacacaccatgccctgcctctcaatacactatttaatacatcagaccctttggtacctctaggcagaggaccgcaattaatttatgagcagctgttgctgtatacatgtaattatgtttgactacaaatgcatctttacaaaatgggcctagtggaatcataatataaatggttcagattaacttaattcagattaagaaaattgtttcatactgaggtaagcgattgaaaaattgtctatttaaaaatgcagtgcattttaaagagttactatttgaggatctaaaatatacagaga

SEQ ID NO: 12679 - DNA, 375 bp, Homo sapiens
tacggctgcgagaatacgacagaagggtaaggtgctgggatatggctgagaacaaaacaaagtccccatccgcacagagctgacattctagaacagaagatagacaataaacaaggtacacaggcaaaatacatggatgttggatgaagaagaatcccatggagaaaaaaataaaacaaagaaggagagttgctatgacagtgaggccaagataattgcaggaaagtagccctgataccaaggagacaataaaccactacttcaggacttctagttatttaagacaaataaactgggtttgtttaagactctgttaatttggttttctttacttacagctgaatgaattcctgagaccgtgtgtaggaaggtgca

SEQ ID NO: 12680 - DNA, 374 bp, Homo sapiens
ggcacgagggcagaggttgcagtgagccatgattgcacccctgcactccagcctgggcaaccaagtgagactgcgtcttttaaaaaaaaaaaaaaaaaaaaaaaagggggcaaaagtttgggggggggcccccaattttttaattttttaaaaagtttgggcccgggggggggggcaaatccctgaaaccccccccttttggaagcccaggggggggggacccccgggggcggggatttcaaacccaccctgcccaccgggaaaaaacccccccttttataaaaaaaacaaattaaccccgcctaagggggcctcccctgtatccccccttctccggggggggggggagggaaaaccttttaacctgggggggg

SEQ ID NO: 12681 - DNA, 375 bp, Homo sapiens
tacggctgcgagaagacgacagaagggacctcattacaggagtaggagtccatttcatacaaccttggattgtgtggcatcagcagtctcaacactgaaccagttgtcagggagggtgcaaactgaccccttcaatgcaaactatctatgcaaactgaccccttcaaaggccattgtgagcaggattatccagatgttagctgccaccttcagggaattgctgttctagctttgctttgctcactggctctgtgccacatgatgagcctgcactttcagctcagctgctttgtgctgcttttactgagtttggctgagactctttgagagaattctctgacctaggtcagtaatttagataatattttgttagtt

SEQ ID NO: 12682 - DNA, 398 bp, Homo sapiens
cagaagcctggattcaattttcattcctgataaattgtacgaactttgggcataaatatttcaacttcagcctctcttcctctgaagtaggatttataggacctttgctatcttgaattacagtgatatttacttagaatgggttaattccatttaaaactttttttttgctgctcagggaaaagtgacttgataacacacagagtgacccctcatgtttgcaaattccaggggccatgcctagtgactgcataatacgaggggctggagccctgatccctgtcataaggcatgtaacagcctgcatccctagatttcagggataactctctgaagcctggaaagggtcagtattccacaggctgcgccctctcatgctgtccattttgagtaacccg

SEQ ID NO: 12683 - DNA, 376 bp, Homo sapiens
tctacggttgcgagaagacgacagaaggggtttttaaattgttacaaaaaaatcaactaaattgttcacatgagaacatgtcctggcaaaaaaagaaagagaaaataagagaaaacaactaaattgttgttaatgttagataaataagaggcacttattgattcaaccacagttttctggagatcaactttaatttttgtttgtactttggtggtagcttttttcattggaaagaaatccaaaattaaaattacattgttaactaaatcttacttttttgtgtgaatttttgtaattaattttcataagacactcttgtctttgagtaagtttcttgtttgtaaacaacacaacacaatttatcactatgaatgaa

SEQ ID NO: 12684 - DNA, 383 bp, Homo sapiens
ggcacgagtatttattgaattcttatttaaaacaaacagaaacataaggggcaaggggcagggagaggaaagcctggcgcctacaaacatgaaataacgtaagatgtaaaacattgattcatatacaaatggtaaattccaagtgctctgctactaactatggggcaccttaaacattgttcggcaagaagaatctcatagtgtgataacttaatgctttaagtttaaatatatttcataagttttaccaatctgatgtgttattttctatagatttccagcacctatctagagagcaattggcctataccgctgagtcgttattatgttggtgctaacttttgttgactagcatttgctgcaagaggcattctgggaagagc

SEQ ID NO: 12685 - DNA, 373 bp, Homo sapiens
  misc_feature 352: n = A,T,C or G
tacggctgcgagaagacgacagaagggaaatcataaggatattcttattgtgaataccctgtagcagggtaatctggactcaaatcaggttgcccatggttcccaaattcacttcattactttcccaaccacttcccccttaacttgctttcccctgaaccgtagcaaatagtaatgcatgacaagctgataggagggaaaacatgacaagtgaggttgagttagaaaggaaaagcagggctatgaggaactgaataagagatcagatttgtatttttcctttggagtcttgagaattgtaatatttgaaacccttggcagaaaataaaatcataaccaagtgactcagaanaaacatactaatgctaactgt

SEQ ID NO: 12686 - DNA, 379 bp, Homo sapiens
cgttgctgtcggaggaggaggttgattatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgg

SEQ ID NO: 12687 - DNA, 338 bp, Homo sapiens
  misc_feature 338: n = A,T,C or G
tacggctgcgagaagacgacagaaggggtggctgtgaatcagccatgatgctgagtgctacaagagaggactgtgcggctgggagggcttataacaggatttaacctagttagggaagatctgaggaagtgatgaaagaatggaaatcaatatgtaagagctcacaagtcagagtgagatgtttcttcctatactgcctgcttctaatgagcatccacttcattgaaccacctcttcattgagccaaacctaccatacagggatacattctctggaggaaagttgagcaactattgcatttgggacattaaagtatgggtgggctgacaggtatgtgn

SEQ ID NO: 12688 - DNA, 390 bp, Homo sapiens
  misc_feature 340: n = A,T,C or G
ggcacgagggcaggcagatcacttgagcccagaagttgagaccagcctgggcaacatggtgaaacctcatctctacaaaaaatacaaaaattagccagacatgatggtgtgtgcctgtggtcctagctactagggaggcagaggtgggaggatcacttgagcccaggaggtcgaggctgcagtgagctgtgatcgagccactgtactccagcctgggtgacagagcgagaccctgtcttaaaaaaaaccaccaacagggaaaggccaggacgacgaggagaagttggtatctttttgttagctccagagtttgtgctggtgaaagaaggttaggatgtanaaaagggatttagagacatacagtggctgctcttcagtattcttcaaggg

SEQ ID NO: 12689 - DNA, 375 bp, Homo sapiens
tacggctgcgagaagacgacagaagggaggagttgggtgattgacattgttgagctctgcaggaaatctgttagtctccatttccggaggtcttgctatgtagaaaaattggatgactttattgcttaagtcactataagaatgttttctgttacctgcaacccaatgcacccaactaataaagtatgtttctagaaatacacttgcctgcactcattttttaagacacacagaccacatacacatggagagatatttttaaaggtcttgtactacataaattgtactattttttaatttaaaaatatgggccaggtgcagtggctcacacctgtaatcctagcactttgggaggccaaggcaggtggatcacaa

SEQ ID NO: 12690 - DNA, 379 bp, Homo sapiens
tacggctgcgagaagacgacagaggggtcaggagtttgagaccaacctgggcaacatggtgaaaccctgtctctattaaacatacaaaaaaaattagccaggcatggtggcacacctgtaatcccagctactgggaggtggaggttgtagtgagccgagatcatgccactgcactccagcctgggcgacagagcaagactctgtcacaaaaaatattcttcccagttttcatcatcatggctacaagttaccaaggtcatttgtttatttggtcatttccttgagggcgagaggccaaattgccttgttgttgtaccagcgccaaccctctgatgtttgttgaattaatgaacacccatttttcagatcaggaaagggg

SEQ ID NO: 12691 - DNA, 330 bp, Homo sapiens
  misc_feature 241, 242, 243, 244, 245, 246, 247, 249, 250, 253, 254, 255,256, 258, 265, 266, 269, 270, 271, 275, 294: n = A,T,C or G
tacggctgcgagaagacgacagaagggaaagtatataacaaaaattgtatatatcaacacaatttaaatttcaaaataagaatgttgaatttttaaaaagcaagttgcgcaggtaatacaaatgtatgacacaacttatatatagtttaaacataatacaacaagagcaaatagtaaattatgaatttgaatgcatatgtgtggagagtgtgggggtgagtgtggatgtgggggggatgtnnnnnnntnntgnnnngntgtgttnntannngttnttttttttcttttttttgnttttttggggtggttatgttgtcaggggtttggttt

SEQ ID NO: 12692 - DNA, 348 bp, Homo sapiens
tacggctgcgagaagacgacagaagggcatacagttgggaaaggaagaagcaaatatatctttatgtatagataattgggggcacaaaacattctagggaacctccaaaatatttactagaataaataaaattagcaaagttataatgaaacataatgtggccaggcatggtggctcacgcctgtaatcccagcactttgggaggccgaggtgggttgaccacctgaggtagggagtttgagaacagcctggccagcatggtgaaaccctgtctctactaaactacaaaaattagctgggcatggtggtgtatgcctgtaatcccagctacttgggaggctgagtcag

SEQ ID NO: 12693 - DNA, 408 bp, Homo sapiens
gtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaagg

SEQ ID NO: 12694 - DNA, 337 bp, Homo sapiens
tacggctgcgagaagacgacagaagggtctttcataatacctaactaatgatgtcactctaatgcttaaacatgcttcagtagcctcaggataaaactctgtggtaaggcatcaaaggtactcaaattgtaggtcccagagttctacatggggagcatctacttgttgcttgtatcatgtctttctcaacggtccctatcgcctagaagaagagttaattgcttctttcttactgtcatttcatgccttcagaataaatgtatagcacatttcaccaggttagaaactccacaaagggtaattcactgctatatttctagggcctagaaatctaggc

SEQ ID NO: 12695 - DNA, 338 bp, Homo sapiens
ttactgttgcgagaagacgacagaaggggctgggggagctgcctgtgccctggcctggccaggaggtccctcctgccgctcagctgcccctgcaactgcacgtccccatgctcctgcagtcccaccagacagacacctcttaggaagcggcatgctccctgggacaggccctgaggcatcacggcctcttgtgaaattatcaaacgtcaccaggtgccagaggcaggtgggcagaacgaggctgaggttcactgggatgctgtggttaaggcctctgctgacctgtgctgtgccggccactgggagtgtgaaatgagcaaacgggaacagaagggtgg

SEQ ID NO: 12696 - DNA, 376 bp, Homo sapiens
tacggctgcgagaagacgacagaagggtctgttttgtagagtaaatcgaaggatctgttttgttatataacacatttacttttcataaatggtgttatctggcaggtattttttggcttccagaataaaagttttaaaattaaaaggggtatccaagtatttttaggagcctagtatttcctcacttactcccaaactctaaaagtagattggctttatgttaaacagagaattcgtacagaaaaaatcttcaggactgtattcattccataaataatgtactttattttattgcatatggctattaaggagggcatccatgatcaatacagactaaatacaatgcactattctagtccagtttattctcgtctcc

SEQ ID NO: 12697 - DNA, 357 bp, Homo sapiens
  misc_feature 357: n = A,T,C or G
tacggctgcgagaagacgacagaagggtctattactcgactttgaatttctcacacagctggcattaaattcctcttctcaagaaacttacaagtagttgtagattattatcaccagagctgtcaatatctgtatctgcaagaaactgccagaaaacagccagtatacctgtaaagggttcaagctaaatagaatttataaagacactattacagagatataggcagagttagggactggcacccaggaactcacaatagcagggagccgttagcacctgcgatgggctgaatcatgttcctccgagactcacaagttgaagccctatcccccagtacctgataatgtgactgtatn

SEQ ID NO: 12698 - DNA, 375 bp, Homo sapiens
tacggctgcgagaagacaacagaagggggagaggacccagatgggcttgttgaagtaccagtgggtaattggtgaagtggccaagggtatgaggagtgcagggtaataaagaaagagcaagggaaggaagttgaggtgtggtataagcagggaaagctgttggatgcaaggttggagttagtgggggctggaataaaaagatgtgacctaacaactattaatgctgtcttgttaaacaaaatgatttgtgtggatctgtgtgaaattctgacttggctagcctatttcaaaatgcacgatgaggttgtttttaaatgaacttacgaattcagtttttccctatttccctgaccgtgatttgacatatctcacagg

SEQ ID NO: 12699 - DNA, 337 bp, Homo sapiens
tacggctgcgagaagacgacagaaggaggacttaaaacaataagcatttattactgatctgaagtccacaggtcatctgggtcagtctctgatctgagccagcctcactcactcatgtgtctggtccactggcagtttgaaagggaacctaattcacatgtctggcagttggctgaatgttggctagagcaataggatgactagaccatataccttttgttctccaacaaacagttgcaggggaccaggggagcaagtggaagcatgcaatgcttcttaaggtctagtatcagaagttgcacactgtcatttccactgaattatttagctgaagcaa

SEQ ID NO: 12700 - DNA, 391 bp, Homo sapiens
cgttgctgtcgggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgcccagatgcctacaaacacttgaactatggcccacactcttgccagcagatggggga

SEQ ID NO: 12701 - DNA, 378 bp, Homo sapiens
tacggctgcgagaagacgacagaagggtgtaaggggaaggcaaatactggatcttgggaaccactgtaatctactttgtgtctagcctatttcctatatccattgatggttcctgccctggctgtgctttcctgttggctctctttgatgctggattctctgtaccctgctcccacactgcctcctgctggctttcctcagatatcaaggaccaagtagtcacatttcccctaccatgcattggtgtcgcttcttcactgaagaaaacacctagggactgaccactcctcccctccaccagatcttcccaacccagtgtgttctgaggctttagggtaaggcagctagtgaaatttttctctccaaatcctggaaggg

SEQ ID NO: 12702 - DNA, 362 bp, Homo sapiens
ggcacgagatgaaggcccatgaggcggcttttattgaacaggaacaaaaagaagctgttgcgtgagctgagaaagcaccgggagcgtgtggagctgatgatggatctgcctggggtttccattgcagacgagggggagactggcatgttctccttgtgcaccatccggggtcaccagttattacaggaagtaacacaaggggatatgagtgcagcagacacatttctgtccgatctgccaagggatgatatctatgtgtcagatgttgaggacgacggcgatgacacatctctggatagcgacctggatccagaggagctggcaggagtcaggggacatcagggtctaagggaccaaaagcg

SEQ ID NO: 12703 - DNA, 336 bp, Homo sapiens
tacggctgcgagaagacgacagaagggcagggacatgtctgaccccacccagtgcccagctcagagcctgataagtgtaggtgcccagggaatgtgggtcagtgaacataagagaggacttcatggagcccaggcgtgggcagggcactccgtggtggggtgctgagtgaagaggcaagtagatgaaagggcccaggtcatcctggccatgtcaggagcagggaagggcccacctggtggaggggatggccagaggagctgtggggcagcattgcgggcactcacctggtgggcctctcatccccattgggccccgactgccggcatctcccttgg

SEQ ID NO: 12704 - DNA, 378 bp, Homo sapiens
  misc_feature 378: n = A,T,C or G
tacggctgcgagaagacgacagaagggctgtagtcccagctacttgggaggctgaggcaagagaatcacttgaacccgggaggcggaggttgcagtgagccaagacagcaccactgcactccagcttgggtaacagagcgagactctctcaaaaaaagagcaacaacaacaacaaaaaaaaccatagccatatggcttgagtaaggaaagacagagttgctatttgttgagatggggatgacagtgaaaagagcaggcttggggtggtggaaagtgcaaatgtaagtgttcgattttggatatacttaatttgaaacgtcattatacaaccaagtggagatcttgcatgtacactggagatacatggccaaaaatatn

SEQ ID NO: 12705 - DNA, 373 bp, Homo sapiens
ggcacgaggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtg

SEQ ID NO: 12706 - DNA, 410 bp, Homo sapiens
ggcacgaggttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtga

SEQ ID NO: 12707 - DNA, 407 bp, Homo sapiens
  misc_feature 387, 407: n = A,T,C or G
ggcacgaggctcgtcctgcggcggccccccagcccacctgcttcctatccgtttcctgcaagatggtgccccctgcatcccctcacccattgctcacggaaggaaaagcagacgtggccagcctgcatcctctgccctccctgagcctcctggcctggctggccacagctggcatggacgccatcagcaggctccgtgcaggcggacgggggcagcccccacagccagggcaccctggacctcactcaccagcacccttttggtcttttcctagcaaaatatgcaaagtgtgaccagtgtggaaacccaaaggtgagtgggttccggctgcaagccaccaaggcttcagctttgggggtgagcagggtggtctctgcactgcttggngtggcaggtctggtgccccn

SEQ ID NO: 12708 - DNA, 388 bp, Homo sapiens
  misc_feature 388: n = A,T,C or G
ggcacgagtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacn

SEQ ID NO: 12709 - DNA, 334 bp, Homo sapiens
tctacggttgcgagaagacgacagaagggaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttgggggggaggggtattatgtgtctggctctcccattttacattaactatcactaatcttttaaatgagtattacattagtgtctttatccgcggactgcctcaattttcattttatttcttccatgagtcaacggcccttattcatactttaac

SEQ ID NO: 12710 - DNA, 399 bp, Homo sapiens
  misc_feature 394, 399: n = A,T,C or G
ctccgttgctgacggtgccagggaaacggattcatctacccacgaaggacgcgggagatgaggtgccagggtaaacagcgggacccgccactatgtcaccctttcctgccgactgcccggaggaactgcatgcagggcggccggctccgtggcaggcagaggcaggaagaggcgcggagcccgctcgtggcgaaaaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggngaggn

SEQ ID NO: 12711 - DNA, 395 bp, Homo sapiens
  misc_feature 4, 5, 6, 7, 8: n = A,T,C or G
ggcnnnnntctgcagcggcctacggctgcgagaagactacagaagggcacagaaggcggctctatgagaagagctcttttaatgtgggaattgatatacaagaaggtacttagtccataagatcaggatgtacaagataaccccagagggcgctcagccaagcttagagccactatcaaattataagttaccatcatcttattcttcaaattttttctgcaggttctctagtctttactcatggtatgttcctgaatgtcttgatataggtttaagtatgggacagtctaaaaattgataacatttagcattttttttcctcacaaagaaactgtggaaaatattagcatgacagagaaagttccactcacggagtagcatctcaagaccggaaa

SEQ ID NO: 12712 - DNA, 372 bp, Homo sapiens
tctacggctgcgagaagacgacagaagggcctgagggtctgctctgcctgcctgaggactgacccaagctatattctgagtcagggctaggggcagcttagtgccaccacaaaggccttccctcagcatatataacctcactgtctcccaggagctatgggggtaatacaggcattgggagatgctggagggaggcagggtcttaattggctgatcaactcaaccaagtaacattggttaatggcccaaggtcaatgtggggagtgtcaactggataaatgatattcagggaagcccatccctgttctgctgcaagtctggagagcatgccacaggtgagcagcgcttgtgaaggtaagatatggaggccac

SEQ ID NO: 12713 - DNA, 372 bp, Homo sapiens
ggcacgagagagagagagagagctagtctcgagagcagctcttttttttttttttttttggggggggggaaaaaacccccccttttttgggcttttaaaaaacaacccctttcagggaactgggggactggaaaataaaactcccccggggttgggtttttgggaacctgaagccttttagaagggagagggtttttttcccaaaaccccaggggagggggggctttgcatttttggaacacaaaaaggggccccccctggggggggaaaaaggctaaaccttcccccctacctggggaatgagcccccccttttgtccccttctgggggggggggacggggccctttttttttttgacccagggggcggtt

SEQ ID NO: 12714 - DNA, 393 bp, Homo sapiens
ggcacgaggtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttga

SEQ ID NO: 12715 - DNA, 353 bp, Homo sapiens
tacggctgctagaagacgacagaaggggaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggagtccagaattcctcagcagcatcctttcatcaacctacccaacctgtagctaagaatacctccatgagccctcgacagcgccgggccca

SEQ ID NO: 12716 - DNA, 379 bp, Homo sapiens
ggcacgaggcaggaacagccctcaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccag

SEQ ID NO: 12717 - DNA, 380 bp, Homo sapiens
ggcacgagattcttttgtctaaaacttatcgaaattgatgcttgtactctactggctccctgatgatagtagaaaagcactagtaatgtaccaaatgaaactggttgtgtaccagatgattttgttaacttcttaaatagcctagaaatcgtcagcaggtcacatacaactgcagtgataatttcagaacatagcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaaca

SEQ ID NO: 12718 - DNA, 340 bp, Homo sapiens
tactgttgcgagaagacgacagaagggggttgtctgaattgggaccggaaaacgttgtcgctcatcctatgacgcgaaagtaaccgagactatcaggatccggagacggaaatgtccgaaggcagcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaac

SEQ ID NO: 12719 - DNA, 368 bp, Homo sapiens
tcgaattccgttgctgtcgagagctaggagttggatggggaaggacgcccggccaaaagccaggaaaaggggaagcgcctggatggaaaggacgagtttgaggacctcgagtggtccgaggaggtccagaagctgcaggagcagcagctgcgcagcgacctcctggaccagtaccgttccctgctggtggagcggaaccgctcccagcgctacaacctatacctgcagcacaagatcttcgaggcgctgcgcagaaagaagggcctggaggccgctgaggtggctgaccggggcgcagaggccgaggcccccgagaaagagcaagcgtacctgcgccatctgggcatgctggaggagctgaagaagcc

SEQ ID NO: 12720 - DNA, 413 bp, Homo sapiens
cgacgaggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggc

SEQ ID NO: 12721 - DNA, 386 bp, Homo sapiens
cgttgctgtcggcggctccgatttatgtctgtgggagtctcggagacgtgtctgggtgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcat

SEQ ID NO: 12722 - DNA, 344 bp, Homo sapiens
  misc_feature 271: n = A,T,C or G
tacggctgcgagaagacgacagaagggttttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggntgttagctgtgtttatccttcttcagagaaaaacaattccaatagtttaaatcgaatgaatggtgtatgtttc

SEQ ID NO: 12723 - DNA, 437 bp, Homo sapiens
  misc_feature 40, 41, 43: n = A,T,C or G
tagtgcttctgagattccatggagagcttgcttgatcttnngncccgcgcggcctacggctgctacaagaccacagaaagggattacaggtgtgggccaccacgcccagccctcttgtgtaatttttgataaataacacatttactattgttggtttaatgaaaacagctcaattctgaggtattgctaaaatactgatatttaaccttaagtttcttacttaggtcagaaactcacaggctattaaaaaggttaacaggaaatagctttaaatgatgactatcacagttttcataaataacctatgtaaactatcagcattactcatgttaatgtaatggaataaatgcttataaacaaacttgatatataatttagaatctaaagttacattaaataataaaactcattaactgggtagcttctaatttaaaaac

SEQ ID NO: 12724 - DNA, 385 bp, Homo sapiens
  misc_feature 331: n = A,T,C or G
gcctacggctgcgagaagacgacagaagggcatagaggagtaattgggtaattcctgtgtcttagggaagtctctctggctcccgaggacagcatactagacacagaggaccaagtagtgggctcctagtatccttctggtggccaaagccttcacagtgaaaatagataggaagagccacctcgcctggcccgatatttgtttttaaaaggctgggcatggcttatgcctgtaatggtagcacttcgggaggccgaagtaggaggatcacttgagacaaggagtttgagactagactgtgcaacatagtgagagcccatctctacagaanaattttgtagggccgggcgcggtggctcatgcctgtaatcttagcactttggga

SEQ ID NO: 12725 - DNA, 401 bp, Homo sapiens
ggcacgagccaccatgcccagccaagccatgaaatcttaatggctcaactaaacaaacatttatttctcattcacactacatgtccatggtgaggaagaccactctgctccatattgtcactcagagatctagacagatggagtctttactatcttatgatgttgctgtctcaacacacagcttctagagttcctgtggtgggataaggtgtaaaaaacttaaactttctcttaaatgctttggccctggctagcatcagtcctatgaatcttcctcagtgctagggagttgggatgtgcagtcctccctgatgcccaaacagaacaggcaaaccagatattactgagtgcaagaaatccctactatgtgtactgaggaacaggattcaagctgtattaga

SEQ ID NO: 12726 - DNA, 401 bp, Homo sapiens
cgttgctgtcgatcttggtgctctccaggtgatgtgttggtgatatggggtcactaagtgaagacaggtttccaggtagaacatagtttttgctcatttttctctgggtgtccagggtcgccatccctactcctactctgccttgtggaattcttccctcaaaggttttaagcgtcttaagtgcttctcacattcccagataagccttggtgctctacctgggatgcagtcggtgcccgttacccagatgttgaagggattaaatacttccatgcctgaactggtgattggacttgttgaaatgtttttccttttttcctcttttgtcccctggcactgggatggtggtggtctgtgggtgctgtctcaaggtgcccttaaaaaaggacaactcagaagag

SEQ ID NO: 12727 - DNA, 424 bp, Homo sapiens
tgctcgagagagagagagagagagagagtgttatagagagagagagagagagagagagagagagagagagagagagagagagagagagagagagagagagagagagagagagagagagagagagagagagagagagagagagagagagagagagagagagagagacacactctctctctctctgagagtgtgagagagagagagcggggtgtgagaccccccccctctctctctctgtgtgtagtgtttctctgtcgcgcggttatttttatctatctctctctctctctctcatatataccttttccccccccctctctctctcacacacatattttttttttttttttgtgtgggtctctctctctataaaacacaccccctcttttttttctacttctgtgtgtgcgctttcttcacaccc

SEQ ID NO: 12728 - DNA, 407 bp, Homo sapiens
ggcacgagaagagatatatatcagcttctagtaaaagtttttttttttaaacctgctagctacatttacattatgtaaaaataaagggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccagggcaggtggatgacttgagctcaggagtttgagaccagcctgggcaacatgatgaaaactccgtctctaccaaaaatcaaaaaaaattatccaggtgtgatgttgtgtg

SEQ ID NO: 12729 - DNA, 411 bp, Homo sapiens
  misc_feature 14, 381: n = A,T,C or G
ggcacgagatttanaaaaaatactaataccatagcattaattgtgatgatgaaaacagcactgtgtctacgttgtcagaaaaattgctcctttttaccaccattgactcatttctgtgtgttcaggtctcataaccagtctatagtcagtgtcatcttggggacagtattccttgagtttctgatgttgaattcagttttgctggatacaaaattcttggcccagattttctttgagtatcttgatttattctgttttcttccagcataaagtgatgcatgaaaagcctgatgaatcttgttttcttcccctgacagacatatgctggttttccttatatgcccaaaggattttttcctttctctgtcaaggcggtcgttntattcgaatgagcatgtgtagtatcggtgg

SEQ ID NO: 12730 - DNA, 381 bp, Homo sapiens
  misc_feature 381: n = A,T,C or G
tacggctgcgagaagacgacagaagggtccaagcaagtagataatgtaataatcaaaaaataaatataaaagtacaacaatactacatactctgaaggaggggtagataaatcatgctataaaggcatgatcaaaataaaaagtttggatctgcacagagaggtcagaggtttctctgtggaagtaataagagaattaagaactgaaggaaaagaaggggttaactatagaacgacaaagaatcacattctaaggaaagcaaataacaagcactaagatcctgtggttggagagaatatgttattcagtagagccacaagatggtacctgtggctagaatgctagagagagagtagaacagataatacctctgtagattcn

SEQ ID NO: 12731 - DNA, 394 bp, Homo sapiens
ggcacgaggtgacctcaggcctacataacctttctgtacctcaacttcctcatccagaaaacagggatgatgctgtctacctcattggatggttgtgcaggatcaaagattcagtcattcagcaaacctataccgagtacctactgtacattcatgagtgctaggcagccagccttccaggtgctcaggtacatctgtgaacacaactggctattggaggaagcaaaatcagtaacatgacctgctctctttgatctgtgctacagaaaaaaaggaaagtggagaggcatcaggaagtcaggagtgctggggaggggctggtaacagtcatggtattaaagaggagggcaggcaggccttactgtgaaggtggtatttgagatgaagtagttgg

SEQ ID NO: 12732 - DNA, 386 bp, Homo sapiens
tacggctgcgagaagacgacagaagggggaggattttctaattctttttcagttttgactctgtagtttttcataagcagtaggagcatgatcatgagacttaggaggagcaaactttgtcccagtatagtttaagaaatctcatatctttatacaaaatatgtttgcagctgaactttacataccatcttggtgctgagacagtcagataggtcctcctgtgtgtatagtgcctacaaatcccaggaatatgaaaattgtatagattcctagttgctggctagagaagtgagagttgaaatgttctaagatataaggaaatgcaggttttgccttagttatatataaagttgtcatcatagagcctagtgctgaagagcaaagga

SEQ ID NO: 12733 - DNA, 385 bp, Homo sapiens
cgttgctgtcgatttttaattgagcaaatattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtct

SEQ ID NO: 12734 - DNA, 392 bp, Homo sapiens
cgttgctgtcgaaaaaaaattagctgggcgtggtggcacattcctgtaatcccagctacttgggaagctgaggcaagagaattgcttcaaccttggaggcggaggttgcagtgagctgagattgcgcattgtacttcagcctgggcaacaagagtgaaatgccgtcttaaaaaaaaaatttcaaacatgcagcaaaggtgaaagaatactacagtgaacacccatatgccttctgtttggattcgactgttaaccaacatttaaccattttgctttaactctatatcctccctttcttgaatgatttgaaattaaattgcagatatactgcttttccctgtaatacctcaggatgcatgtctttgaaataatgctttttcctacgcttttcg

SEQ ID NO: 12735 - DNA, 406 bp, Homo sapiens
  misc_feature 406: n = A,T,C or G
cgttgctgtcggcgccgggggcgcagcttatgagggcgccggacctgggaagccgattccaatcagttgtcagacccgggaagcccgacgttccgctctcccgagtccctctgtggggtgaggaatgggtcttgtgaaattctgagcaaaaacaaaggcaaactctatctccgaaagggacgtttgggtcacatttcctctctgggggcggactccaaagttctcaaaatgagaaggcagaaatgaaaacacttcaactttttttttcttttcttcccggggcgggtgtcttgaacccctcttctccccgcccctctggctccgttctcctcccctcctccacccgtctcccggactcgggggtggcgcctgacaccccgacactttcggacactgtttgggtaan

SEQ ID NO: 12736 - DNA, 405 bp, Homo sapiens
ccatcgattcgaattccgttgctgtcgaaaattttaaagttccattttctagccttaccacgtatcaagtgctccatagccacacgcagccagagcctactgtactgtgtagtgtcagcataaaacatgtccatagttgcagcacgctccattggacagcatgcttaggacaggagttgtgccttgtctacctggacctgcccctaatattggctagcatctcctcacatggaattctggaagcctcgcccccttctttcctcacccccagctctgctcctcactgtgcagggccttggatgtgcctggagcagaggccaggcaggccctggaagcagtcttgggctgtatggatgggggattccagatcgtatatgtagagcatactctaaatgtggggcagga

SEQ ID NO: 12737 - DNA, 386 bp, Homo sapiens
ggcacgaggcaacatggcaaaatcccatctctacaaaacatcaaaaaaaaaaaaaattaaccgggcctgggggggccacccctgaatccccattttgtcaggaggctaaaggggaagaatcccctggccccaggggggcaagggatccagggaccaatggtttaaccattgctttttacctgggggaaaaaaaggaaaccccgtttaaaaaaaaaaaaaaaagaaaaaattctaaaaacccttatttttataaaacttaaaaagggcgggaaaaaataggttttattatcttattttaacaaagggaaaattgggggctaaaaaaataaaagtttattgctaagggccttgggcttaaaatttggcaaacccttgtttaaaatccg

SEQ ID NO: 12738 - DNA, 386 bp, Homo sapiens
tacggctgcgagaagacgacagaagggggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccactttcccttcatc

SEQ ID NO: 12739 - DNA, 380 bp, Homo sapiens
  misc_feature 363: n = A,T,C or G
tacggctgcgagaagacgacagaagggatctccagcctggcctggcctctccgcagcgtttcagccacagttgcacaggtgcggctggacctggacctgctgagggaggttctcagggtccggagctggccttaggtggtcaccatagtgagatcctgaaggcttcgaagaggccacaagaagtacaggaatatagcccagtcttagcggaggccatgcagcagatggggccctggggagggattccggagcacctggtcccatgctggggctcagcatcgctgtctgtccagggatgagcatgcaaaggccacatcctgctgggtctaagctctggatcctgttgaggacagaactcagcanatacagctcagtgctgc

SEQ ID NO: 12740 - DNA, 396 bp, Homo sapiens
gacggcgctcggggtgctgcagtccaacctgccatgtgccgagacacttctgacaaacctccaagaacacgtgatggctgttactgcacccgcgaaatcactgacacgaaaagttcacgctggtgcctatcctacagaagagggtgtcatcttcttggaagtgaaagaccagctgctgctcatgtaccttatggatttgacccacctcattctggacaaagcctcaggaggatctctcggggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcag

SEQ ID NO: 12741 - DNA, 382 bp, Homo sapiens
cctggcaaaccttgttggcctggcagaaaatataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaaga

SEQ ID NO: 12742 - DNA, 382 bp, Homo sapiens
  misc_feature 382: n = A,T,C or G
tacggctgcgagaagacgacagaagggacataccagggtaatactctgcaaaaagaactaggggtgcctatcttaattattaggaaaaactggacttccagaacaaaaagcaacattacagatgagttttcaatttaccagggatacataattttaaatttgtatacccctaacagcataactttgaaatatattttaaaaaattactggaactacggaatattcaaaatcacaaagggacattttcacacatctcacagagggacattttcacacatctctctcaaaattgatgggtcaaatagacaataaatcagtaaggagttaaaaggtttgaagaacacaattaagaagcttgatctaatggacttacacagagcan

SEQ ID NO: 12743 - DNA, 405 bp, Homo sapiens
cgttgctgtcggcgcatgcctgtagtcccagctacttgggaagctgaggcaggagaatctcttgaaaccgggaagcggaggttgcagtgagctgatatcacaccactgcactccagcctgggaggttgcagtgagctgagatcgtgcccctgcactccagcctgggcgacagagtgagacttcgtctcaaaaaaaaaaatttaaaaaaagagcagcttctactgcagcctcctcttaccctattgccttctcttgctctggtctccactcaaagcatgcagccttctgggtgattttgcagatgggtcaaaacagcatactcaatgttgcctcccaaataaaaaaacctaccgaccattgtacttctttctttgtggtaggtactgcaacttgcagcaacttgtt

SEQ ID NO: 12744 - DNA, 418 bp, Homo sapiens
  misc_feature 9, 10, 11, 12: n = A,T,C or G
cttgttctnnnngcccatcccatcgattcgaattcggcacgagtggaagcctggcaggccactcgagttttctctaggaggtaggtctggactgcggctccagtcatttgctgagccctgttcagctggagctggatgaacaaaagcttccatgacagggttggagttcaggatcctctgttctatcctctctgcaatcttgtggctctcccaagatgcaggtgaggtggccaccacagcatagaacttcattaggcagcgagacgtccatgtctttccagcaccactctctccactgacaacaatagactggttgactggttcaatcaggctcttgacattcctgtaggtctgttcacccacagtgaacacatggggcttcagtttctggggctgaggcgcagcatggtactctctc

SEQ ID NO: 12745 - DNA, 404 bp, Homo sapiens
cgttgctgtcgctcaaagtaaaggatcgtaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcacc

SEQ ID NO: 12746 - DNA, 357 bp, Homo sapiens
tacggctgcgagaagacgacagaagggatatttcttcaattcacatgaaaacagcagaaagggagcccttatgaagttagaaaagctactctgaaccatgcttctttctacaagtttaggaaaacatttcacgtaaaaatgaacaacagattgtggtgatggttacacaactctgaatataaaacactgaactgttggctcacacctgtaatcccagcactttgggaggcggatcacaaggtcaggagtttgagaccagcctggtcaagatggtgaaaccccgtctctactaacaatacaaaaaaaaaagaaaaattagccgggcatggtggtacgtgcctgtagtcccagctactg

SEQ ID NO: 12747 - DNA, 361 bp, Homo sapiens
tacggctgcgagaagacgacagaagggcggggaggctgaggcagaaaaattgcttgaacccgggaggcggaggttgcagtgagccgagactgcaccactgcacttcagcctgagtgacagagtgagactccatctcttaaaaaaaaaaaagtttattctttcctgtggggtaagcagagctgaagttttaaaaagacagggggggatcttcattagggaactgggcaatgggcttctcatgttaacaatgttgacaacaacagccaaaaggaaaaatgtaaaaaccaaaaaaaaagctggcgcaggggctcacgcctgtagactggcactttggatggctgaggcggggattgcttgaggc

SEQ ID NO: 12748 - DNA, 375 bp, Homo sapiens
tacggctgcgagaagacgacagaagggtgataaagtgattctgcttctctttgacaacttgcatctctcctacatggaagtaagttttattcctgtcaatgttgtctttgtgtgtgacagattaggattaaattatggtttgacttttcctagcagcgtgatcatgggcaagtggcttttttttttttttgaaaaaaagtttattttttttccccaggtggaagggcaggggcacaatttgggttacttgaaactccggcccccgggccaaggggattttcgggtggaattttttaaagaagtgggaacccccccccccccgggttaattttggatttttaggaaccaacaagttttccccattgtgggaaaacg

SEQ ID NO: 12749 - DNA, 378 bp, Homo sapiens
cgttgctgtcggattccaggtgcatgctaccacgcccagctaattttgtatttttagtagagacggggttttaccatgttggccaggctggtctttaactcttgacctccaataatccacccacttcagcctcccaaagtcctgggattataggcatgagccagtatgcccagctgttacttttttttaagccattgggaaaagtgttttaagttacatcttgtttgctgatatataaactacaagttttctgttatgactttgaattcacaatctttctaaacttaattaattctaatttatctatttctatctacataatatctgtgaatgagttttcttttagaatcttacagcttttttgttcttacaatattg

SEQ ID NO: 12750 - DNA, 371 bp, Homo sapiens
tacggctgcgagaagacgacagaaggggggacgttatgtgaatcttaagtcttaccagtccttgcattagtacattaaatttggatgttttggaagcaaattcatacgatcgtgagtgatttctccaaagaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaacaaacaaacaaacaaaaaaaaac

SEQ ID NO: 12751 - DNA, 375 bp, Homo sapiens
tacggctgcgagaagacgacagaagggtggtcccagccccctaatgttgagggtttgggacaggtggcaaggatgactacagggagtcatctaagcaaactgaaagcaggattcagaaacatagtttaatcatagctcggtttactaaactataaaacattctgtccttttacttgaaagaactagctgaatataaatcacaaacttgaaaaaactacttggaaaccactagtttagtttttatttaaattttaaaaaatggtaataaagcacataacttatgtgacatggaagcaaatttaaaacatttatgagtaattatatttttaaagtattagataccttagctcaacaatagcatagaaagttaggctt

SEQ ID NO: 12752 - DNA, 348 bp, Homo sapiens
tacggctgcgagaagacgacagaaggggttctaagatttccaaaatactataaaatattctcatgttctcaaaggcagaaccagccttttaaaatttaatttaatcagcactttaaaaattatcctatgaattgatgggtgtagactagatagttatccctaactattttttgtctcctcataacagaattaaatctttttagctattgctatgtgtcttgcctgtgcatctaatggaaattgtatacatccttgcctcactgatttagggcttgataatatgacataatttgaccaatgggatgcaagtacaataaatttagctccatcctggcagaagcttcagcg

SEQ ID NO: 12753 - DNA, 348 bp, Homo sapiens
tttcaagcggtttacggctgcgagaagacgacagaagggtagcagactattaagatgttgagtaacaagggaaatcaacacggaattgtaggcctaaaccactggcttataaccagattatgggcccctttaagaatctgataagaagttcgcattttctttatccccagaatagacatacataaaaataatgcatactaagtatctggcattcatagactttccctaaatacattaatcacacattatcagctcctgctgttaaagatactacaggctcttgaaaaattccctcttagttctggtgtgaagtactaacagtgggttaattttcaacccattgattat

SEQ ID NO: 12754 - DNA, 379 bp, Homo sapiens
tacggctgcgagaagacgacagaagggagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcaa

SEQ ID NO: 12755 - DNA, 374 bp, Homo sapiens
tacggttgcgagaagacgacagaaggggcacaccgcgcgggaagggttatcaagtgccaaagatcaatgctacctaccacctgtacctgtatgggtgaaggcagaagacagggagctctactctgccttccactctccctatcttatctcccctttccctgagcaaaatattgtcacaatcaacctgtagcagatgtttcctgtgcttttcaaacataccaaaagtctgctcatctttaagtcaattccaccacaacaaagaggttgattacaaagatcgtcaaagagctcacatgaaaatagtgtttctctgtccatttaaaaattactcagctgatgcacttacaagcttctaatctacaataatgacgatt

SEQ ID NO: 12756 - DNA, 372 bp, Homo sapiens
tacggctgcgagaagacgacagagggggctccaaaagcatgaaacatttaatgttcattttaatgtttgtgcaaattctgtacaattaaatctgtaaaatatttagcactatttgtaaaatacttaaatggagacatatatcatgttcattgaacagatgactcatcaagataccaattatccacaaactgatcaacggattcaacgtaattccattcttagtctgtttatgctgctatgacaaaatacctgagactgggtaattcataaaaaacaaatgtattttggtaggtttggtggtctggttagggctatatgctcccgaggggagaaacaccatgtccgcatgtggcagaaggcagaagagcgaat

SEQ ID NO: 12757 - DNA, 378 bp, Homo sapiens
tacggctgcgagaagacgacagaagggagttgttaatgtccaaagctaacaagtaaccaacaaaaagttggttaaacattcttctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctgggggtggtctatctttctttctctggctctttttctctcctggatgctcagcttcct

SEQ ID NO: 12758 - DNA, 344 bp, Homo sapiens
tacggctgcgagaagacgacagaaggggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtgtgtgtatatctagtttctctatagaacatatatgggagagagaga

SEQ ID NO: 12759 - DNA, 347 bp, Homo sapiens
tacggctgcgagaagacaacagaagggggtggcgggcgcctgtggtcccagctactcaggaggctgagggaggagaatggcatgaacccgggaggcagagcttgcagtgcgctgaggtcgcgccactgcactccagcctgggtgacagagcaagactctgtctcataaaaaaaaaaaaaaaaaaacattgccttggggggccggccgcgggggtacaatgtccaacccggaaacctttggggtgctgggggtgctgttccccaagccaaggttttctccccccccggccccccccggggaaacccccttctttaataaaaatccaaaataacctggggctgggggac

SEQ ID NO: 12760 - DNA, 347 bp, Homo sapiens
tacggctgcgagaagacgacagaagggcacattttgttgctggctaaagtttctggcagtgaatctgatggttactttaaggactaagacaaatattgtcagttcaggtccttgggacctatacctcaagaacctggcctatgcctatagctgaccctctgtccagtacttccaaatgactagaatttctggatcaaaaacaaaagcaggcagatcactaagatttggtcagacacaagaaaataatggatccaagaaagcaagtttcctatggttaagaggttaagtaacaattgtaacaggaagagaaaaagacatgtaatctacacaaggagggtaggggcagg

SEQ ID NO: 12761 - DNA, 346 bp, Homo sapiens
tacggctgcgagaagacgacagaagggcacattttgttgctggctaaagtttctggcagtgaatctgatggttactttaaggactaagacaaatattgtcagttcaggtccttgggacctatacctcaagaacctggcctatgcctatagctgaccctctgtccagtacttccaaatgactagaatttctggatcaaaaacaaaagcaggcagatcactaagatttggtcagacacaagaaaataatggatccaagaaagcaagtttcctatggttaagaggttaagtaacaattgtaacaggaagagaaaaagacatgtaatctacacaaggagggtaggggcag

SEQ ID NO: 12762 - DNA, 346 bp, Homo sapiens
tctacgggtgcgagaagacgacagaaggggacagtggcaccacctgatttcatgatgtaccatatgcactaacacatgtttgaggtacagaattgaagctgatttttctgctaaagatgaatttctattaacaatcccatttttatattgtattattaaaacaaaaatacctctctttgctagagagtatatgtatgacttatattattaactatggtttgcatttaacacatggccgattgcctgtaaatctgcttattttaacaacatacggtgctgggcacagtggctcacgcctgtaatcccagcactttgagaggttgcgggtggatcacttgaggtcatg

SEQ ID NO: 12763 - DNA, 373 bp, Homo sapiens
tacggctgcgagaagacgacagaagggcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttac

SEQ ID NO: 12764 - DNA, 345 bp, Homo sapiens
tacggctgctagaagacgacagaagggcacacaagggaggtttgttgtaattgtctgctatatgagaagcttttgtgaattaccttgcactttctgacctgcctgggatccttgccagtgttaagtcactgaaagtgtgtactacaaaagacttccatccactattagctgatatcacagtgtgtatcaccttaaaatgcttagggagggcagatagctgtgctctctacctttatctggagttattgagtctgatcccttcgggcgaggcctcattcccactttcatggctggtttgggtgcagacatcatccaactttggacagaggatacaggctggcttga

SEQ ID NO: 12765 - DNA, 374 bp, Homo sapiens
tacggctgctagaatacgacagaaggggattgaagataagacgggaatttacatgggataaaagaaaaaaagtaccttaaatgaggacattcccatgtatgattaaaaaaacattctggatgtaaacattaaaaacggatttctgtgtgtcatcctaaagattttgagattcatgtattaatttgttttcagaaattaaagggattacaattgctagtaaaattgaacttcgtaataatattttctctggtattagattcagaaagccagcgattagaagagatgctaactgtgtttggaggtagcttctttatgaataggtaaaattgtattttcaaaaatttgtatcataaacaatatgtagtttccctgta

SEQ ID NO: 12766 - DNA, 351 bp, Homo sapiens
  misc_feature 351: n = A,T,C or G
tacggctgcgagaagacgacagaaggggcattcgatcttctaggtcacagaagactttgttagctggtatagcagacagggaaaagtgagcacattcccatctttaagagcactgcttctaaattctgtcactctttttgataggaaattaccctaacagcctcattttttccatcttagccttcacaacaaataataaataaagaaggagtgatatagtcatactgtattatacctacttactatacttattcgtagtgatactgtatgagagtactggtcaggggattgggtattgaaggttctagtgctggctctgatactacctagtagggcaatttagtcatgtcn

SEQ ID NO: 12767 - DNA, 345 bp, Homo sapiens
tacggctgcgagaagacgacagaagggtctccatggggtgcacagaatgtctgtgagactgatggagtggagaacgccatcccccagcctctccagctactcgaggcattctgtagaacataagcccatagattgtgtgtgtgtgtgtgtgtgtgtgtgcatgcgcgcgcgtgcgcactggaggaacctaagaaactatgtggcgcactttctcttattttagagctcccagagtgtagctccagaatcgtaaagggatatgctcagtctcacagccagccgtgggatctcagtcccaacactcacccttgtgctactgagtcagctctaagaaaatctgccaag

SEQ ID NO: 12768 - DNA, 368 bp, Homo sapiens
aattccgttgctgtcggcgccgggggcgcagcttatgagggcgccggacctgggaagccgattgcaatcagttgtcagacccgggaagcccgacgttccgctctcccgagtccctctgtggggtgaggaatgggtcttgtgaaattctgagcaaaaacaaaggcaaactctatctccgaaagggacgtttgggtcacatttcctctctgggggcggactccaaagttctcaaaatgagaaggcagaaatgaaaacacttcaactttttttttcttttcttcccggggcgggtgtcttgaacccctcttctccccgcccctctggctccgttctcctcccctcctccacccgtctcccggactcggggg

SEQ ID NO: 12769 - DNA, 347 bp, Homo sapiens
tacggctgcgagaagacgacagaagggcactagctgccagggcagttggctgggcactgagaggctgttggagccttatcttcttacttacttctggcctttccaatttgctctatactcctatccatgaaaaccaaccacaaatccatctgtactacctacccgtcatcttctctaaaagcaaacaaaacaccacacacacaacactatactgtcttaaaaagtctttgcaaatgcatacctctgtggattgaaagccctctcccagtcttcttatctcaaaggccaaactcaaaatctacttcagtgagactttcctccattctaaagcaagggctcccccaacc

SEQ ID NO: 12770 - DNA, 343 bp, Homo sapiens
  misc_feature 343: n = A,T,C or G
tacggctgcgagaagacgacagaaggggggaagctcagggttggacttttgatgcctcgcaaagctgtgatacagatacttacacatctaaaacagaagctgatgacaagaacgatgaaaaatgcatgaaagttgacttagtatcttttccatcttcacctattatgggtgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcacaagagagtgccctgcttn

SEQ ID NO: 12771 - DNA, 374 bp, Homo sapiens
tacggctgcgagaagacgacagaagggacaaacaatagctgagcacaggtagagcgtgaccagggagagcgcggatgctggcgcaggaaggctctgaggaaggctgcacacacaggatggccctctccagcttcacgtcctcagggttacagatacagccggggctggtggtcacagcaagcaccctccatcctctgctctgctcctaagggccccttctggtgtccagcctggggcctttgctaggtcagagccaaggggatccgtgggaagcatgtgatggggcagggcagagggctggggcgagggtggagttcagcacaggaggtgtgtcacagttggggcgtagttgttaagtgtggcctcatgtgtgt

SEQ ID NO: 12772 - DNA, 377 bp, Homo sapiens
tacggctgcgagaagacgacagaagggaactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaa

SEQ ID NO: 12773 - DNA, 371 bp, Homo sapiens
ggcacgagggcagaggttgcagtgagccaatattgcacccctgcactccagcctgggcaaccaagtgagactgcgtcttttaaaaaaaaaaaaaaaaaaaaaaaggggggcggaaatttggggggggggccccaaattttggatttttaaaaaatttggggccgggggggggggcctaacccctaaaaccccacctttttggaaggcaagggggggggaaaaactgggggggggggttcaaaaaccacccgacccaacggggaaaaacccccgtttttataaaaaaaaaaaattaacccgggattgggggggtggccctgaatccccactttcccggggggtgggggagggaaaactgtttaacctggggg

SEQ ID NO: 12774 - DNA, 347 bp, Homo sapiens
  misc_feature 214: n = A,T,C or G
tacggctgcgagaagacgacagaaggggtgggaaaggcagagaatgtctgaattcttgggtctcttcctaacctgattttgagagagccgtcatgaccccacccttatcctagccttattttctgcaatctcaatctgtgtggggtaggctggatatctgagggccttggcaattccttcctggaatatggggaggagaggagagaagagtcanggcccaggcttggtctagcctatggtcttgacagggggagagctttccacagccaggcctaccatcaggggaacaactggagggtcttaaacatgcccaggactcaaatccccgctcttctacttttgggatg

SEQ ID NO: 12775 - DNA, 329 bp, Homo sapiens
tacggctgcgagaagacgacagaagggactctggctgcccagacaacatccaggcctttccccgtaggcagcgctgccaggaggcagcagtgaaggtccccttggctctctggccccagcctccctccctgttccaccttctgcagttcgaggcactcgctttggcctcaggacacacctgccttgctccctctgcaggccataacatccccttcctctgacctcttctaaaatctcctctctcacgtggttccttcatactatggcccactggactactgagcctaatcatccaaaaattgaaaccccttttcttcaagggtgggaag

SEQ ID NO: 12776 - DNA, 325 bp, Homo sapiens
tacggctgcgagaagacgacagaagggaaaataatcatgaaaacgatttgcggaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccacc

SEQ ID NO: 12777 - DNA, 380 bp, Homo sapiens
  misc_feature 41: n = A,T,C or G
ggcacgagagagagagacatctgacttactgtagatgaggnacctcaatgcaacgctgtagctagctgtgacaactgattagtcctctgggaagacaagcgggttatatcctacgaaccatgtctgatcaattagtagtggctgcctagaactgcactggccaatatgtgaaccattggccacatgttgctacttaaagtgagaaattcattgcttcagtcacactagccatattacaagtgctctatgcccggacactgaacatttgcatcatcacagaaatttctattggccagcgctgacttagaacgtcatgttgggaagagaagtgaggccgtgtctaggaagcatgagagatcatcatggtccattagcaatgg

SEQ ID NO: 12778 - DNA, 463 bp, Homo sapiens
cgttgctgtcgctctcctcgaggtgccccgctgtgaccagcagacctgcacacagacgcaagacaggataaacatctgggaagcacaggtatatgaggcacagaaacacaaggcactgtggatgcctcttctgtctggacagaaaactggagtcaggagacctctctgagtccccagagacagaatcatcactactgtgtgtccttggaacttaaagtagtaaaaaaaaaaaaaacccggccgaaagttcacagcttgcaccttgaaaaaggaccctcacaaaaacccaaccatgctggtacctgatttgggacttccaaacttccaaaactgtgagaaaaaaaatatggttgtggtttataagccacccacactatggtattttattataccaccccaaccaaacgggtagggtaaaggtagggattttggccaatttttaccttacccctcaacattagaa

SEQ ID NO: 12779 - DNA, 420 bp, Homo sapiens
ggcacgaggagagagagagagttagagttatagagagagagagagagagagagagagagagagagagagagagagagagagagagagagagagagagagagagagacagagagagagagagagagagagagagagagagagagagagagagagagagagagagagagagagagagcgcccctctctctctttttttcgtgcgctcttgcgatagatatctttttttctctctcgcgcgtgttttctcacacacacacaaaaaagcgctctccccctacacgcccccccctctctgtggagtgtagaatatgtgtgcgcgtgctttctttctctctctctgtgaggggggtttcccccccttcgtttgtgtgtgggctctttatgtgtgttttctctcgcgcgcccgcacattttaaaaaa

SEQ ID NO: 12780 - DNA, 380 bp, Homo sapiens
tacggctgcgagaagacgacagaaggggtctgagtatagcaatatctgtcttcaaaatgcaattttcatccatcagatctttcatttcttcatgattatgaaaatcctaaataaaacaacagaaagttttagctagtactcaataaaataacatatcatgattacctctgaagttaaagaataacctgcacatccatgcactaaaaaggttactgtaagtggatatccaactggagaaaaagttgaagcaaaattttgaaccttatagagcataaattccaaaaagttcagaaatttatttaaagtcaatgaatttataaaagtaaacacgcacacacacatgcacaccagagagtttttaagagtttcagaattggaat

SEQ ID NO: 12781 - DNA, 450 bp, Homo sapiens
tcttcttttttaggatcccatcgactcgaattcggcacgagtggtgttccactagtatgttgaaaatgtcatatcatggagaatggagacaccttccaggtgtctgttaaacccatcttctctgtgtacttctggcatcttttttggtaggatcatttggcaggggggaggggtggaaggcttttggcaccattgaaaccagttctggcccatttgtttgaatagctaacatacacatcagctctatacgcttcatataccacctgatagaacccgtgaataatgctcttgaaagtgtaacactcatgcttcctaccacaagcaattaacataaagcttatacgccagctgtacgacgcccattgtttacataactcctctacttttaattcaaccatcttttgcacccctcgattcgatcagctccacctctagtctctacgtatcgtc

SEQ ID NO: 12782 - DNA, 398 bp, Homo sapiens
tacggctgcgagaagacgacagaaggggaagagctctagttctttgacagttgcagtgtcaatggcttcaagtttattgaatgtctcaaaattatgttttgagtaaggcctttgccttcactcaaatattcaaattattttcatcataatttaaatctccaaatatatagtgttttattttcagatatgatatatactggaaacaggggcaagtattctttatcaatatgatacttttagaaaataattgttttcatttttgtgaaatttatttcagacagtctcaaccgccagtgaactacagaaaccaatttactggattgtagctggtaaagcccttgattatgaacagatgctgcttctcatggctaatgtgaaatgggatgtagaaaaaaata

SEQ ID NO: 12783 - DNA, 408 bp, Homo sapiens
ggcacgaggagagagagagagagagagagagagagagagagagagagagagagagagagagagagagagagagagagactctctctctcttacatagctagatatacacatatacacacacagacagacacacctgggtttgctctccccccctctctggtgctcccagagctacgctttttttgtgatgtctctcgcgctttctctctttgtcgcacacctctactgcccccctttctctttttctctctcgcccgccttttttttttttttcgcacacactgcccggggtgaaactcgttcccccccccccgctctttctttttttatgtcacgctccccgagggaggcgtggctgagaatggcttccatggagtctccccgtgaatgcttttcctcgccacaccg

SEQ ID NO: 12784 - DNA, 399 bp, Homo sapiens
gatcaattcggcacgagagcatgtgaaaagtccctggggcagaatcaagcttggcatcttcaaggaaatgacagagaggcccatgttgcatgggtggagactggcatgagatgaggctggagaagggtcaggccacacagggctggataaagggctctgacttcattcttggtgtgatgggaagcccttggaggattttaagcaaaaatgtgccacgattcatgctggtgggtctgtggaagatggattgggataaggtggggagtaggctggaaggtggatctaccaaactccatcctgctatgaccgctgcccttaactatttaaaggaccctggctcgaaggggtgaggaggacattttatcggagacagagccctgagggacctgaccccatggg

SEQ ID NO: 12785 - DNA, 388 bp, Homo sapiens
  misc_feature 388: n = A,T,C or G
tacggctgcgagaagacgacagaaggggatgaggaagaaatacgaaagcagtaaaatgaacaatgagaatctgttacccaaactgatataaactccctcagaaagaaagatactactccctaatcctggaagtgttaagtggcaataatgatcaaatgttgtaaaggggattgttactacagctaatatgaaatgggaggctggactaaatctaacctttctacccttgatttcaattctaaaaggacacgtactaccattgcagaaagaaaagacagttccaaatgataaattttagagttgttttgctaggatgcaagagaaattggataagtggaccactcatacgttgctggtgagatatgaaatagtagagccactgtggaan

SEQ ID NO: 12786 - DNA, 409 bp, Homo sapiens
ctggagtgcagtggcaccatcttggctcactgtaacctctgcctctggggttcaagcaattcttctgcctcagcctcctgagtagctgggattacaggtgacccgcccacctcggcctcccgaagtgctgggattgcaggtgtgagccactgcgtccagtctcggcgccaagtttaagaagagcatattgtcatggccttacatcagttatatgctcctgggtaacaaactaccccaaaatgaagcgacttaaaacagtaagtccttgttcatcatcatgtgggagtatggatgtgggcagggctcatctctgttcactgtgctggccacgctagcaagggcaattaacagttggcaggtaggctggcttgtgcttcccattgccctcacccacatgggctttcagccc

SEQ ID NO: 12787 - DNA, 413 bp, Homo sapiens
ggcacgaggaagtaaccaccattcccacctttcactgcctaggctccaagtctgaatacatttttgaaataggaactcccttttgcaaaaaagaaacctgggtgtcagtgaggtgaagtgacttgccctatgagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctataacccacagaagactaacctgat

SEQ ID NO: 12788 - DNA, 401 bp, Homo sapiens
ggcacgagggaggcatccacccacccagtgggaatcgggatcgttcactgattcagcatatctgccctgggtgtccctgggtgtggcagtcgggaaggcaggctccggtcgggatggcagggtcggtggccctgaagaagcccccaccccagcagggaggcaggtatccagttagcaggagaaagcaaagtggatgatagatagcgaagggtgaggggatgtcaggtggagggcacagcaagtgcaaaggccctgatatgggaccaggaaaaggagctggggctgggcccaggtggaggaagaggcagcctgcaagagtgccagatgggccccagtgggttgtgtgtgcagaagtgcgctctggctcccaggtggagtggggcttataggggtcaggaaca

SEQ ID NO: 12789 - DNA, 414 bp, Homo sapiens
  misc_feature 317, 396: n = A,T,C or G
ggcacgaggtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcangaggtggtgtggggcgagggggccggggctggggaacccgaggcggaggaggaaggggactttgtgaacagtgggcggngagacgcataggcagagt

SEQ ID NO: 12790 - DNA, 398 bp, Homo sapiens
ggcacgagggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacaggt

SEQ ID NO: 12791 - DNA, 402 bp, Homo sapiens
cacgcgagccgagccaagatgtccaaccgagcggtttgtcgatattttagccacgccgggagctggtacacagcctcaggaccgcagctgaatgcacatctagaaggttggctttcacaaggacaggctacaattagacctgctagagccattattgccccccggagaattatcatccttgggccttctcatcatgtgcccctctctcgatgtgcactttacagtgtggatatatataggacacctctgtatgaccttcgtatcgacctaaagatttacggagaactgtggaagacaggaatgtttgaacgcatgtctctgcccacagatgaagatgaacacagtattgaaatgcatttgccttatacagctaaagccatggaaagccatattgatgagttt

SEQ ID NO: 12792 - DNA, 391 bp, Homo sapiens
ggcacgagaggacgtggagcgctgccttcgggacacgggtgtgcagggcgtcatgagcgcagagggcaatctgcacaaccccgcgctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggccc

SEQ ID NO: 12793 - DNA, 382 bp, Homo sapiens
ggcacgagccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagc

SEQ ID NO: 12794 - DNA, 386 bp, Homo sapiens
ggcacgagggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcgacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctca

SEQ ID NO: 12795 - DNA, 367 bp, Homo sapiens
tacggctgcgagaagacgacagaaggggtttgctataaacgtgtgtttatttagtcctaatgttgttaggatgattctcacttgttatttaacctcaccctgattttaccacaggcttatattgacataattttaacttagtgcttctcaagggagattggggtggagtcaggatgtttggaattaccttttggattgtaacagactattggccaggcaagctaaaagttttgcagtactgatgagctgtagggggaagaattgcttcagccaaaatgccactagctccccttttgaaaacagtacaagtttaacttaaactaaatcttaatgacagtgaaagttaattcccagttattatctttga

SEQ ID NO: 12796 - DNA, 357 bp, Homo sapiens
tacggctgcgagaagacgacagagggggatacaactaaagaaagagatacacgatgacctagatatatgagtgaagaaattatccagaatgtatcacagagaaggaaatgggcaaaaagaaagagggtaagatatatatttataaacacacacatacacatattacataaaatgagaaagtgacatgtctttcattagttttccaagagcagaagggaaaaataatgggaaaggaatagacaatatttgatgagataatagttgagaatgtttcagagctgataaaaagcaccatgacaaatttgagaagctgagagaactgcaagcagaataacgtaaagaaaatatgcttctaag

SEQ ID NO: 12797 - DNA, 376 bp, Homo sapiens
ggcacgaggggctaccaatttgagaccattggtctggtagatacactttcattaatatacttactccatcactctttctatattttagaagttactagtagaaatgtatgcaggagtcactggagaccttattaaaatgcagcttctgattcagtgagctggggtggggcctgagagtctgcatttctcccaggctccctggtgctgccagtggtgctgctctgagtaacaagggggtggggaatgatatggagccgtccattattatcccatctgacaaatgagtcacagagcccttaggtaattgaggtgggatcagtctgattctgtaagctgtgttttcagccacaacatttactgcaaacttggagtaggg

SEQ ID NO: 12798 - DNA, 367 bp, Homo sapiens
tacggctgcgagaagacgacagaagggtcggtaaagattatttaggttcccctgatttttctaagcagtttaccaggtgtttacataagtcatggaaaaatatggatggtacattcttggaacttcatgttctgagcaggatagtgacttcctattgtacttgacaggatgaagtatctgcaagatgtgccttcaggcagttaaataacttgacctgctgttagaaatcttttttattttttattttattttattttggtttatttatttatttttttgagacggagcctcactttgtttcccaggctggaatgcattggtacgatctccgttcacacgctctgcctcctgggttcacgccattctc

SEQ ID NO: 12799 - DNA, 364 bp, Homo sapiens
tacggctgcgagaagacgacagaagggagtggcaaatgttcatgctggcttaaatatcgtttggtactcttactcctctggtttggatttacaggatccaaaccaaggatccaagcctttagttggttaacagttagttgattagttggcactcattttgtcacatgattcaggatgactgggggaaaacaggatattggggtatatctttaactttttcacttctaagataatctacagtttccctacctctcgctcataccttccctatccaagatcagaacttcagaccgtccccatgggaatatgagggctgggtagaagggagaggaactagttacaggtatttctgaatttcagtttg

SEQ ID NO: 12800 - DNA, 369 bp, Homo sapiens
tacggctgcgagaagacgacagaagggtaaggtgctgggatatggctgagaacaaaacaaagtccccatccgcacagagctgacattctagaacagaagatagacaataaacaaggtacacaggcaaaatacatggatgttggatgaagaagaatcccatggagaaaaaaataaaacaaagaaggagagttgctatgacagtgaggccaagataattgcaggaaagtagccctgataccaaggagacaataaaccactacttcaggacttctagttatttaagacaaataaactggttttggttaagtctctgttaatttgtttttctttacttacagctgaatgaattcctgagaccgtgtgtaggaa

SEQ ID NO: 12801 - DNA, 334 bp, Homo sapiens
tacggttgcgagaagacgacagaagggtccaggtaacaaccctgcacatatatcccagaatctaaaataaaaatggaaattataaaaaaaaaagaaattaaattgtgaagaagacaaagtatcaaaagaccttttctgttagagtctaacaatgttcaaatttagcttcttggaaataacttttaaatagctaagagcgtcaacagaaaactgtggactacaggaaaagaactgcttcatatttcccgaatcttctcaaacttggtatctgcatatcaatgactttagattttatttttatgttgctgttacttttgctaaggaagtattatgg

SEQ ID NO: 12802 - DNA, 341 bp, Homo sapiens
tacggctgcgagaagacgacagaagggagacgaaatagtactcatgagaaaacctacaaggaaatagacaatagaatgaggcagaggttgcagtgagctgagatcacacattgcactccagcctgggtaagaagatctcaaaaaaagaaagtgtcatcatctactagattggaaatatcagatattcttgagtctttcttctccctcatatacaggtagtcatccagttcttcaaaatctcgttgaaatgtggcttcccctccagccagtctactgcctatcagtacttacctgtctgtgcattagcccccaccgacctctatcccaccagcatctgcctg

SEQ ID NO: 12803 - DNA, 352 bp, Homo sapiens
tactactgctgcgcgaagacaacagaagggacacagaataagttctatagatctaatgtacagcatggagactacagttaataatactgtattgtatatttaaaatttgcaaagagtagatcttaagtgctctcaccaccaaagaaaggtaactgtgaaaagagatgtaaactctatctggactagagtaacctcagttcactaaggtcattatgaatatgtatatcagaacatcatgctatacacctcagatacacacaatttcaattaaaaaattttaaaaagaagaaatcagtctgtgtcacattccagtgatctttgtttcatacattgctttggctgaaggaagggg

SEQ ID NO: 12804 - DNA, 344 bp, Homo sapiens
tctacggctgcgagaagacgacagaaggggggaggatttttgatttttctactttttgttgaaaaaaggaatttgtactctgtgcattggatggacttgtttggtacttgggattttcctctcttaaccgtcaacatcagtgttggaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagaactgcatgctgattatcactgcctttactccttttttttt

SEQ ID NO: 12805 - DNA, 335 bp, Homo sapiens
tacggctgcgagaagacgacagaaggggttaaaaaagaaccatggagacggatgcattaactaagcccaggggtcctttttcaatcctcatctcacttgacctgttggttccatttaaccagatctcttccttgaaacgtttttattttttttttactttgcttccagggttttgttacatgtttctgttacatgttaaacttctttctgttggagtgccccatggttcagtccttccacttctcttttctgtccacactctgggtccaatttcattcagattcattcatgatgtaatataccacctataagctgatttcgacacttaagatcag

SEQ ID NO: 12806 - DNA, 334 bp, Homo sapiens
tacggctgcgagaagacgacagaaggggttccattcctggcttgatggtgtccttgagacaacagctggcattcacagtacaggtatttagtactggagggagcacagcagaacttatctttaaataattgcatttttttttttgttttgacctgtatgttggctcccaaaaggaagggatcaaggggtttgcctttatttctcctaattcaaaacataccagggttttcaacattctatcaaaaacttttaaaggcaaatgttaaaatcactccatctcactcaaaggatagcatttaggagaaacaatagaccaatcaataagcttgggagg

SEQ ID NO: 12807 - DNA, 338 bp, Homo sapiens
tacggctgcgagaagacgacagaaggggaataacccagaaaatatttcttactgttgataatctgcagtttgcaagtgcagcgaatcttgtaggtagatttaccttgagtttttttgaaacggtagaattaatatattaaaacatatggtttttagttaaaataggatgttaaaggaatagagcgcacgaacaaaaaaactttccacttgaacccatgttgtttcatctgacagtgggtatggtgtccctggcaggatagggcttccacctcctgctggtgccggtaggacagggaagaggtggggaacactgtgtctccatctcccaagcatcttaa

SEQ ID NO: 12808 - DNA, 347 bp, Homo sapiens
tacggctgcgagaagacgacagaagggggaaaaccaacgtgttcggtgacagaccccagcgccgactgagcctctaaagcgacttcagctctgccccaccaacaccaccgcgcgcccgggaacagccgctccgggaagaaacctgaggggactgcggggggcacgagggacagctgagggaagggaggacgcgagagaaacagcgcgagcacgctgagggccgggggttgccaggagaggggcccgcggacccgcatagcggaggaaggtccgggagaaaaggggcgggacggaggagaatccgggatcgcctggcagaaaaagagaagggagtttctgaatcctgg

SEQ ID NO: 12809 - DNA, 378 bp, Homo sapiens
ggcacgagggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcacggggagaaggtccttcttgcgctaggtcaaggtccccgcctggagggggccaaacccc

SEQ ID NO: 12810 - DNA, 432 bp, Homo sapiens
cgttgctgtcggtctttcagtaggagattggtttaataaattatggtacatttccttcaatgactgtgcagtcctcagaagagattaggctgatctttaccaattgacgtgaaaagatgatgatattaagtgaaaaaaaaacaggttgctggctgggcatggtggcttatgcctataatcctaacactttgggaggccaaggtaggaggatcgcttgagcctaggagtttgaggctatcctgggtaacaaagtgagacccatctctacaaaaaaaatcaagaaattatctggatgtggtggcacatggtcccagctacactggaggctgaggcgggagaatcacttgagcccaggaggtggagtctccagtgattcatgtttgtgttattgcactccagcctgagcaacacagtgagaccctgtcttaaaaa

SEQ ID NO: 12811 - DNA, 434 bp, Homo sapiens
  misc_feature 2, 3, 4, 42, 43, 44, 45: n = A,T,C or G
annncaattcggcacgaggagagaactagtctcgagagcagnnnntttttttttttttttttttttttacaaaatgcccccttgggcccaaggggcaaaaatttacctttgcttaggggttttttttttttaaaaaaccaaccggttttaatacccctcctttaccccctggaaccattggggggaaaaaaaccctttgggaaaaacccatttttcaaaggaaggtttccccgggggggttttaataaaaatattgttgggaaaaaaaccaaaaagccctttgatttaaaaaagggataaagggaggggccctgaaaaaccccccccttttttatttttttttgggggggataaaacctaaaaagaaaaagggtttttcgcccttaaaaaagaaaaatttgccccccaaaaataaccccccttaaaaaaatttt

SEQ ID NO: 12812 - DNA, 425 bp, Homo sapiens
ggcacgaggagagaactagtctcgagagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattaaaatacttgttgtaaaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatggctcccatgtttctcatttgctgattgattcattagttgctcttaagaagatttcgcagttggaaataatg

SEQ ID NO: 12813 - DNA, 403 bp, Homo sapiens
ggcacgagaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatgg

SEQ ID NO: 12814 - DNA, 387 bp, Homo sapiens
  misc_feature 387: n = A,T,C or G
ggcacgagagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccactgaaagttcgaaggattaaatctgaaaagcttcacctcan

SEQ ID NO: 12815 - DNA, 405 bp, Homo sapiens
  misc_feature 393, 405: n = A,T,C or G
cgttgctgtcgctcgtaaatgtcataaaattttttaacattttgcatcaggactcaataaaagcccagcatcataattgactgaaatgtctttttaacttcttttcatctataagttctccttctataccttttattatcattataattattattactaggtcattcatcctgtagattttccacagtcaggattttcctgattgtatcaccacggttgtaggattctagaggcttgaacatattaacattcaatagttgagggagatgcaaaaccactctctaggtggtgacgttattccatcaggaagcacataatgtccaattggctatttagtggtattagcagctacttatacataatagatccagtaaatcatgagagactggctgngtatggtagctn

SEQ ID NO: 12816 - DNA, 419 bp, Homo sapiens
ggcacgaggcaataatcaacagttctaagcctaataaagagagctcttaatcagctcagtggtggttaaaaccagctatcttttaaagaagagaaaaaacaaaacacagcaatgccctgtctcttcagaaaattgttttaaaaagttagccaggcatagttagtggcccacgcctgtagtccgagctgtttgggaggttgaggtgggaagattggttgagcccaagattttgaggctgcagtaagccataattgtaccactgcactccagcctgagcgacagagaacaagaccctgtctcataaataaagtgggggaaggggtgcaaaattacactgtgagaagccaagaagtttcaaagttctatttatttttctaagtcattcttaatcattatttggtgtttcagtgtttgaattt

SEQ ID NO: 12817 - DNA, 387 bp, Homo sapiens
tctacggctgcgagaagacgacagaaggggaaaaatctctggtcatctccgagaattaacttgcaactgttttctatagtgctgtcgtcttgggcaatgggcaattacatgactttgtgtttgcttcctttgcagtcttttttttttccccccattttttcctaataggaaaaaaaaaaaaaaagggcccccctggtggggcctatttctggtggcgggaaactttgaagtcccaaaaatttggagggggggtttttttacccttgggggcggggggggccggtttctaatttttaatttttttaaaaatccgggctaacctccgggggaaaaaaactggaaaccgcttttattaaacctttctttataaaaaattttttttttatg

SEQ ID NO: 12818 - DNA, 411 bp, Homo sapiens
  misc_feature 411: n = A,T,C or G
cgttgctgtcggccacgaacacagccttgggcccttggtgatgcgcgccgctcttgagtcggtcagatgccaaacgcaaaaaaaagccttctcctctaaagacacggaaatgcaccgagtccggctctgactcacccccaaatccttacggtcccccaactcggcagccaaaatcgaaaactactctcgtctcagcgcccccgctgttgattacctgccattccgcacgggcgcctgcgccccggccggtgtcgccgacttcggacggcatcccgagactacccttctcaaggccgtatgaccagtccgagctgccatgatagactctccgaagccggtcgtgacctcccggaccagccctgcagcaccgacctcctctggtcgggcccggagcccggctccggtctcttn

SEQ ID NO: 12819 - DNA, 407 bp, Homo sapiens
ggcacgagaaggccgtggggctggagcatgtgggtgcctgctggggagcctgggtcagggacagggtcatggagtgtaggggactggaccacccagggcatgcgagtggctgagccaggttgcgggcagagggtggccaggggcccatgggagcatttgcaggtgagctccctggggagggttactgtgggcgtggacgaggctgcctgggcgtgtggctcagggccgggcctggtgaggtggctgctgcagggtggctgatgacagacaggtcttggggaggaggacccgggactcgggatgagcctgcgtctggctgggtggtgcctgctccttgttttgtggtgggagactgaaggggagctgaggctttggcggcaacgggccttgtccagtggggcattttt

SEQ ID NO: 12820 - DNA, 401 bp, Homo sapiens
ggcacgagcacagtgcccttggaggtgttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccat

SEQ ID NO: 12821 - DNA, 375 bp, Homo sapiens
  misc_feature 329, 340, 375: n = A,T,C or G
tacggctgcgagaagacgacagaaggcagacatacgggcacgcaccaccatgcccagctaatttttaaatttttagtagatctgcggtctcactatgttgcccaggctggtcacaaactcctggcctcaagtgattctccttccttggcctcccaaggcactgggattccaggcatgagccaccatgcgcagtctcatttctgttttatctagaacatgttttcatcacactgacttttttgagaagtccaggccaattttaaatttcattttgtctttttatcagtggaaaagtagcatatttatgttgcacgacaaagatgaatcanataggaagaanatgtaaaacacatttggggccgggcacagtggctn

SEQ ID NO: 12822 - DNA, 350 bp, Homo sapiens
tacggctgcgagaagacgacagaaggggatctgtcttttgaaacacataaacatgtacatacataaacatacaaattgctttcaacggtttatggaatatcttatagcaaattaaagatgagtatgtttgtcattcaattatgaaagatgttgatataaataaatttattcatatatttcaaaaagtatgtagggcttccagtcaaggtaaagaaacagagaccacatttactgtcttccctataatagaaaaaacccagaaaatttatgaaatgactgtttttttagacattggacaacaaagaacagtgacctctgagacacaggatacaagatgagccctaaaagtg

SEQ ID NO: 12823 - DNA, 369 bp, Homo sapiens
tacggctgcgagaagacgacagaaggcagacatacgggcacgcaccaccatgcccagctaatttttaaatttttagtagatctgcggtctcactatgttgcccaggctggtcacaaactcctggcctcaagtgattctccttccttggcctcccaaggcactgggattccaggcatgagccaccatgcgcagtctcatttctgttttatctagaacatgttttcatcacactgacttttttgagaagtccaggccaattttaaatttcattttgtctttttatcagtggaaaagtagcatatttatgttgcacgacaaagatgaatcaaataggaagaaaatgtaaaacacatttggggccgggcacag

SEQ ID NO: 12824 - DNA, 372 bp, Homo sapiens
tacggctgcgagaagacgacagaagggtagcacactgaattatggggtgtgtgtttgtgtgtgtgtgtgtgtgtgagaattctaagctaccttgtgattctcataattagctaggttttgaaactcttgtgtgatatggtttttattttgtattttttgctttatgtaaaacgtcaatggtttgctgactctttaatcttacaattattttacatttgaaccttgcctctagccccatatatttaagtactttgaatacacatgaataaatttagttgaccattaacaggagtgggtgccaacatttcttaacctactgtgttattttaatctattttgagagatggggtcctgctctggtgcccacgctgg

SEQ ID NO: 12825 - DNA, 363 bp, Homo sapiens
  misc_feature 279: n = A,T,C or G
actacggctgcgagaagacgacagaagggattctcaattgcaaatggttgaatatccaactccagatggcttccttaagcaacaaaaggagtttcttagtttgagcagaggttgatccagtgagtcaataatgtcaccaagaaatgtgtgtgtgtgcgtgtgtgtgtgtgtgtgtgtgtatgtgtgtttccatgtgtcttttgtgccatctatatcagtttcaccctattgttggagagtgactcatgctcacatgatgggtggcaacaattacagagntaatgtttttctcatatacatttaaaatttgacaaagagacaaagagatatctttgtcttatctcagccttttaattcgcaccg

SEQ ID NO: 12826 - DNA, 375 bp, Homo sapiens
cgttgctgtcgcataaatttttgtttttttcactgatggatctcaatgcttagaacagtgtctggtgcatagtagaagctcaataaatgtttgttgaatgaatgaacaaatgaaagaggtggctgggggtatgctgttttatataaggtggatcaaggaagggctctctgataagagaatgtttaagcagagatggaatgaagtgagggccagaatcttgctcatatctggggaaagcatctctgggcacaggaagagccagtgttaaggccctgagccaggaacatgcttggtccttggaggaacaccacatctgcttgtgactgaagtccagtgagagtaggaaagaggagatggggagtgaaaacagcatag

SEQ ID NO: 12827 - DNA, 374 bp, Homo sapiens
tacggctgcgagaagacgacagaagggccacgtggaactgtaagtctattaaacctctctttattttgtaaattgcccagcctgttatgtctttatcagcagcttaagaatggattaatacaccccacaaagaccaatcagaggcatcatttctccccaaacttaaagtcttaactgcttccccgagttgctgattatataattattgaaaaataaaatataaagatgcagcaatacatttgcaatatttatatttctattatcataattcccagagtggttttttagacctatctctaagtatatatagattcaataccaattcaatgagttctctaacccagagatctttgatttatcttctatgggtaggc

SEQ ID NO: 12828 - DNA, 352 bp, Homo sapiens
tacggctgcgagaagacgacagaagggtcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggtcatgaatgaaaaacttcagcactgcatggaactaacagatctaatgcggaatcacctgaatgagaagagggcactccgcttgg

SEQ ID NO: 12829 - DNA, 340 bp, Homo sapiens
tacggctgcgagaagacgacagaaggggatcagcctgggcaacatagtgataccctatctcttaaaaaagaagaagtttttaaatttgaaataataataggtactggatttatgcaaatgtcttttctgcgtcttttgagatgagtatcaggttttttttttttccttttatcatcggaggaggaacttaaggttcccatttgtattaagggaaaactaagcccctctgtgatttctgaaccaagctattcctaggcctgagttttattttgttgacccaaaaataaattaaaaggccaaccgtgggggcatgtccctgtagccctagttgctgaggaaa

SEQ ID NO: 12830 - DNA, 339 bp, Homo sapiens
tacggctgcgagaagacgacagaaggggtactttttatatcaagtactttgtatttagtccttagcttgggaggcaagtattgcaaactcactgtacctttgatgataaaagtagctaacgttgattgagtgctctctatgtcctgggccctgttctaagaactttgatgcatccttatttagtgcttaaaataaacctaagagggctaagtactattatgatttccattttacacgaaaggaaactgatctgccaggtcacatacctagtaagggattgttctgggctgaagaaaaaggatgcatggaggggagtatcttgcccaaggtcacgttatg

SEQ ID NO: 12831 - DNA, 334 bp, Homo sapiens
  misc_feature 334: n = A,T,C or G
tacggctgcgagaagacgacagaagggatgtgacatggactcatgcaaagagcagaatcttattcaaagttgagcattcccgtttatgaattttatccagatactctaagttgtcaatgtgaaccctggtcagtaatcttcagcgaggacagtattattgcttttcatgtaaaacctcaattattaatagttttaaatgacaatttttctttagtatatctaaaaatattttgttcaaatataatcaagtggaaaatattggacagaaatgagtcatccacaaaaagtatcattgaaactaggggaattagagctttgaatataaactttctan

SEQ ID NO: 12832 - DNA, 344 bp, Homo sapiens
  misc_feature 344: n = A,T,C or G
tacggctgcgagaagacgacagaagggaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtn

SEQ ID NO: 12833 - DNA, 337 bp, Homo sapiens
  misc_feature 337: n = A,T,C or G
tacggctgcgagaagacgacagaaggggattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcatccctcctcccccatcataaccatattcagcacccattttaaatctacttttcttccttatttgtgctacagaggttgatggcgtaaattttcctacttggaagaaattactttatcagttaatttcagggtn

SEQ ID NO: 12834 - DNA, 342 bp, Homo sapiens
tacggctgcgagaagacgacagaagggggctttccgagcccgcttgcacctcggcgatccccgactcccttctttatggcgtcgctcctgtgctgtgggccgaagctggccgcctgcggcatcgtcctcagcgcctggggagtgatcatgttgtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgcc

SEQ ID NO: 12835 - DNA, 390 bp, Homo sapiens
ggcacgaggcaatctgggatggtgaattttatgtatccacttgactgggccaggggctacccagagatttagtcaaatatgatactgggagtttcagtgagaatgtttctaaatgagattgacattggaattggtagactggggaaagcagatggccctccctaatatgggggtgggggggtgggtggcgcttcatccaaccaggggaaggcctgaatagaacaaaaaggctgagtaagagagagttccttctgcctgacagcctttgagctgagacactgctttttgggctgagctgaaacattggctccttctgggtttcagagcctgccagtcttcagactggagctacaccacagctctcctgggtctcaggcttgtagactgcca

SEQ ID NO: 12836 - DNA, 367 bp, Homo sapiens
tacggctgcgagaagacgacagaaggggtagtcagaaaagggtcattgtttttgcattgttgtaaatctttttaatggctcgcttaatagaacatagctagattctcatttacttcctctttcagtctgtaaaactattacatgtcatgaagcctctagaaaactcagctcagcggggcgcggtggctcaggcctgtaatcccagcactttgggaggccgaggcgggtggatcacgaagtcaggagatcgagaccatcccagctaacaatggtgaaaccttgtctctactaaaaatacaaaaaattatccgggcatgttggtacacgcctatagtcccagctgctcgggaggctgaggcagaagaat

SEQ ID NO: 12837 - DNA, 412 bp, Homo sapiens
cgttgctgtcggccacgaacacagccttgggcccaagtgtgatgcgcgccgctcttgagtccctcagatgccaaacgcaaaaaaaagccttctcctctaaagacacggaaatgcaccgagtccggctctgcctcacccccaaatccttccggtcccccaactcggcagccaaaatcgaaaactactctcgtctcagcgcccccgctgttgattacctgccattccgcacgggcgcctgcgccccggccgctgtcgccgacttcggacggcatcccgagactacccttctcaaggccgtatgaccagtccgagctgccatgatagactctccgaagccggtcgtcacctcccggaccagccctgcagcaccgccctcctctggtcgggcccggagcccggctccggtctcttc

SEQ ID NO: 12838 - DNA, 394 bp, Homo sapiens
ggcacgaggtgagacaccgtctcaaaaattaacataaacaaaacaggtcaaaaatcagttgcacaagttgtatgaaaccaggtattctgcagctctgtctcttgtttattaagatatgcacagtttctgaatcaacaaatatatctgtgattcttttatactactacataaaagaacaggagtaattcttgccttataaattaaatgtcaaacatttcctatatgtaatcatttgttcctaaaatatgatttagtcccagcatgcttatccctgttttctctttttctctccagctcctatctagttcttcaacaaatcctgtcaactctaccttccaaatgcctcttgaatccagccatctcaccacctccaacactaccaccatttttcttg

SEQ ID NO: 12839 - DNA, 448 bp, Homo sapiens
gcaggatcccatcgattcgggctggtgagacacgatcccctcctaagaaaatgtatgtgctcagacaggtaaccactgctgctactgtttttatttgtttgtttgttcaattttatttaagatttgtttttgttgtactaggattttaaaaaatgtaatatattgcaggatttataaccaggttcactgactgcttgcttgctttctttttttttttttttttcctccaaaaaaaaacaaaccaaggttttttttaaaaaacttttagccccctttggacctggattttggaaaggttccaaaaggggacaaaaatctgctgtggaaattttttatttttccgggttaaattgaaaaggtttttatttttgtttggaattttgggggggatttttatttcttttttcccaagccctttttgccatcctggttgggggggggggccaac

SEQ ID NO: 12840 - DNA, 347 bp, Homo sapiens
  misc_feature 164, 347: n = A,T,C or G
tacggctgcttgaagacgacagaaggggaactcagcatagcggacttttttgtgcaactaagcattgatgccctgggagctctttgagctgtactgacagcattggctgtccccatctggcttttctcatttcttaagtagttatgtggtctccaggaggcagncactgctctgtccgtattgtcagtatccttgatggtcctctttatggtttgacactggaagaccctgcaactgttcacttgggcctttttgaaatgctaagaggcttggataccttttttagatgtaccaggaaaagaaatagtctatgccttgcagtaaactcttaattctaccagtggggn

SEQ ID NO: 12841 - DNA, 402 bp, Homo sapiens
  misc_feature 402: n = A,T,C or G
cgttgctgtcgggggtccccaccccgatcccaacgcctgggcctctccttctcctgtccccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtgggcttctccctcttggctgccttgctcctggctgtggggctggcactgttggtgcggan

SEQ ID NO: 12842 - DNA, 371 bp, Homo sapiens
tacggctgcgagaagacgacagaagggtgatctactgaggccccctcctcagggagctagatttcctcagggtgcctgtggagagatgaaggcactggctgtggagcctgatgggcctgggttccagtcctggcctcaccactttgagctgtgtgatctcgggcaacaccctgaagctcttggatcccctgttctctctgggcggggacattgtctgcctcacagggcaattgtgagggttgaaggagatgttacgggcggttgtaagcagcgggttacaaagctgctcctctccccatacagggggtgagcttcattcattcattcctcttatgtcagtggcctccagtgggaccccccatgccaaggcc

SEQ ID NO: 12843 - DNA, 350 bp, Homo sapiens
tacggctgcgagaagacgacagaagggggccgctgccttcctggagcaggacagtcagggagctcactgctttctggaggaggaatgtaggtgagaccgggacaggaaggggtatgggtgcccacaaccggctgatgtgaaggagtcccacttagggatccaggaacagtgggaatagcactgctgggggccaagaggggcacttgctccatgggcccaagcagtctagacaccttgggggatgagggagcctcccctggtgtcaggagagccctggggtcccccacacacagtgagggaaggggaaaacccacagcacttgcctcaaggctgcaggttttgaagacctt

SEQ ID NO: 12844 - DNA, 347 bp, Homo sapiens
tacggctgcgagaagacgacagaaggggacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggg

SEQ ID NO: 12845 - DNA, 345 bp, Homo sapiens
tacggctgcgagaagacgacagaagggagacaaaatagtactcatgataaaacctacaaggaaatagacaatagaatgaggcagaggttgcagtgagctgagatcacacattgcactccagcctgggtaagaagatctcaaaaaaagaaagtgtcatcatctactagattggaaatatcagatattcttgagtctttcttctccctcatatacagttagtcatccagttcttcaaaatctcgttgaaatgtggcttcccctccagccagtctactgcctatcagtacttacctgtctgtgcattagcccccaccgacctctatcccaccagcatctccctgtggc

SEQ ID NO: 12846 - DNA, 346 bp, Homo sapiens
  misc_feature 346: n = A,T,C or G
tctacggctgcgagaagacgacagaaggggcacaagacgggatggcaagggctttcagacgcatttccaagagtccagcaagccagggggaagatgatccctttgccgaagcgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaagtgctttaaaggcagtctgcatcttttcttcccttggtgtgggagaggtaaacactttgatttgctgan

SEQ ID NO: 12847 - DNA, 341 bp, Homo sapiens
tacggctgcgagaagacgacagaagggcttgcctatttttaatattattaaagcctttctccttcagtagtctattttcttagaataacaactcttttatctattctgaactctattttttttcttttttaagagacaaggttttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactaaaaattgacattgtg

SEQ ID NO: 12848 - DNA, 343 bp, Homo sapiens
tacggctgcgagaagacgacagaaggggcacaagacgggatggcaagggctttcagacgcatttccaagagaccagcaagccagggggaagacgatccctttgccgaagtgcactctctagccaacttttgggagcgcttatgcttgcaaagcgctggggatgagcctagctctgtgtgacccacgaacgggaaggcagagcactggagaactgacgcttctgctgctgctttgattctcaaggctgatctttaaaaccctcgccttgctgacaggtgctgtaaaggcaggctgcatgttttcttcccttggtgtgggagaggtaaacacttagatctgctgg

SEQ ID NO: 12849 - DNA, 342 bp, Homo sapiens
tacggctgcgagaagacgacagaaggggcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctg

SEQ ID NO: 12850 - DNA, 400 bp, Homo sapiens
cgttgctgtcggcgtgtgagtgtgtgttcgcgctcgtgcgtgtgtatgtgtgcgtggggggggagagaatgcacaaacactcgaggtggtttgtatatttgactggtgaatttcatagttgtttttctggggttacttagaatttgagagtccgcgagaagcattaagaagaacattactgataaaaaaggaggggtgggaagcccctacacttctccccgagggtatccccgctgcaggcttctttatatgtttggattccccagacctcttgttttgaggcgtgatataaattcaccctctcatacatttaaaaatatcggttgaacacctgctatattctaggcaccgacgagacagcagtgagcagacgagaatgcctgctctcctggagccacaa

SEQ ID NO: 12851 - DNA, 417 bp, Homo sapiens
ggcacgagaggattcaaagcaggcacagtggtgtacacttaaagtcccagctactagggaggctgaggcaggaggattgcttgagcccaggagttcaaggccagcctgagcaacatagtgagactccatctctaaaaaaaaataaaaataaaaataaataaaaaatacaactaatggaaagggcaagaaaaaaaaaagaaaaaaattaaaagtgattcggagcagtattcctgcaaaaagctcccggcgcatgtatatttacagaaaatatgtacatgcagcaggcccaaaggccaccaaagggcaaagggcttctgtaacagttcaagcctctggctgacccagggactggctgcttcacacttgcccccatggctccaaaggggtaggagacaggttccctcacaccggaggcaa

SEQ ID NO: 12852 - DNA, 404 bp, Homo sapiens
  misc_feature 404: n = A,T,C or G
cgttgctgtcgattcagtataggccatgctcccttttattaagatgcaattttcagaatatgtagactggcttagatgaaatttgatcaatttatttagttgctcttctgcgtttgctaaaagtgcagtggtgggtggcatcacacagtggtcggagtcagaactggcttttgataccagtagttgacctttgacaagtatttagtctttttaattgtagttacctcactggaaattaaggagaaaataacaataacctttttcatagcattgttgggtagattaaatgaaataagtaagatgcctaatatgatacttagcacagagtgaacacttggtaaatagttattgttagctaaaaggcgtagtttccttgatgcccaaatggaagattccatttcagn

SEQ ID NO: 12853 - DNA, 389 bp, Homo sapiens
cgttgctgtcgttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtgccccacatcctctcctccgggacagtcaccgaaaacacaggttccaaagtctacctggtgcctgagagcccagggcccttcctccgttttaagggggaagcaacatttggaggggatggatgggctggtcagctggtctccttttc

SEQ ID NO: 12854 - DNA, 399 bp, Homo sapiens
cgttgctgtcgcttccccaggggcccctgagttcagtcctgtccgtctccagcagacgccggcttcccgggggtgggaggctcccctgagttcagtcctgtctgtctccagcagacgccggctccctgggggcgggaggctccgggcctccccagaggtgtttccattctgctcccatgtggcctcttcattttgtcgttgtcccctcctcatatacactctctttcatttttaaaccataattactgtagacaaatttaaaatacaaaaatgttaaaaagcagcaagaacaatcttaatctttttttttttttgaaaccgccctgctttgcccccccggttggaggccaggggggcatccccgtttcattgaggcctcaacctctggggttcaagcag

SEQ ID NO: 12855 - DNA, 403 bp, Homo sapiens
ggcacgagagcgaccggttatcctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttgga

SEQ ID NO: 12856 - DNA, 379 bp, Homo sapiens
tacggctgcgagaagacgacagaagggttgggaggctgagggaggagaatcgctcgagcccaggaggtggaggctgcagtgagctgtgatcatgctactgcactcccgcctgagtgacagtgagaccttgtctctaagtaaataaatgttctgagatttttttcctatattccaatggatcatcttatgcatccccagaggtgcatacacacactctttcaagaccaatgatctatataaattatacgatctctttattattataagagaagggtctcactatgttgtccaggctggattcaaactcctaggcttaagtgatcctcctgcctcagcttcccaagtagctgggactacaggcacacactaccactcccag

SEQ ID NO: 12857 - DNA, 388 bp, Homo sapiens
  misc_feature 388: n = A,T,C or G
ggcacgaggaaacaaaaacaaattggcctctgggttgcacaaaggtgggggaggccagaggagctctgcaaaagctttgaaaactaaattgatcttagaaccagagccctgctggccacagaaagtgcatcctgaatctaaacaggttgagtgcctgctaatacagaatatttaaacaggaactacagtctcataacataacactcaaagtgtccaggataaaattaaaacttactcctcatactaagaaccagaaaaattcgaacccagaaaaattactcctcatactaaaaaccagaaaaaatctgaatgaggaaagacaattaacactaagatgacaaaaatgttggaattattgcatagggattttagatgagctatcttatan

SEQ ID NO: 12858 - DNA, 374 bp, Homo sapiens
ggcacgagataacacttgccacaacttgggaaattccatgggtctatgccacattgctcccagagtaatgaggcaaaatagtgctctgttatagaattgcttgtttcacaatacatcatgacagataaccatacaacatggaatgacacaaacataatatgccacactccacaatatgtaatgctcgtcttccaggggggttcagtctaaggtaatctctaccaggaagaaaagctagatgactttagacatgtgcattggtttggaccttctaattagttgaatttttacttattttgacatgagagattacatagaatctctatgttgcccaggttggtctccaaatctgctcaaacaatcctcccgcctca

SEQ ID NO: 12859 - DNA, 378 bp, Homo sapiens
ggcacgaggaccacacaggccgaatccgggtgcatggtattggcgggggccacaagcaacgttatcgaatgattgactttctgcgtttccggcctgaggagaccaagtcaggaccctttgaggagaaggttatccaagtccgctatgatccctgtaggtcagcagacatagctctggttgctgggggcagccggaaacgctggatcatcgccacagaaaacatgcaggctggagatacaatcttgaactctaaccacataggccgaatggcagttgctgctcgggaaggggatgcgcatcctcttggggctctgcctgtggggaccctcatcaacaacgtggaaagtgagccaggccggggtgcccaatatatccgag

SEQ ID NO: 12860 - DNA, 387 bp, Homo sapiens
ggcacgaggcatcaactatggtggacatgttacagatgactgggaccggcgcctgctgaccacctacatcaatgattatttctgtgaccagtctctatcaactcccttccaccggttgtcagcactggagacttatttcatccccaaggatggcagcctcgcttcttacaaggaatacatcagcttattgcctggcatggacccccctgaggcctttggccagcaccccaatgctgatgtggcctctcagatcactgaggcacaaaccctctttgatactttgctttccttgcaacctcagattacacccaccagggctggaggccagacccgggaagagaaggtccttgagttggccgctgatgtgaagcagaagatccctgaaat

SEQ ID NO: 12861 - DNA, 465 bp, Homo sapiens
  misc_feature 411, 442, 443, 444: n = A,T,C or G
cgttgctgtcgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaagaaaaaaaaattcggggatttggtcaatatcccatttttttgttaaccccaaggcccttaaaaataacccggaacttaagggactgggaattttgggttaaaggggccctccggggaaggggggggaacactgactttttgaccctctttgaaaagataaaaggaccggggccctggggggaaacccttgtgaaaaggctcgggaattcagaatggcctaaaaaacctccccccacaccggcaaaaaanaaaaaaaaaaaaaaaaaaaaaaaaaaaaaannnaaaaaaaagggccgttgttgc

SEQ ID NO: 12862 - DNA, 442 bp, Homo sapiens
  misc_feature 430: n = A,T,C or G
caccggcttgctcgtttggccgatgcggcctacgggtgtgagaatacgacagaagggggacacaaatgttaaaattagcaaagacattaagatagctttatgactgtattctagatgttttaataagtcaaatagagccatagaagaaatttaaaagactcaaactaattcctagagatggaaactacaatgtctgctgtgaaaaatatactggatgggactagtggtagattcgccatgataggagaagtagattagtgaacttcatgacacagcaataaaaacatcatgatggagcagaaaaaaaatccaaacctttgaaaagagcttcattgagctgtgggacaatgtcaactagcataaaaaaaattttgagaaataatagctagaaatatctgaattgatgaaactataaaaccgagatcaaagngtgaaacaagcg

SEQ ID NO: 12863 - DNA, 468 bp, Homo sapiens
  misc_feature 401: n = A,T,C or G
ccttaaggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcangtgactggagcccgagggcctgacaggttcccagcagctgggccggccagccttgcactgtgggggt

SEQ ID NO: 12864 - DNA, 406 bp, Homo sapiens
ggcacgagaagttgggggcaggggaggcggttcatgaaggcgggctctacatgacttaacccttgcttggcatggccttaagccctgtttacaatttggtatcttattgccacagtgtctgttctgtccatctcatgatccctattttgttcattcatgctcggcagctgcgtctaaaccataaagggatggggtataacaagttgcatctgacctcccaacccatcacggccaggaattgttttaagttttttctgagattccctcggccacgaggtggcatctgctcaatcgttggggttttatgatttttagcttacataactgatttgataatccagggcatttgttaccgcgtatccaggcgagattatgactcaactatttagcacctccatctcaacag

SEQ ID NO: 12865 - DNA, 407 bp, Homo sapiens
tttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgaagtcgggttgtggctgcagcagagcaagagatgcttgcccgagtgggagcaacccacccccgt

SEQ ID NO: 12866 - DNA, 380 bp, Homo sapiens
ggcacgagataacacttgccacaacttgggaaattccatgggtctatgccacattgctcccagagtaatgaggcaaaatagtgctctgttatagaattgcttgtttcacaatacatcatgacagataaccatacaacatggaatgacacaaacataatatgccacactccagaatatgtaatgctcgtcttccaagggggttcagtctaaggtaatctctaccaggaagaaatgctagatgactttagacatgtgcattggtttggaccttctaattagttgaatttttacttattttgacatgagagattacatagaatctctatgttgcccaggttggtctccaaatctgctcaaacaatcctcccgcctcagtttct

SEQ ID NO: 12867 - DNA, 374 bp, Homo sapiens
tacggctgcgagaagacgacagaaggggaacacatttttgatcatgcatattttgatttttaaatattattggttagaaatttgaacaaagtcacccatacattttctaacttccagaactctacttattatatatcttttgctttatagcctgaaataactctatagcgaagtaatttacaagaaatggtctattatgaaaagcaggctttaaagcataaaaattttttttataggaaatatgcatgattataaaacaacctgatttttattttattgttcataaaagagactaatattggtgcatgtgctgctgtaatttgttgtgtattatgtgtgtaggaaaactgcccagcttgtagccagcttcctca

SEQ ID NO: 12868 - DNA, 407 bp, Homo sapiens
ggcacgagaattgctgtgcgtggggcacggacggacagcgaggtatagagagtggagagaaggccgcagcccagctgggcttccaggtgggagctcagcctccccatctctgccgtggaagggactcagaggtgtcaggccaagcatgcaggcaggcttgtgacaaactccttggccaggagctctgagaattagcttcacttccctcagaaatgccccaattccctcctggaagaggagctgtgtgacagctcaggccagggggtcgggactccccccatctcctccgcacacacatacccctgcacacatacccagccacgtacagctgggtggctgtacgcaagtcatttttctactctgagcctcagggtcttcctctgtccacctccccccaggattactgg

SEQ ID NO: 12869 - DNA, 387 bp, Homo sapiens
ggcacgaggagagagagagagagagagagtttgagagtgagagagagagagagagagagagagagagagagagagagagagagagagagagagagagagagagagagagagagagagagagtgtgggcgccctctcctcttgtgtgcgctctcccccccccgctctctcactcttatgtgggggggcgcgcgctctctcttttttttgtggggtgtgtgcgcgctctcccacacggggctctctctctgagagtgagcgctctgtgtgtctgtgtatataggggggggtgtgtgtctctctgtgcgccccctgtccctaggcagagagagagtctctctgtgtgcgcgcgctcttttgtgtgtgcatatgtttctctctcccctctc

SEQ ID NO: 12870 - DNA, 400 bp, Homo sapiens
  misc_feature 400: n = A,T,C or G
ggcacgagacactaagatggctgccgttgccatgacacccaaccctgtgcagacccttcaggaggaggcggtgtgcgccatctgcctcgattacttcacggaccccgtgtccatcggctgcgggcacaacttctgatgcagattttagctgagggatttggaagccatttggggaggcaggctgggccaaagggtagagctgggtaataaatgtctattctcctggggaggagggattctaaactttccttccgtcctcaatttctacctccatagaccggccagaatttagcttcacttgagagagatctggaatggtcgccatgattgaaaccacgcaccattacatcatcattacattaattacatcaacataaattatttcttcccccttcccttn

SEQ ID NO: 12871 - DNA, 395 bp, Homo sapiens
ctttaagatcatcctgggaatttccttcactttttcttttgggagacctcttatttctggatcccaggtcttcatcattcttggtttacttcctttattggtggactacatcctccacatgggaggtaaattgttgaaaccttgcatgactgaaaactttattttaatctcaccctcaagggatgatttggctaggtatggaattctagtttggaaataatttgctctcagaattttaaacacattctccattgcctcatagttttggcgtaaatgttgagaaatacaatgccacttttaatttctgatgctttgcatgtgatctatttttctctcaagtagcttttataatctccttatccttgatattctgaaaattcatgatgctgtgcctg

SEQ ID NO: 12872 - DNA, 418 bp, Homo sapiens
accgatgctgccggaatagagaaaacattatctgtatgagctcttctcgatttacatgtaattggcaaaattcaaagagctgattcttcaacaaataaattacttaaaaacggatggacagggaacctcgtaaagcctttatcaactgcaatgtatggacttctatactgaaatgtttacagatgaaattatatgatgactgggatttaaaagaaatcctacgatagccaggtgtggtggtgcatgccagctactcaagacgctgcggcagaattgcttgaacccaagaggtggaggctgcagtgagccaagaccacaccactgcactacagcctgggcaacgagagactctgtctcacaaaatataaatgaaaaactaaaagttattctatgagtggcggaaagaacagattacaca

SEQ ID NO: 12873 - DNA, 394 bp, Homo sapiens
  misc_feature 376: n = A,T,C or G
cgttgctgtcgagctcaggaggctgaggttgcagtgacccgtgatcgcaccactgcactccaacctgggtgacagagccactgcaaagcactctgtttagtcatggtttcttttatgtattctttcatgtattgaccttaaaaaagaatgtttctgaatatgcctttaatctgacaaaccaccaccttaatattcttttaaaatcagtttgagcctacagccatgccactgtgaatgtgtctgatctcatgtgatcatggaagctaaagtgagtttgatatgataaatatatgcaacgtaactttaaatataacttttaaaaatatgtttttaaggccagatatggtggctcacgcctgtaatcccagcactttgngaggccaaggtgggagga

SEQ ID NO: 12874 - DNA, 407 bp, Homo sapiens
ggcacgagcagctactcgggaggctgagacaagagaatcacttgaacccagaaggcagagattgcagtgagctgagatcatgccactgcactccagcctgggtgacagagtgagactccatctcaaaaaaataaaatattgtggtattggcacaggagtggacaactaggtcaatctaggaacagaccttttggaacttgatatacatgaaatgactcaaccaatcagtgaagacagggtggatgttcactgaatattggagaaaactgaactcccccatacaaaagaaaacagatttccactttacacacactcaaaattaaatttcagattaaatactaggatatttttaatgatttattaaatttttttttggtagagacagggtctcaatatgttgctcagcg

SEQ ID NO: 12875 - DNA, 412 bp, Homo sapiens
cgttgctgtcgggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatattttgg

SEQ ID NO: 12876 - DNA, 407 bp, Homo sapiens
  misc_feature 407: n = A,T,C or G
ccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataaggggatccattggagtctttggctgaatactaagctgtgcatgcttagagtgaaatttcaagagactgggcaaagaacaattactaggaacagaacaactaccaggaagctgtaagctgaataattcttagagctaataaaggattgagaagtggttgagctctgatcagacacagaaaagagactttgttgaacctctgggatgttcaatagagacctcagaagagtcacaccttattaan

SEQ ID NO: 12877 - DNA, 328 bp, Homo sapiens
tacggctgcgagaagacgacagaagggactctgcattaaacaggagcttttctaatatggctggaaactgttgggggtggattagagatttttaaggatcttatggcaagctttggctggtagagtacaagaatctagtggtgtcttttattggggttttgggggtgctgggaactatgacattacaaagagccactaattgttaactgaaggaaaaaatactggtcaatgaagggaaacttaactataaaatcaacttagtagaaataaaccattaagtggtactaatatgggcaggcacagtggctcacagctgtaattccagcac

SEQ ID NO: 12878 - DNA, 344 bp, Homo sapiens
tacggttgcgagaagacgacagaagggtctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttttgggaaaaaaattttttttttccccccggggggggaaagggggtttttt

SEQ ID NO: 12879 - DNA, 340 bp, Homo sapiens
tacggctgcgagaagacgacagaaggggaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactgg

SEQ ID NO: 12880 - DNA, 388 bp, Homo sapiens
ggcacgaggtttcaaactcctgggctcaagcagtcctcctgcctcagcctcccaaattgctggggttacaggcttgagccactgtacccagcccatcaataatttttgcctgaaacaatttttattgcgatctttgtgttgagagtcctccatggatctgttgtgtgcttacatgtcttgctgggtgtgccaagaatgcaaggcccaagaatgctctttatttgggccttttctcagggttgtttacacagctggtaatcttcagagacaagttaatgtttcctcttggacaaagagcaggcttgcccactgcttggtataaaaacaatagatttcagccgggcgtggtggctcatgtctataatcccagcactttgatttttttttt

SEQ ID NO: 12881 - DNA, 403 bp, Homo sapiens
ggcacgagagaggagctcagagaggaacggagaggcagacagagggaaacaacgcagaaagaaacagagccaaagccagagtgtggggggagccggaggaagaaacaaaaacacacacatgtggagtcggaacgacacaggcagagaggcacagagtcgcagcaatccagacagaaagagacacgcagaaagaaacagacagtgacagagaagatggtagcctctctgccctccccaaacaccttgccccactggtcctggctggcggcaggggactcacaggcccttgacctatgcccagtaggggaagagacaggacttttcctcagaggccttcaatgagaccccattcccaaaaaggttgggtctgacacacagcagccatggtgtccacggcccccat

SEQ ID NO: 12882 - DNA, 393 bp, Homo sapiens
  misc_feature 314, 315, 320, 321, 337: n = A,T,C or G
tccagatgcagctgcagccgcgcaggcaggagccagggacaagtgggagccctgcctcttccaagttggcggggtgggagctcccaggtgcagctgtggctgcccccccaggcacaggacgagggcatctctgcagcctgcaccatcggccatcccaggaaggacagcccccttcaccctccatccctgcaggttcaggggtgtctgcttccactgcctggcctctctccactccagcaactgctctgatcttggaggggagtcggagccaagacctgcagccatgaatggcagcaggaggaaagggggggggnncccannaaggccccaccctcangccagggagggcctgaattctgggggctgggctgccagtccctctgaccagagagg

SEQ ID NO: 12883 - DNA, 423 bp, Homo sapiens
  misc_feature 378: n = A,T,C or G
ggcacgaggttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactatcgctcanattggcagaattaccggcaagcatacagtcctcgtcgaggccgtc

SEQ ID NO: 12884 - DNA, 385 bp, Homo sapiens
cgttgctgtcggtttattgtaacagtaattaaatgctgccttaattgaaggggtttgggtggatttttttttctcaaaataagctgtagggactattttaacagcttaaacaggagctctcaagatgcactttcgtattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccagccccaccctgaacacagctcatacgcagaatcaggaccagcatgtgcagagctggccaccagcac

SEQ ID NO: 12885 - DNA, 376 bp, Homo sapiens
cgttgctgtcgtggggacagatttgtgatgcttgattcacccttgaagtaatgtagacagaagttctcaaatttgcatattacatcaactggaaccagcagtgaatcttaatgttcacttaaatcagaacttgcataagaaagagaatgggagtctggttaaataaagatgactatatcagagacttgaaaaggatcattctctgttttctgatagtgtatatggccattttagtgggcacagatcaggatttttacagtttacttggagtgtccaaaactccaagcagtagagaaataagacaagctttcaagaaattggcattgaagttacatcctgataaaaacccgaataacccaaatgcacatggcgattg

SEQ ID NO: 12886 - DNA, 384 bp, Homo sapiens
gaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttcc

SEQ ID NO: 12887 - DNA, 225 bp, Homo sapiens
tcacactgccttccacccgctagcgagcccaattgcatgcaatatatgcctgatgatccaggggaggagagagagtgatgcagagctggtgcagaagggcagcgagctggtggctctgcgggtggcgctgcgggaggcccgtgctacgctgcgggtcagtgagggccgtgcgcggggtctacaggaggccgccccgactcgggagctggagctggaagcctgttc

SEQ ID NO: 12888 - DNA, 413 bp, Homo sapiens
ggtgctggcgattctgtgttattaattatattcatactattgtgcaaccaccggcaccatccgtctacagaactcttgatcttcccaaactgaaattatgtattcattaaacaataaccacccattacctcctctctcctcagcctttggtaaccagcattcagtctctatgaattgactactctggatatctaaaaggaatcattcttatttcatttaccataaagacttcaaagttcattcatgttggaacatgtattagaatttctttactcttaaaggccagatatgccgtaggatgtaaataccgtagtttgtgtatcaggtcatccattactggacactgggttgcttctgctttatggctattgtgaataatgcttctgagaacgtgggtatacagataactgcat

SEQ ID NO: 12889 - DNA, 405 bp, Homo sapiens
cgttgctgtcggcctgggcgacagagcaagactctgtctcaaaaaaaaaaaaaaaaaggttaaaaatttacccggggggggggagggccccctgtatttccacttcctcaggaggggggggcagaagaatcttttgaccccaaaattcaaaaatggcaaggacttataatattgttattgccctccaccttaggcaacaaaggaaaaccttgtttttaaaaaaaaaaaaataagccaggcttataataggttatcccaaagggagtaaggaggttttatagggccaaacccttcttataaaaaagaaattagccaacttatggttgtttaagggtaataggaaaggcttatatggagaacctttattcttaaaaaaaagggaaattttttttcggtaccccatgt

SEQ ID NO: 12890 - DNA, 381 bp, Homo sapiens
  misc_feature 381: n = A,T,C or G
gcctacggctgcgagaagacgacagaagggccatccactaatagattggtcagcaaacaatccaagctgtgagccaaagtcagcccactatgaggccaactctgtttgcacccattctttatagcttttgcactacagtggcaaagttaagtagttgcaacagagactgtataacctgtaaagccaaaaacctcactgtctggacttttatagttccagactctcacactagttgaatactttgaaaatcttcaggttctttctgggaagtttggtaagactatctctaagcagtattagataattggaatcttaccatttagcacactttcatacaaaaagtgacaggtaatggttgggatcagaacagaacaacataan

SEQ ID NO: 12891 - DNA, 437 bp, Homo sapiens
  misc_feature 437: n = A,T,C or G
aggatccctcgattcaattcggcacgaggacagagccgactccatcttttagaaaaaataaaaatattaagaggttctgctgccaaatgtgggttctgtgggtcgggtgtgggttctgtgggtcgggtgtgggttctgcaaaccaggtgcggattctgtgtaggttctgcaggcccagggtaaaggctcacacctgtaatcccagtactttgagacgctgaggggggaggatcacttgagcccaggagttcaaaaccagcctgggcaatatagggagaccgtatcactacaaaaaagtttttttagttcaccgagcatgggggcacatgcctgtagtcccacctactcgagaagctgaaatagggtcacctgaccctggtaggctgaggctgcagtgagccaaaatcgcactactgcactccagcctgggtgacaan

SEQ ID NO: 12892 - DNA, 399 bp, Homo sapiens
ggcacgagattacatttcccagtacttcctgttccctcttcctgctttctctttttttttttttttggaattaaaaacggagtttggctttgcccccgggtggggggccaggggaaaaattttgcttaattgaacccccaccttggggggttaaagaattttgcctgcctaaccctccggagaaatgggaataaaggggccttgccccccccccaacctatttttggttttttaagaaaaaagggggttcaacctggtgggccgggctgttccaaacttttggccctggggggatccccccccctgagcccccaaaaaggtgggaataacgggggggaccaaccatgccaaaaattgggtttaatttttttaaaccttttaaccaacctaaccaaaaat

SEQ ID NO: 12893 - DNA, 346 bp, Homo sapiens
tacggctgcgagaagacgacagaagggggccttcatgttggcagttccagaagtggggttgagggagagagagaatacttgaggaaataatggctgaagacttcctaaatttgatgaaagacctgaatatatgcatccaagtagctcaacaaattccaagtaagatgaactcaaagagaccacacagataccaacatttcacaagccaaagccagagaattttgaaagcatcaagggagaagcaacttgctacatacaaaggatcctcagtaacaggtccccaagccctgggccacagactgttaacagtctgttatgttccagaccacacagcaagaggtgagtg

SEQ ID NO: 12894 - DNA, 341 bp, Homo sapiens
tacggctgcgagaagacgacagaaggggcacttatgacaacattaacacagaatgccagttcatcagcagccgactcacggagtggtcgaaagagcaaaaacaacaacaagtcttcaagccagcagtcatcatcttcctcctcctcttcttccttatcatcgtgttcttcatcatcaactgttgtacaagaaatctctcaacaaacaactgtagtgccagaatctgattcaaatagtcaggttgattggacttacgatccaaatgaacctcgatactgcatttgtaatcaggtatcttatggtgagatggtgggatgtgataaccaagattgccctataga

SEQ ID NO: 12895 - DNA, 427 bp, Homo sapiens
ggcacgagccggcccccactgagcccactccggcctctgaagccaccggagcccctacgcccccaccagcacccccatcgccctctgcacctcctcctgtggtccccaaggaggagaaggaggaggagaccgcagcagcgcccccagtggaggagggggaggagcacaagccccccgcggctgaggagctggcagtggacacagggaaggccgaggagcccgtcaagagcgagtgcacggaggaagccgaggaggggccggccaagggcaaggacgcgtaggccgctgaggccacggccgagggggcgctcaaggcagagaaaaaggagggcgggagcggcagggccaccactgccaagagctcgggcgccccccaggacagcgactccagtgctacctgcagtgcagacgaggtggatgaggccga

SEQ ID NO: 12896 - DNA, 427 bp, Homo sapiens
ggcacgaggagagagagagagagagagttttagtgatagagagagagagagagagagagagagagagagagagagagagagagagagagagagagagagagagagagagagagagagagagagagagagagagagagagagccccccctctctctcttttttttggggcgctctcttttttctctctctctctatatctctctctcgctctctctgtgtgtgtggctatgcccccgggggcccccccccccccacacaagagagtgtctctctctgtgtgtctcccactctctctctctctctccccccccccccctctctctctttttgttttgtgagagtgtgtgtctccctcccacactctttttctgtgtgtgcccacacagaaagggggggctctctctctcccttctctcccccacacgct

SEQ ID NO: 12897 - DNA, 339 bp, Homo sapiens
cggttttttgttgcgagaagacgacagaagggtacggctccataaacacgacagaagggtaataacaagctgtatatttttcaaaggttttttaaactttggacactctttcttttgttaaccacttaaaggaataaaagagctggaaaaaaaattggaccttcaactcaggttgttccatataacaaacgtattctttgctgttacgtaagattttcgattcacagagtccatccatgtacatcacttacacttaaattgccaaaataattagtctgaccatctgactttaaaagactgttgctacacatacatcatgtttaggagaatgtgggatat

SEQ ID NO: 12898 - DNA, 394 bp, Homo sapiens
cgttgctgtcggtagcatttgatcagctttgccacagatgaaaagcagaactggacatggaagagaagtgaagtaaggacaagctggaatctataggcatctctgcatctatctttcactgcatctagccatgacaaacttcatagtataatgactacagctttatctccaacttttttttttttttaagaagaaacttcccggacgagatcccagaggggtattttagcatcctagagacctcctcctagagggtcaaggaagatacctgcctcaagttctgggagaagaggaaatacagggcatgggccactatacacgggaagtttttttttttaaaaacaaaaaaggctttgaccacttagaaaaggctgagtttcgacacatccgctcg

SEQ ID NO: 12899 - DNA, 399 bp, Homo sapiens
ggcacgagcatgttcaggccccgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatg

SEQ ID NO: 12900 - DNA, 399 bp, Homo sapiens
tatagtggaaacagtatttctagatgttagatttagcagacaaagacttcaaagcagctattgtaaatcagtttaaagcagcaaagtaagctaagaatgaaaataaagtgtgacaaatagagatgttcaaaaaggagatagaaatgattttaaaaataacaaaatgaaaattctgagattgaagaatatagtaactgatgtgaaaaatttactagagggtcttaccagaggtttgacatgacagaagaaagaagcagtgaatttcaaaggtagatgatctaatctgaagatcagagaggaaagattaaagagaaatcagtagagccacagagatctgtgggtcagcatcaagtttacctatgtatgtgtgatgggaatctcagaatgaatagagaaagc

SEQ ID NO: 12901 - DNA, 397 bp, Homo sapiens
  misc_feature 329: n = A,T,C or G
ggcacgaggttttgcttcagctagaatatacaatgcagatgtcattaaaagacttactttaaaatgttaaaaaaaaaaaaaaaaaaaaaaaaccctcgccccttaaaaattttgggggggggtttaccggaaacccaaacttgaaaaaaaccttggtggggtgggaacaacccccaataaaagggcgggaaaaaaagggtttttttggaaaaattgggaaggctttggtttttttgaaaccctttataggcggaaaaaaaaaggtaaacaccacaaggggcttttttttttttttcagggttaggggggggggggggggagttttcccnaacaccaatatacagggtatacctctaactacagcttgcataatggcttaaaattgccatggggaaag

SEQ ID NO: 12902 - DNA, 372 bp, Homo sapiens
tactgttgttagaagacgacagaagggtctacaagcacatgctgcctgagggcttggagactggcctgttcatcccattgcagcaacccaatatgaaagcaaactgctcaggaaccagagggttgtcccgccattgtcactgtcattgcccatgccacactagctgcccagaggcctaagaacctgcccacttgctggaaccaaggcttcaacacctgggtaagtcacctggaggcccaagtattggcccacctagacgtgccaacatcagtggtaggtttggtgtgcctgttcctgggccccaaatactgaactatttggtatccaaatccccataaaaactccagcacaacctccactaataactacacc

SEQ ID NO: 12903 - DNA, 410 bp, Homo sapiens
cctagttttatttctttgtagtgaaagaagattgccacggagacagacagcagcatggtcagtgtggtaggagccggccatcagcgagagctgctccatgcctggctgctgggagctagagcctgcggcccactggcttgcctcactgtagttggtggtggcagtgacagagactgcagcatgaccagagtggtaggacaggggctatccagggctgcacctttcgcagtgtggggtgggttgggggcactatccagggtgtcattgcctgcattaggggtactggttggtagcactgcacagggctgcactgcccacagcagggagggtgggttatgggtgctttctggggctgcaatgcccatggaggaggacaggttagggcatatcgggtatatgctactggcgga

SEQ ID NO: 12904 - DNA, 407 bp, Homo sapiens
ggcacgaggcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttga

SEQ ID NO: 12905 - DNA, 453 bp, Homo sapiens
ttgttctttactagttttgaaaaaagtagaacaaaataaccaaagtgacttttgtacttttctattggtgtgtgtttgtttatttagagatggtgtcactctgcgttgcccagtctggccttgaactcctggagtatccttttgcctcagcctcccgagtagctgggactgcaggtgtataccacctccccaacttggatttactagtagtagcaagtgtagacaagagtctcctatttggaatgtaaattgttggttggaatgtacgttggcacaacttggggaaagtttggcaatgtatatcaaaagcattaaaattgtgtatatcttgtggcctggcaatactccttttatgaatttattataaaaaaaagtacatttatttaaaaacttagctggctgggtgtggtggctcattcctgtaatcccagcactttgggaggctgaggtggg

SEQ ID NO: 12906 - DNA, 407 bp, Homo sapiens
cggatggatttggaagctggaattcctcttaacaaccaaggggtttattttcaaagcaatattggggaattgatttcacagttcgttaccttagtagggaacggtaaggttattctttttttttttttttttgggattaaaaacctgggggcctaaatttaaccaaaaaggggccaaaaggtggaatgaaactaacttttgggcaaaattaaaccatccccccaaagggcgaaaataatccaccgccccccccggttttttggtgggttaaatttggtttagattaaaaacaggcttttgccccccagccgggagggcaggggggtaattagaaccttttccccccgggatgaaagcaatatcctgccttcacccccccagaaatctaaaataacgggcccccccct

SEQ ID NO: 12907 - DNA, 339 bp, Homo sapiens
tacggctgcgagaagacgacagaaggggtaagctattaagtgcatgtttccctcaggccctctggtccattctggacaaatgttgaaagatgggttggattggcacggaacgctgtgccaaaagcaccccctttttttttttttttttttttttaaaaagggaattttgtttttgtgccccaaatgggggggcagggggaaaatttaatttaaccaaaccctcttcttccggggtaaaagaatttttccggccttgccccccaagggggggggaataaaggggccttgccccctcccccgggaatttttttttttttttaaaaaaaagggggtcccccc

SEQ ID NO: 12908 - DNA, 399 bp, Homo sapiens
ggcacgagggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgaca

SEQ ID NO: 12909 - DNA, 326 bp, Homo sapiens
tctacggctgcgagaagacgacagaagggatggtaaaatgataatcaacgaatactataatcaaccctatgtccacaatttgataactgcaatgaaccaatcctttgaaagacacaatttgtcaaaactcacataagaaatagaccatctgagggggcctaaaccttttaaagaattgaattaataatgttaaccttccaaaacagaaagcagggacccagatgggttcactagtgaattctactaaacatttaaaggaaaaactaataaatgagatattccatgtttatggatcagaagacaatattgtcaaggtgacagttctt

SEQ ID NO: 12910 - DNA, 380 bp, Homo sapiens
tacggctgcgagaagacgacagaagggcgcggcctcagcctccagtggcgcgatctcagctcactgcaagctctgcctcccagttcacgccattctcctgcctcagcctcccgaggagctgggactataggcgcccgccatcacacctggcttttttttttttttttttgggaaaaaacggggttcccccatgtaacccaggagggcctaaatctccggacctaaggacccgcccccctgggcctttaaaagggctagaataacgggggggaccccccgcccagggcctgggaagcacacagttttacccttgttacccccccttggggaaaagggtttcggcacgggggttcttttaaaggagggaccagccctcattg

SEQ ID NO: 12911 - DNA, 378 bp, Homo sapiens
  misc_feature 291, 378: n = A,T,C or G
ggcacgaggcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggncgatctcgttcccatactcgctcaaaatccaggtctagctcaaaatcccattctagaaggaaaagatcacaatcaaaacacaggagn

SEQ ID NO: 12912 - DNA, 450 bp, Homo sapiens
  misc_feature 20, 23, 24, 28, 29, 36, 42: n = A,T,C or G
accctacgaacaagctactnggnntttnngcaggancccatnaattcgaattcggcacgaggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgccttcaccttcaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggaga

SEQ ID NO: 12913 - DNA, 405 bp, Homo sapiens
  misc_feature 1, 2, 8, 9: n = A,T,C or G
nncaccannaaacttcagccaacccggtcattgtggacaccattgttatggccaatctgggctactttcagctgaaagccaacccaggagcttggatcctcagacttaggaagggacgctctgaagatatttatagaatttacagccacgatggcaccgattctccccctgatgctgatgaggtggttatcgtcctcaacaacttcaaaagcaaaattattaaagtgaaggttcagaagaaggcagatatggtgaacgaagacttgctgagtgatggaacgagtgagaatgaatctggattttgggattccttcaaatggggctttacaggacagaacactgaggaagtgaagcaagataaagatgacataattaatattttctccgttgcatctggtcatctct

SEQ ID NO: 12914 - DNA, 400 bp, Homo sapiens
  misc_feature 45, 364: n = A,T,C or G
ggcacgaggggggacgcgctcaatgctctttatgtatcccttagngggcttccgatttaagcgactgcccacgagacccaaaaaaggtggtccggaaatctcaccgtgaggcgcggctcatcagactgaaacttgctcacagacttccagttatttatttggggtctgaaggatatcaacagctcatctgtgaccaacagggcaactggaacctacacaaaccaattgcttgctgcaagcagagttttatatatttatagtcacagacggcagaggaagaggctctcagtccccacctgtacaacaacggaaaggtgtgtggccacactaagaatccaaacgccgtggcctcctgcagagctgnggcttttgtggagaatacttccgggtattacatgcg

SEQ ID NO: 12915 - DNA, 336 bp, Homo sapiens
tacgggtgttagaagacgacaaaaaggtacgggtgcgacaagactacagaaggggttcttttattaggaaatgcatgtatacggaaaaagaagaaggaatctttaccaatggactacaggaagtgaaagcaaaacgtttccctacctgaaagtttccttgtgtgagactggaatatatagttttacctctgtacaccatttttgctctagcctatatggactacctacactcataatgagaataatgatcaaatgaaggagttcggttttgttttgttcttttctttctttttttttttctggagacaatctcactccgtcacccaggctggggtg

SEQ ID NO: 12916 - DNA, 375 bp, Homo sapiens
tacggcttcagattacgacagaaggagtttgtatcctaggagcaataggctataccatatagcctaggtgtgtagtaggctgtaccatctaggtttgtgttaaattcactctttgatgtttgctcagggacgaaattgcctaaaaactcatttcttagaatgtatccctgtcgttaagggactcgtgaccgtattactatcttacagatgaagaaagtgaagttctgaaaggttaagtgtcttggccaaagacacacagccagtataatgggagcaaaacacaactgcctgaagaaaaactttggttgattaaagtaaagtaaaaacagatctgaaaagatctaccaattcaaatccttcagtaaaattctgggt

SEQ ID NO: 12917 - DNA, 373 bp, Homo sapiens
catgcgacgccatggaacattaagaggaaaaagttttgaaaaaattaaagccatttacaacctgggtttcaacgctagccctttctggattgccatacgccctgccaagatactgcaggcccattcaggcctgtgctatctgcatcagccgagggctttccaggaacttgactgtctttcattcgaactttatttttgttgatttaatattttaaactttattttaaaaatatttcaaacataagggcggggtgtggtggctcatgcctggaatcccagcactttgggaggccgaggcgggcggatcacctgaggccaggagttggagaccagccaggccaccatggggaaaccctgtctctaccaaaaatag

SEQ ID NO: 12918 - DNA, 399 bp, Homo sapiens
gggaagaagaaggaggagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattgga

SEQ ID NO: 12919 - DNA, 428 bp, Homo sapiens
  misc_feature 428: n = A,T,C or G
ctttactagttttgaaaaaagtagaacaaaataaccaaagtgacttttgtacttttttattggtgtgtgtttgtttatttagagatggtgtcactctgcgttgcccagtctggccttgaactcctggagtatccttttgcctcagcctcccgagtagctgggactgcaggtgtataccacctccccaacttggatttactagtagtagcaagtgtagacaagagtctcctatttggaatgtaaattgttggttggaatgtacgttggcacaacttggggaaagtttggcaatgtatatcaaaagcattaaaattgtgtatatcttgtggcctggcaatactccttttatgaatttattataaaaaaaagtacatttatttaaaaacttagctggctgggtgtggtggctcattcctgtaatcccagcn

SEQ ID NO: 12920 - DNA, 390 bp, Homo sapiens
ggcacgaggctactcttacgcactcacgttcattaactgcgttctgatggcagaaggtagacagcaactggacaaaggtgaatttacggagaagtacgtggtcccgcagacaaggctggcattcaagttcatcacactctaccgggcgatacgggagcatggcttctacgtcactgactgtccccagcagcaggcacaaccccctgagggcggcggtttgtgctgagagctatgtaagcgcagcctgtacgctggagggtagggaggatgctacctttaatcactactatggatctctaaatgcatttaactgcggataataaaaacgtgtatgggccgggcatggtggctcacacctgtgataccaccactgtgggaagctattacagg

SEQ ID NO: 12921 - DNA, 405 bp, Homo sapiens
gtccgttgctgtcgggaagtccttacctctgtaggtatctcctcaatgaatactgtgtgtaaggctgaaatagttcattatgttaataaccttctttatgttctcagggaaatgcttaggtggtgtcacaaaatgtgccttttcttttcttttctttttttttttttggggcaaagtctcctttttttccccaggttgaaggccagggggccaacttgggttaattgaagcctccccttccggggttaacccttttttctggcttagaccttcaaggaattgggaattaaagcttccccccccccccccgggatatttttttggatttttaataaaacacgggttcatttttgttatccaggggggttcatatctccggccccaataatccccccgcttttgcct

SEQ ID NO: 12922 - DNA, 433 bp, Homo sapiens
  misc_feature 1, 2, 433: n = A,T,C or G
nnccggcacgagagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccaaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcn

SEQ ID NO: 12923 - DNA, 335 bp, Homo sapiens
tacggctgcgagaagacgacagaagggtacagacagagaggtgagttgggtttagaagaggctggtaaggtgggctcaaccaaaaaaggcccagtggaccctacactatggaatgaattgtgtccccccaaattcgtatgttgaacccctaactctcaatgcgactatatttggagatagggtttttaggtgattcaggttaaatgaggtcctaagggtgaggccctaatctgatgggactggtgttcttataaatggaacaggatgcacaagagagctctctctccccacatgcacgaagaggccatgtgagtacagagcaaaatggcggccac

SEQ ID NO: 12924 - DNA, 350 bp, Homo sapiens
tacggctgcgagaagacgacacaagggaatgaagagtcctttttggttccaagccaatcctggctgggtgctttgcttcccttgctatgctgccaccctgagtttctgcacttcagagggtttccatcacttccttgctaaatttcagtgctgtaccttacatattctacctaaagcttagttttatagttgagttgatttttctttgtggaagagataggcgtcgagcaccttcagttagccatttaacgcgttttttatgttttaatgctgaatagagttccattgtatctactacttcttttttttttggccattgacctaatgaggggtatttggaccatttttat

SEQ ID NO: 12925 - DNA, 405 bp, Homo sapiens
ggcacgagaggctatggcatctaggtttgtgtatttacactgtgatgtttgaacagcgaatgaaattgcttaacaatgcatttctcggaacatatccatgttgttaaatgtcccatggctgtattgatgttgatcttaaacatagacatgatagaatgactcagaatttaatactctttgtgatttcaaaagtagattttagcaaaatgctttagtgaaaacctgtgtataattttttaaaaaacatttaacattttaatcataaatgctaacagatccttctgtcttatttccagtctttttaaggttgtgaatttctggaacttaacccatttatgcaggagattaaaattttttgtgtgtgaaaaatcagaccttgtcagtgaccttgaacagtttacatat

SEQ ID NO: 12926 - DNA, 408 bp, Homo sapiens
ggcacgagacttgggaggctgaggcaggcaaattgcttgaacccgggaggtggaggttgcagtgagccgagatcgtaccactgcactctagcctgggcaacagagcaagactctgtctcaaaaaaaaaaaaaaaaggggtggaaaaggggaaacggctgggggggggggttacaccctgtgaacccaacctttgggggggccgggggggggggactccctgggggaagggattggaaacccaccgggcccaccgggaaaaaccccgttttttttaaaaaaacaaaattttaccccggccgggggggggggccctgaaaccccggttttttgggagggtggggggagaaaattggttaaacctgggggggggggggtggaagggcctaaaaaccccccccgggcttttc

SEQ ID NO: 12927 - DNA, 422 bp, Homo sapiens
ttattgcatgagaccagctagcttgttgtttgggccgaagcggcctacggctgccagatgacgacagacgggtacggctccgagaagacgaccgaaggggttgatataactgtgtgggtgagtctgattatactcataataatatatttgtatctgcagtgcctagaacaaaacctgccatatggcaaatagtcaatatttgttgaagaaatagattaattgacattaaaagggagaatatttaatccctgctgaggactaataaaatcatttttattattgtcaacttgctttaacaaccatctcacaaataaaatgaaggctactatattgttttgcagttctgaatctaactttacaaaaatattgaagagcatgctaagaaaagatcatatatctggcacattaaaaggcgtttagag

SEQ ID NO: 12928 - DNA, 407 bp, Homo sapiens
  misc_feature 407: n = A,T,C or G
ggcacgaggagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccaatgtgaaatgattcttcaagcatctgaatatgaagaccttgaacacaaacn

SEQ ID NO: 12929 - DNA, 403 bp, Homo sapiens
  misc_feature 403: n = A,T,C or G
cgttgctgtcggaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgn

SEQ ID NO: 12930 - DNA, 387 bp, Homo sapiens
cctgcacgggctgttgatgcctgccacccttcacgtgaggtgtgacttactcctccttgccttgcaccacgatggtgaggcctccccagccatgtggaactgggagtgcagataaagctctatctttgatagatgggccgctcttacgtatgttgttatcatcagagggtgcactgactaacatggcgtctccgagggtatggactacatgtctgaagatcttggtgaggtgagggagggtgcctacatgtaaaaaagctgttttaaaattaaatatgactttaattttaaaaattaaacatttttgcattatcaaagttaaatatacaccatggaaatttgaataactagaagaagggagaaaacaccttttctaacgtttatcat

SEQ ID NO: 12931 - DNA, 380 bp, Homo sapiens
tacggctgcgagatatacgacagaagggtacggctgcgagaagacgacagaagggatgtgggattccctgaaccaactggtaatgcactaccagcatataaggtgtcctcattaaagcagttggtgattggtacatgggacctcactcatgtatgtttgcatctacttgtgagtcaaaaagttttcttaaagtataggtgggatcatgaaagacatacaattcactggagaaattgtgaaaaagtaaaagattatgaatttaggctcaaagccaatttccctctcatttaattctacatgagcaagtcaaggagtttggtagagctttatgaaatctctaaagattgaaggaaaacaatcactataatcgatttgataag

SEQ ID NO: 12932 - DNA, 391 bp, Homo sapiens
  misc_feature 349, 350, 351, 355, 359, 372: n = A,T,C or G
ggcacgagggtgtgaccacacttcttcttgaagggcagcctcctgcccaggccccgtggccctggagcctcaataaagtgtccctttcattgactggaaaaaaaaaaaaaaaaaaaaaggcccccaaaaaaaaaaggggggccttatacctaaaacccaaacggaaaaaaaaccttggaaagttgggaaaaaccccaaccaaaaaggcgggaaaaaaaggcttaaattggaaaaatgggggagccattggtttaattggaaccaaaaaaacccggaaaaaaaaaggtaaaaaaaacaattggcttttttttatttttcaaggtccgggggaggggggggaagttttttnnncatngcangactttctacaangacacccaaactccttaag

SEQ ID NO: 12933 - DNA, 385 bp, Homo sapiens
  misc_feature 385: n = A,T,C or G
ggcacgaggctgtggtatcccatgagttgtttctgtgcactggtcctatgtgccgctatgctgaagacctggcccccatgttgaaggtcatggcaagacctgggatcaaaaggctaaaactagacacaaaggtacatttaaaagacttaaaattttactggatggaacatgatggaggctcatttttaatgtccaaagtggaccaagatctcattatgactcagaaaaaggttgtggctcaccttgaaactattctaagagcctcagttcaacatgttaaactgaacaaaatgaagcactcttttcacctgtggatcgcaatgatgtcagcaaagggacatgatgggaaggaacctgtgaaatttgtagatttgcttggcgaccn

SEQ ID NO: 12934 - DNA, 372 bp, Homo sapiens
gttgctgtcggtgagcgctgctgagcgggaggtgggcacggcgggggcatcgcagatgccagccgcgggactgagtcttccccctcccccggtgcactcagatgaacgacccgagccagcccaacgaggagggcatcactgccttgcacaacgccatctgcggcgccaactactctatcgtggatttcctcatcaccgcgggtgccaatgtcaactcccccgacagccacggctggtgagccccgacccgcgcggtgggctgggtcccccgtgggcggacgcgcagcctctcacgcatcgttccccgcaaccccccacccccacgcctaggacacccttgcactgcgcggcgtcgtgcaacgacacagtcat

SEQ ID NO: 12935 - DNA, 381 bp, Homo sapiens
tacggctgcgagaagacgacagaaggggcacttatgacaacattaacacagaatgccagttcatcagcagccgactcacggagtggtcgaaagagcaaaaacaacaacaagtcttcaagccagcagacatcatcttcctcctcctcttcttccttatcatcgcgttcttcatcatcaactgttgtacaagaaatctctcaacaaacaactgtagtgccagaatctgattcaaatagtcaggttgattggacttacgatccatatgaacctcgatactgcatttgtaatcaggtatcttatggtgagatggtgggatgtgataaccaagattgccctatagaatggttccattatggctgcgttggattgacagaggcacca

SEQ ID NO: 12936 - DNA, 442 bp, Homo sapiens
tctttttgcattatcccatcgattcgctcaggctgatctcaaactcctggcctgaagcaattttcctgtttcatcttcccaaagagttgggaataggagtgggagccactgtgctagcctatgctttacttattccaaaaaaataacaagaatggaaagaggaaaaataaacctgaaagcgagttgagatacattaatccagctgtattttaaatgagaaacataaccacaccgacggggattggtgaagggaagatggaaaatctaatccaagtgatttatcgacacatcaaatgtgtttgactgtatactggcagttgtggtgggggatgggactgcaagaaaaatcttgaggccaggcgctggtggctcatgcctgtaatcttaacactttgagaggccgaggcaagatcacctgaggtcaggagttcgagaccagcct

SEQ ID NO: 12937 - DNA, 427 bp, Homo sapiens
  misc_feature 359: n = A,T,C or G
ggcacgaggagagagagagagagaactattctcgagagcagtttttttttttttttttttttaaaaaagggggaccccttgggttccccaggcgggagggcagggctgaaatttgggttaatggcaccctccttttctaaggttaagggaatctccttcccccccccccctaaaaagcgggaaaaaagggcacttccccccttccccagttaatttttgttttttaaaaaaaaaggggggttcccaagggggccaagagcagcccctgttcgtgcacaaaggcaccaacatggagaccgtccaaaactgtcgcatttaggggactgaccccaccgtccaagcgatattgggttttaaantggagggttattatctcttgcgggacatcgggtgagttgacccatacccggagcctgccaaaaataag

SEQ ID NO: 12938 - DNA, 418 bp, Homo sapiens
ggcacgagaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttaaaaaggaagcttggctttgccccccagcctgaaaggcaggggcccaatctcggttaattgaaaacttggcctcgggaataaaggcaattttccggcctaaccctttaaggaactgggaataacgggcccccggccccccccccgggttaattttggattttaagggaaaagggggtttaacattgctgcccaaatggttttaaat

SEQ ID NO: 12939 - DNA, 375 bp, Homo sapiens
tactgttgttagaagacgacagaaggggtacacatgcacacacgtacaggagcgtgcacacaaacacacgtgcatgcacacacgcatgcacacacgcacacatgtgtgcacacatgcacacatgcgcgcacacatgcacaggagcctccaaacacacgtgcatgcacacacatgcacacactcacacgcatgcacacacgcacacaagcaaacacatggacacacacaaacgcgcacatgtacaggagcctgcacacaaacacacgtgcatgcatacacacgtacacaaacatgcacacacacatgggccaggcgtggtggctcacgcctgtaatcccagcactttgggaggccaaggagggtggatcacgaggc

SEQ ID NO: 12940 - DNA, 384 bp, Homo sapiens
ggcacgagacctagaaagagagtgcaatgaagaactttgcaattatgaggaagccagagagatttttgtggatgaagataaaacgattgcattttggcaggaatattcagctaaaggaccaaccacaaaatcagatggcaacagagagaaaatagatgttatgggccttctgactggattaattgctgctggagtatttttggttatttttggattacttggctactatctttgtatcactaagtgtaataggctacaacatccatgctcttcagccgtctatgaaagggggaggcacactccctccatcattttcagaagacctgaggaggctgccttgtctccattgccgccttctgtggaggatgcaggattaccttctta

SEQ ID NO: 12941 - DNA, 401 bp, Homo sapiens
  misc_feature 1, 2, 3, 4: n = A,T,C or G
nnnnacgagagaaaggataggaaggaagcatgagagagaatagggagaagtgaacagggatgcagagcgaatgccagtttcagccaactccaaggacagccctggagctggaatggcctttacagctgccccatggcgacagaggcggccaggcttctatacccctacgtggatcactcactgtgcttgggcaccttgggaaagggcatggctttgagcaaaaggctctctgcagctgaggcaacccctaccagggctgacggctgaagtctgtctgctgaccactgtcccagcagctggggcttgttagtccttcctcaaagggggatccagatggcatgtcacagtgtctacctgaaatgctcactgaatccagctgcaatgcaagaagactccctgat

SEQ ID NO: 12942 - DNA, 406 bp, Homo sapiens
ggcacgaggtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcaaaagtgtctgcgggccctgaccggtcgcaggtggcggtgcgagtgagcagcaccaaggaggcggcagccgaggccaaaaagagcgtttgtcgccggctagattacataacgcatagcctccagcagcagggcgtgcaggcagaaaatataactgtgacaaaggactttaggagagtggaaaatgcttatcacatggaagcagaggtctgcattacatttactg

SEQ ID NO: 12943 - DNA, 399 bp, Homo sapiens
ggcacgaggtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcaaaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattact

SEQ ID NO: 12944 - DNA, 399 bp, Homo sapiens
ggcacgaggggggttgtggccgagctgtactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatg

SEQ ID NO: 12945 - DNA, 407 bp, Homo sapiens
ggggccagcccagccctttgagatgtcgaggttggcataacacaaagccaaaagagaaagaacatcctggccaacgtggacaaaccccagctaaaacgcaaatgtaactgggggtggaggtgcaagcctggaaacccaattgcttgataggctgccgctagagactcacttcaacccaggaggagcaggatgcgcagagcttatatggtcccactgcactccaacgtgagtgacagataaaacctcatctcctaaaaaataataataatattctagcatgtttatatgaaaataattgtgctttccaaaacagaaataaaaatagtgagaaatgtgtcattgttttacatctctatatcaaatgtatagactacaggtagatttccttatctgcttctgcagtcatt

SEQ ID NO: 12946 - DNA, 353 bp, Homo sapiens
  misc_feature 338: n = A,T,C or G
tatcggctgcgagaagacgacagaagggtacggctccgagaacacgacagaagggtaatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggngaaggggagaagaag

SEQ ID NO: 12947 - DNA, 340 bp, Homo sapiens
  misc_feature 340: n = A,T,C or G
tacggctgcgagaagacgacagaagggtacggctccgaaaagacgacagaagggcattggtaaaatagacaaaatggctactcttaatctaccattctcactgggttgttgtgaggacacagataattaagaaaaacataataaatatccaaattagaaaatggaaaaggggccgtaaccctactcctaacctggtcattttaacctcctgtgccctcagtttcttcatctgtataatggacataggcctggtgtggttgcaagaagcagctaaaaatcaggaaaaagaacatcatgtattcagctatgcacacttccaacgttgctctttactgaggcn

SEQ ID NO: 12948 - DNA, 417 bp, Homo sapiens
ctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctgg

SEQ ID NO: 12949 - DNA, 407 bp, Homo sapiens
  misc_feature 273, 276: n = A,T,C or G
cgttgctgtcgaaagactcagcccaagtataggatgccctttttccctttgtttttttttttttgaaaagggagtttggttttgcccccaaaggtggaaaggcagggccagaatttgggttaactgaaatacccccctccttgattaaggaaattttcttgcttaaccctcccgggaagtgggaatggaaggcccccccccccaccccgggtaaattttggatttttaagaaaaaacgggttttaacaatttggcgcagggtggttttaaacnatnaacctaagggaattaccttccttggccctccaaaaggccgtgaataaagggcgtaatgcccggccccaaacaaaaaagggggtttttctaaataccgggggggtggggtttaaaacaatactttgacaaaa

SEQ ID NO: 12950 - DNA, 423 bp, Homo sapiens
ggaaatttgggaagaatccaagaagtataggccaatgaaaacaagttattaatacaaatagtactgtatatgagagtacacattacgaatgctgtgctttaatgcataaacatgtttacagtggtccacatgtgccaggagatgtgggaatggctacccctgaagtcatatggagaaatggggtcctcatcgcacaccatacacaaacatcatctcacaaatggattaaagacacttaagacctgaaaccaaaaaaactcctaggagaaaacacaggggaaagctccatgacatcagtttcggcgatgatttttttttggacatgacactaaaagaacaagcaacaaaactaaaagtaaacaggtgggattacattgaagtaaaaagtttctgcacaacaaaggaaacaaccaacaaaatgag

SEQ ID NO: 12951 - DNA, 410 bp, Homo sapiens
ggcacgagagcgcacttccctccggagacgttagaaagtgcattttggcgtcacttaagggacggtgtagtgagttccggcttcactggttccaattctgtcccattgttcgttgcatgtgaacttttctggatttcagttctttcatccggggcctgccggtgccgtaaacggccattcaaagggaaaaacgaacacgcacaccaaagcgctagcttgcgttcctgcgcatgcgcagtgacccgagcggagaggccgaggcgtagcctaagcgtgggattccgcgcgtgcgctcggctccgcctggtgcggccgcggccgggagggactggattatgtcggccccgtttgaagagcggagtggggtggtaccgtgcgggaccccgtggggccagtggaccagaccttgg

SEQ ID NO: 12952 - DNA, 416 bp, Homo sapiens
ggcacgaggaaacgtttgttgttttggtcttcacaataaaccttggtaccgccaactctttggtccgtgccatctaaaagcgctgtgacactcaccgcgaaggtcccggctttattcctgagaccacgaacccaccggcaggaaccaactccagactactatgtgctacagagaacttcttcaggccttgaaaatagaacatagtaaaaagcggcttctttgtccatggatcagcagtcactatttcccagctcgcctccaagagctaactaaagtgcagcataaactgcatgcagcattgttttcaccacagcaaacccttcggggtgcctcctagcggcggatggagaactagcattgcgcgagagcaggaatgggccacttgtgtgtaacaaaagatggactgcgcttggaag

SEQ ID NO: 12953 - DNA, 431 bp, Homo sapiens
cgttgctgtcgaagactgaggtcgttgattctgatggatcagtgaaagacaaaatcacagcattcatagtagaaagagactttggtggagtcactaatgggaaacccgaagataaattaggcattcggggctccaacacttgtgaagtccattttgaaaacaccaagatacctgtggaaaacatccttggagaggtcggagatgagtttaaggtggccatgaacatcctcaacagcggccggttcagcatgggcagcgtcgtggctgggctgctcaagagattgattgaaatgactgctgagtacgcctgcacaaggaaacagtttaacaagaggctcagtgaatttggattgattcaggagaaatttgcactgatggctcagaaagcttacgtcatggagagtatgacctacctcacagcagggatgctg

SEQ ID NO: 12954 - DNA, 335 bp, Homo sapiens
  misc_feature 265, 335: n = A,T,C or G
tacggctgcgagaagacgacagaaggggaggagacacagaacatggcggtagggatggcagtctaccctgtggcaacgcggaagtcacgctgccgcaaggggcgcattggggcccatacgaccccagaacgcaaatgataggtaggcggacctttcccgcttgcgcgcatactcagctacgtaagactccttccttcacctttcctttctttgcctttcctttccctgacgctggaggaagaagggcaggggttctgtgccatangcggcctttctggtgcagaggaccttccccatcctccatcatgtgagcagccagagccgggcgctcgaan

SEQ ID NO: 12955 - DNA, 408 bp, Homo sapiens
  misc_feature 408: n = A,T,C or G
ggcacgaggcacactgcactccagtccagtcacggggtcctgggccctgagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgagctactagctactgttaatcccctcagctgtgacctcctaccctcccaaagacctaccttggggaggaatgatactttccaaaccacccctcctggggtccatgcttgccaacaactgcattgttgctggtggctgttcctagtcttccactctgccttcttagctaagctcctggcgagtggggcctcagcacctgcctcgccatgcn

SEQ ID NO: 12956 - DNA, 353 bp, Homo sapiens
tctactgctgcgagaagacgacagaaggggctaacatttgctccatcaagcagataggtaacagagtctaggactggccatatagttaaagaacctaccgtcaagcaggagtagtgttagaaattgcttgatggttgtattagcctgatttcatgctgtgatacagacacaccccagactggggagtttatagagaaaaagaggtttgattgactcacagttccacatggctggggaggcctcaaaatcatggtggaaggctaaaggatatcttacatggtagcagacaagagagaatcaggaccaagcaaaaagagtttccccttgtaaagctatcagatcttgtgagactt

SEQ ID NO: 12957 - DNA, 352 bp, Homo sapiens
tactgctgcgagaagacgacagaagggtacggctgcgagaagacgacagaagggtgtagataacagaaggcactaaatcattgaagatttgacccttgctcatagacttctctttacttggaataacacttcgacctgcctacaaatcttcaacagtttatttcagctattacctcctttataagatctttcctagtcttcctagatcctcttagttctacctacaaatactttatttaactttcaatattatctgtgcacctctggctctagccactaccaatttaaaagctttttgtatgttatctatttctcagtctgcttaaaacaaagaatacataaatgaacggcg

SEQ ID NO: 12958 - DNA, 346 bp, Homo sapiens
tacggctgcgagaagacgacagaagggtacggctgcgagaagacgaccgaagggacatgtaaacaataatttggtgtcgggaaggtaggcgtcagccaagcaaagcaggaaggaaacggaggagagggtgccttgcttgaatgggggcaccgcaggggttttcctgccctgtgcttcatctgtgctatgctctaccttccctccagtcagtcataaaatcccctgtttgctgcccccggctttgcttccccacactgactatattagagtcctcatttgcagagcagcactgcaagctaagtatttgtagcacagattaaagagactgaggagggtcctggggagg

SEQ ID NO: 12959 - DNA, 335 bp, Homo sapiens
tacggctgcgagaagacgacagaagggggcggccaccataatgatactatatgtgtccaagctaaacaaaatcattcacttccctgattttgataagaaaattcctgtaaaggtaagtaatgaaaagtatgtatgactgtgatagaagatgtgaaaatacacattgattttagagtacaggtcaatttctatacacactgtacttcctgcctgcactggatagaaacttctttttttgtttgagatggactgtcgctctgtcgcccaggctggagtgcaatggtgtgatcttggctcactgcaatctccgcctcctgggttcaagagattctcgc

SEQ ID NO: 12960 - DNA, 375 bp, Homo sapiens
cgttgctgtcgctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacg

SEQ ID NO: 12961 - DNA, 389 bp, Homo sapiens
ctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggtgcagatcttggtggtagtagcaaatattcaaacgagaactttgaaggccgaagtggatcacttgagctcaggagttcaagaccagcttgggaaacatggcaaaacccgtctttatgtgcctggaatcccacctgctcaggtggctagggtggatggatcgcttgagcccaagaggtggaggctgcagtg

SEQ ID NO: 12962 - DNA, 387 bp, Homo sapiens
ggcacgaggcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttg

SEQ ID NO: 12963 - DNA, 373 bp, Homo sapiens
tacggctgcgagaagacgacagaaggatacggctgcgagaagacgacagaagggtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggag

SEQ ID NO: 12964 - DNA, 379 bp, Homo sapiens
tacggctgcgagaagacgacagaagggtacggctgcgagaagacgacagaagggctcacacctgtaatcctagcattttggacgctacggcataagcattgcttgaagccaggagtttgaggccggcttgggaaacagtgaaatcctgtttctacacaaaataaaaaaaattagtttgctgtggtggtatgcatctgtagtcccagctacttgggaggctgaggtgagagaatcacttgaacccagaagttcaagactgcagtgaactatgatcgaaccactgaacttcagcctgggcgacagtgagaccccttctcaaaaaaaaaaaaaaaaaaaaaaaaaaaagggggcccttttttccctaaacccaaccttgaaa

SEQ ID NO: 12965 - DNA, 410 bp, Homo sapiens
ctgcgctagtcctaaagaggaaatgtctctactctgcgtggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagcgttggggaggcggagaatatgccaccgccacagccacga

SEQ ID NO: 12966 - DNA, 396 bp, Homo sapiens
caaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactggtggtgatg

SEQ ID NO: 12967 - DNA, 358 bp, Homo sapiens
  misc_feature 85: n = A,T,C or G
gcctacggctgtgagaagacgacagaagggtacggctgcgagaagacgacagaagggcttctcaattttccctttgacgcaaaanttactcactcagtttctaaagaaatattttttaaaaagggcttcagtatacgttagttctctcatctagacctggttgctctaatcggtgacatgaaatgcaggctttttaccatcgtaagcagcactaatatgaacttggaaatatttttaacacgcgaaaggctaacaagatgactcagcaataccaaagacaggcctgaatgtccgttactaacaaatactgaaaccctttttaaaaaatatttatctaggaactgagcgagaaattttt

SEQ ID NO: 12968 - DNA, 413 bp, Homo sapiens
  misc_feature 413: n = A,T,C or G
cgcacgaggaagaaaaatgtttgtaatctattcatttgataaaagaccaatattcaggatattcaagaaacccaaacaattcaacagtaaacaaataagcccatgaaaaagtaggcacactttttctatttacctccataaatagacaattgtcaaagagagacttacaaatggccaacacgaatatgaaaaaatactcaatgttcccaatcatcagggaaatgcaaattataaccacagtgaaatataatctcatcccagtttgaatggctattataaaaaagacaaaaaataaccaatgctgatgaggaggtagagaaaaaggaactcttgtgcactggttggtggaaatgtaaaccagtacagccactgtggagaacaatatgaggtttttcaaaaaactaaaactcatn

SEQ ID NO: 12969 - DNA, 398 bp, Homo sapiens
ggcacgagacaaaatgaagctttaaaacagataaaagaaatctacaattccccatttaagtaggctgttaaatccaacatttaaaataaaaattaagctatttcttttgggtttcccacaccacttttacctgtactgattttttttcttcttttttttttttaaaaaaacagggttttgttttgtcactcccaacctggagggcagggacccaataatatttccttacagcctcaaattcctgacctcaagggatctccttcccaaagggttgcaattgcagggggaacccactgcccctggttgttgaaaaatttttgcctacagggagggaaactactaaagttcctggggaaccaaagtaaaatttcttaaaaacaaaagggagggagaggaga

SEQ ID NO: 12970 - DNA, 340 bp, Homo sapiens
tacggctgcgagaagacgacagaagggggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcctgtgccttgagtggcagaggagccgtccagccacaccagctttcctcccaccgctcagggcagggaggtctgaactgcggccccagagcctttggcctaagctggactctccttatccgagtgccgcctctatccccttccccacgt

SEQ ID NO: 12971 - DNA, 383 bp, Homo sapiens
cgttgctgtcggagaattccagtttttctcacatcctcatcaacagttgttattgtctggcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatagacttttcagcccaaatgtttttat

SEQ ID NO: 12972 - DNA, 415 bp, Homo sapiens
  misc_feature 415: n = A,T,C or G
ctcaggctgatctaaactcctggcctgaagcaattctcctgtctcatcttccgaaagtggtgggattacaagtgtgagccactgcgctagcctatgctttacttattccaaaaaaataacatgaatggaaagaggaaaaataaacctgaaagcaagttgagatacattaatccagctgtattttaaatgagtaacataaccacaccgacggggattggtgaagggaggatggaaaatctaatccaagtgatttatcgacacatcaaatgtgtttgactgtatactgtcagttgtggtgggggatgggactgcaagaaaaatcttgaggccaggcgctggtggctcatgcctgtaatcttagcactttgagaggccgaggcaagatcacctgaggtcaggagttcgagaccagccn

SEQ ID NO: 12973 - DNA, 421 bp, Homo sapiens
ggcacgagaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttaaaaagggatttttgttttgtcccccagcttgaaagccaggggcccaatctgggttaatggaaaactttgcctccggaataaaagcaatactccggcctcaccctttaaagtaccgggaataacggggcccctcccccccccccgggttattttttgtttttaagggaaaacggggtttacccttgctgcccaaatgggtttaaaactg

SEQ ID NO: 12974 - DNA, 162 bp, Homo sapiens
  misc_feature 7: n = A,T,C or G
acctatnatggaattctaatgtcattattttaatggaatcaatcgaaatatgctctatagagaatatatcttttatatattgctgcagtttccttatgttaatcttttaacactaaaggaacatgacataatcataccatagaagggaacacaggttaccat

SEQ ID NO: 12975 - DNA, 381 bp, Homo sapiens
cgttgctgtcgggctgtgaggcgctggggaatctcaaaaaacttcagccggggacaatcaaaaatctgaagcaggacaattggggagagagagatcactcttcttgaagagatcatcatgcagttgtagatccttttgttctagaaaggccacaagaagctgagaggaagtctgattcctcagtgcgcatggggatgggattggggtgggctggtctggtggtggagccaccggtatggctgacaagatagggggtgggtcagtgtggggcaggggttgagagtgcgggccctgggtcagcctgcttatgtatcagtcctgcctctgccacttactatgcaacctggagcaagtgaacacctcagggctcagagtcttcat

SEQ ID NO: 12976 - DNA, 400 bp, Homo sapiens
  misc_feature 1, 2, 3, 400: n = A,T,C or G
nnnacgagatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtcn

SEQ ID NO: 12977 - DNA, 335 bp, Homo sapiens
tacggctgcgagaagacgacagaagggctactatgttcctgataacctgatactgctccgttaatcctcgtgggttgatacttgaaagatatattaatcctcatggagcaggatcagattaccaggaacataggagtggattcctgtccaaaccaaattgcattcctttggatttttaaatttaacttaattggctattctaaagagtccccctcacccaatgtttgatcattggagcccttaagatgcacaatgaaattgtgttttgcattttttggtaacaggactaaaggaaggacctggtaatgtatgctggagcattcttcttggaaggg

SEQ ID NO: 12978 - DNA, 387 bp, Homo sapiens
ggcacgagcattgctttgcttgtgcattttgtccaattcttggttcaaaatgccaaaaacctggacaacttgtagtcaaggccctccactggcaacatgtatatgtgtttttgaggtggtaggtagctgagattgaagatgagtggatttatgaattgaataacaataaatatcctacttaaaaatgttaaaagttggaaatcatctcttattgtgataacatatttctcctccctgggaatctgttggacagattggagctggcagggtagggcctgtattgttgaagttgccatggctactgcaggaagtgagctttcttctaaaaacctcactggcccaagaacaagcccaggcaagtctacaattcaatgacttagaagtatt

SEQ ID NO: 12979 - DNA, 395 bp, Homo sapiens
ggcacgagggtgtggagagggcagtggccctcatttatcactctgaccttcacagggacagatctgatttatttattttggttaaaaaaaaaaagggaacaaaaccaactttgcattgcatgggctggacccataaactaagttatatccgggaaaaaaaaaaaaaaaaaaaacccccttaaaaataatggggggggttttcccgaaaccccaacctgaaaaaaacccttggggggttggggccacccccccctaaaaggccgggaaaaaaaggctttttttggaaaattgggggggctttggttttttttggacccctttaaacccggaaaaaacaagttaacccccacaatgggttttttttttttttccagggcccgggggggggggggggg

SEQ ID NO: 12980 - DNA, 399 bp, Homo sapiens
ctggtgttagggtactttgtttttgaggtttggcagagatgtgtttaagagctgcggctcacaagcgaggggaggtgtgggaggtttttctattggagaataacaaatgctaagggtgacgtggaagaagttcaaggacctggagtagttggtgaatttccaatcatcatcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaacaagaggaggaggaggaatatgag

SEQ ID NO: 12981 - DNA, 399 bp, Homo sapiens
  misc_feature 290, 291, 295, 297, 298, 299, 301, 303, 304, 310, 312, 399: n = A,T,C or G
tgacccttggactctcagacaccttgaggttcagcagaggaaaaaggtaccacaaaagaatttgaacagagggcctgatgaaacagtgaggtttcacataacccaagcaaagaacatttttcaagagaaaaagaaaggacagttccatctattgatgtttgagaaatcaaatgagattaggtgagagaagaaactattgtgggaactaaatgataagaacttacgaacacaaagaaggaaacaacacatactgaggtctacttgaagtggggggaggtgtgggaggtttnntatntnnntnanntatgananttaaactgtgtgtaattaggggggtttattaaaaatttttttaaatgtgatagagaagcttaagaaatgtgtgtgctgttggggtgn

SEQ ID NO: 12982 - DNA, 385 bp, Homo sapiens
cgatgctgtcggcagaacactgatgagcttcccagcacagggacaggaaaggtggcttgcgggtctggaagaagggtcaggtggcatttacacagtgggagagggctgatcggagacaggcattccatgcagggcatttggaagcaaaatgtggaggtcaggccatgctgggctattcagagaaggaagtatgggacatgtcggtgaacccgaatgcctagtaaggcagctctgatggaggaagccaagctgatggcatctctctggcacttggcagcgatggccttcattacttacgtgctcctggctgggatggcactgggcattcagaaaaggtcagtgccaagccccttccttaccctcccctccctgtgagctcttctcc

SEQ ID NO: 12983 - DNA, 334 bp, Homo sapiens
tacggctgcgagaagaccacagaagggtacggctgcgagaagaccacagaagggtacggctgctagaagaccacagaaggggaaaataaaaaaataaaacatttttttgggccctttttttgcgaagttccaactttatcaaaatctttttataatttgggccaacccccaattaaagtgttgggaaaaaactttttttttgggaaattttggaaccttttgctttttttggacccctttaaacttggcataaaccagttaaccccccccatttcctttttttttttttttaagtacacggggggggggggggagggttagcttctgttgaaac

SEQ ID NO: 12984 - DNA, 422 bp, Homo sapiens
  misc_feature 301, 302, 303, 304, 305, 306, 307, 308, 309, 310, 311, 312,313, 314, 315, 316, 317, 318, 319, 320, 321, 322, 323, 324,325, 326, 327, 328, 329, 330, 331, 332, 333, 334, 335, 336,337, 338, 339, 340, 341, 342, 343, 344, 345, 346, 347: n = A,T,C or G
  misc_feature 348, 349, 350, 351, 352, 353, 354, 355, 356, 357, 358, 359,360, 361, 362, 363, 364, 365, 366, 367, 368, 369, 370: n = A,T,C or G
cgttgctgtcgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaatccccgcgatacttcaacgccttctgacttccaggtgatgactgggcccccaataaatcccgtctttgggtcnnnnnnnnnnnnnnnnnnnnnnnnnnnnnnnnnnnnnnnnnnnnnnnnnnnnnnnnnnnnnnnnnnnnnnaaaaaccccccgcggcgccttttgttagaaaaaaacaaaaaaaaaaaaaaaa

SEQ ID NO: 12985 - DNA, 421 bp, Homo sapiens
  misc_feature 421: n = A,T,C or G
ggcacgaggggctggggcgccccccacttgcatctcagagaccccggaatgcaaggcctcctgcagctgcacccagggcgccccacagtgatctggggattaggacgctcaggtgtccgggccctgcccacagcgcctgggcgggagctgctgtcacacccagcaggtgcgggccgagcaggacccaacagagggctcaggagggcaaggcccaaccgggagccacgtggaacccagaggaagccgccccacccagcttggccacagccatcttccctcctgccggacagggtgggccggccaccgagcagaccagtgcccccgccttggtcccgggtcagcagccccagggtccccttgcctcatctggggcggctgtgggctctggcgctcctctctggctgaggtggaaacagagacn

SEQ ID NO: 12986 - DNA, 398 bp, Homo sapiens
ggcacgagaccgtgttggaggcccattgcagaatattgactttacccagcgaccgtttcatggcatctcaacagttagtcttccaaatagtctgcaggaagtagggcacagaaacagggggaggattgggtgtttttcctgtttctgtgccctacttgagtcctctaatacttcgtctagaacttgaatctttgctagataatgaaggtgatcaggtgattcatacatcttctttcatcaatcaacatccaatcattttctggaacctcgtttggtatttcagacgtttggaccttcctagtgacttgccaggacttatcctcacatctgaacattgtaatgaaggtgtacagctttctctgtcatctctgttccaggatagcaaacttgtgtatatt

SEQ ID NO: 12987 - DNA, 421 bp, Homo sapiens
ggcacgagagatgacattttctccgatttttattatgttcggttcacggagcggctacatgaagttctgaaggatggtcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccacactggccagaaagttacagatgacatgtatgcagaacagacggaaaatccagagaatccattgagatgtccct

SEQ ID NO: 12988 - DNA, 386 bp, Homo sapiens
cgttgctgtcggaataaaacattttacttaaacacaaagagcatcagtgacctgtgggacaactttatgcagccttattatctatggtgattggcgtccctgaaagagaggagtggggagggagatggaataggaaaaatacttgaagacataatggccaaagattttctgaatataataaaaactaagtccacagatccaagatgctcaacaaaccctgagtatgagaaatatgaagaaaaatatgccaaggctcatcataacttgctggaaaccagtgttaaaaagaaaatcttaaatgcaaccaggggagaggatagttacttgcagtggaacaaagacgaagttgacattacacttctcattggaaacaatgccagtaagca

SEQ ID NO: 12989 - DNA, 415 bp, Homo sapiens
cgttgctgtcggaggaacaaataaacacttatgacatacagaaaacaaaaagttagaatggcagaagtcagtccagccttatcaatagtaacattaaacgtgaatagatttaacaattcattcaaaagacagattgttatattggatcagaaaacaagatccagttatatgcagcctatagaaaacacactttcaattcagagataaaataggttgaaagtaaaggacagaaaaagatgtatcatgcaggcagcatccacgagaaagctggagaggctgtacttttaaaaagttggagggacagagtctcactctgtcacccaggctggagtgcagtggcacgatcagctcactgcaacctccacctcccgggttcaagcaattctgatgcctcagcctcccaagtaattgggat

SEQ ID NO: 12990 - DNA, 411 bp, Homo sapiens
ggcacgagactgaccatgccccttggacaagttatttagtctcccggagtctgtttgctcatctctaaagagagggtgatgacagtacctttttcccagggttacagagggattgaatgagatgatggatggcccagtgcctggaggacagtagcactttgtccttaatagggattttagcaataaagccagcatgaaatttatttttcatgcccttagatttgaaaatttatgacttagaatgtgtgtacttcttaggttaacctgcccttcgtcacctcatgaaaagtaagacagacttaggtggctgactttggagggttttttttgttatatttgctttcattatagatcagcaaccgttggaagctggcccaggtacaagtacaaaaagactctaaagaagctgtt

SEQ ID NO: 12991 - DNA, 406 bp, Homo sapiens
  misc_feature 311, 312, 313, 326, 327, 328: n = A,T,C or G
ttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcatgaaataggcaggcctatgaagaaaggccttttactcttccagcatgcaagctcagaaccaacacattactctctgtgcctaatgttcctcaatgtggttgatttttttttttaatttatagagcatttcgggggaggtgtggggagtttcctnnncactttatctccnnnttacaaaaatttgaggtgcaaagggaaggcccgattttttttttaatgaatttttttttattagatctcgagggttat

SEQ ID NO: 12992 - DNA, 409 bp, Homo sapiens
ggcacgaggtaaaacaccccctacatgttccaattctgggcctgtcttctatctatctttgcccttctggtccgttccctgttctgagccccagggaacttagggctgaaagtcacccccgaagcctcagaccagatcgggaggccacacgcagctcatggggacagagggcccagggtgacggtccactcatgagaagtgctatgtgactccagggagtctgtccctctccgggctccaatccccagcccaagctcagatgacccagcctgtgtccctttagcggccgaggagccaccacctgttcgggggctggaggatggcttcccagaggacctgggacactcacctagctcgttcatggcacggcggtactcctcatcacaggacagcttcataacagcacagg

SEQ ID NO: 12993 - DNA, 406 bp, Homo sapiens
  misc_feature 10: n = A,T,C or G
ggcaccaggntgtccagagcgttgttcatctctacgagctcctcagcgctctgcagggtgtggtgctgcagcaggacagctacattgaggaccagaaactggtgctgagcgagagggcgctcactcgcagcttgtcccgcccgagctccctcattgagcaggagaagcagcgcagcctggagaagcagcgccaggacctggccaacctacagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcg

SEQ ID NO: 12994 - DNA, 399 bp, Homo sapiens
ggcacgaggtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattat

SEQ ID NO: 12995 - DNA, 425 bp, Homo sapiens
atcccatcgattcgaattcggcacgagctaaccaggacggcccagtaggcagagctcatttttattcctgtctgcaatcgtgcaaaaacgcctcttatggaaaagccagagcgccaggagtcagcaaaacacactaaagattgggcagtcactggggagaacactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagct

SEQ ID NO: 12996 - DNA, 404 bp, Homo sapiens
ggcacgaggtttttgtttttaagagatggtgtctcgctgtgttgcccaggctggaatgcagtgactgtttacagctgcgatcatagcatactacatcctcaaactcctgggctcaagcaatccccttgcttcagcctgccaagtaactgggactacaggcgcactgctgtacccggctttgtgtttgttgaaataatttgaaagggtatgctggaagcatattaaagtggttattgaagcagatctgtgttgggggtgatggggagagaaaatgtgggctccagttgagtttaaggcaggagtgtccaatcttttggtttccgtgggccacattgggagatttgtcttgggccatacataaaatacactaatgctaatgatagctgatgagctaaaataaaaaa

SEQ ID NO: 12997 - DNA, 376 bp, Homo sapiens
  misc_feature 376: n = A,T,C or G
ggcacgaggagcggcgcgccggttccttggttcctgagggcgatggcgcggggtggctggcgccggctacgccgcctgttatccgtgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgccccctcaatttcgagtcn

SEQ ID NO: 12998 - DNA, 326 bp, Homo sapiens
tacggctgcgagaagacgacagaagggcatctataggaaaaagtctttccctatggaagctactcccttaaactagaagaggcgactgttccaccagatgcacagatatcaacataaagacccaagaaacacaaagaagcaaaaacaaaacgaaacaaaaaacacacaaacaaatgaaacgaaacacaacacttccaaatgaacataataattctcctgttacagaccctaaagaaaagaaaatctatgaaatactacgaagaacttgaaaataatgatcttaaggagactcagtaagatataagagaatacagaataacaattca

SEQ ID NO: 12999 - DNA, 393 bp, Homo sapiens
ggcacgaggggaccactaccaccaagacgtggagatcgacagtggcccctaaagcctggctgcgctgttatttattggatacaaagcagatggggcagggtaaagagtttacacattcggcaaagcacagggcaacagcgatctctaatggaaggcgcagcgttaccgtctcatgcgggaattccactctcggcccgcgctggccccgccctttatcgttattttccacttgcgcctactgctcaggcaattgtgcaggcgaccccggagcccccagccgttctccccggccctcgagcatttacgggtttacctttctaatgaagcccaacggaagctgctaacgtgggaatcggtgcataatgagaactttctgctggcacgcgctatggg

SEQ ID NO: 13000 - DNA, 390 bp, Homo sapiens
ggcacgagccacaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaa

SEQ ID NO: 13001 - DNA, 349 bp, Homo sapiens
  misc_feature 212: n = A,T,C or G
tatgtacttcgattgcgacatgacaacatacagtgatgagttggtgcaatgcactcctacaaggcaacgaaagataagctctatttagcaacttcgtgatgctatctggtttattgggaaccattataaactgcaataaactggctagctacgacaattgcatatcttgtatgttacaagattaaggggaggagcgtggaggcttagcttanagtcacaaaaggagaacttgaaaaacaaatgcaagaaaaatctgaccagctatagatgcatcatgccaaaataaaggaactagaagatctgaagagaacatttaaggagggtatggatgagttaagaacactgagaa

SEQ ID NO: 13002 - DNA, 410 bp, Homo sapiens
  misc_feature 395, 410: n = A,T,C or G
cggtgctgtcggaactggtggtggctccagcaggtgtgacgatgaaagagggaaatgagatcctgcagcgtagcacgaaaggtaccagggagctagttgaaaactcaacccccagcctgactccctgtccacagtcccgttgttccttcacagccttacaggttatcccagcaaccagactgagccctggggaaggttcgaataacctcaggcaggccagagcacaactcctgccatccttctcttagcttagggaagcttgcccctagagcagcatcttcatagtatgtttcccaaaactagtcctatgcgatgctcatcagaaaaaaatcctgagcaataactcctttctctatcccctatcttgcataaagaattgcacattcacttattanaggctctcagaagtn

SEQ ID NO: 13003 - DNA, 390 bp, Homo sapiens
ggcacgagacatcttctcctacttctacatggtatacggcggcagctcgggcaagccctccgagaagaacctctacgccgacatcgacgccgcgtggcaggcgctgcgcacccggtatggcgtgagtcccgagaacattatcctctatggtcagagcattgggactgtccccacggtagacttggcctcgaggtatgaatgcgcagcggtaattctccattcccctctgatgtctggtttgcgtgtggcttttccggataccaggaaaacatactgctttgatgctttccccagcattgacaagatatctaaagtcacctctcctgtgttggtcattcatggcacagaggatgaggtcatcgatttctcccatggcctagcgatgtacgg

SEQ ID NO: 13004 - DNA, 424 bp, Homo sapiens
  misc_feature 424: n = A,T,C or G
ggcacgaggaggcgatgaagggaaaggtgggaaagttaggctctcgtaaagcctagaggatgtggtggggccatacaatacggggagtaggccttttgggtagaatctacatgaaatgtattaggcgatgggaggggggcgccgacccgcctcagcgcgcatgtgcatcggaaacttttcctgggctcttcgaccctcggtcggctccccttaccgggcatgcgtattgcggccagttgggccttcgcaaagtgctcagggaagtgtagtgtgcagggaaagtaggtcactcctgctatcgcctggtccggaggtgtttgaggactacaattcccagagtgcagagcgggccctcaccgcccgcctctccgcctacgtttgggttgagtcgagttttcctggctcctgaggaacatggagtgcn

SEQ ID NO: 13005 - DNA, 395 bp, Homo sapiens
tacggctgcgagatgacgacagacgggtacggctgcgagaagaccacagatgggttccgctgcgagaagaccactgaaggggacggctgcgagaagacgactgaagggtacggctgcgagaagacgactgaagggtacggctgcgacaagacgacttatgggtatcggctgcgagagacgacagaatggtacggtgctaaaagacgacagaagggctacggctgcgagaagacgacagaagggttacattacatgatgcttcaatactagataaaccaggcttttgtgtcaaagctagattataggatttggagtttaactttcttttcccagcaaggtagtggccatctgagtcagctggcaaaaactgggaggattagtgatcaagaaattgt

SEQ ID NO: 13006 - DNA, 423 bp, Homo sapiens
ggcacgaggtgaaagcccaagtttagatgtgcattaagtattaaatagcacagtatcttcttcatggagccttttttcctcccccatcccctgcagctgcctttttttgggggaagggggggaaggttttttgaactttaaaaaattaaaaatatagcttattgaataaccgccataaaaaatataaatgcgaatatcataaaactcatactgctaaactaaattttttttttttcttgtaacggagtcataactatgataccaggctgtagtgcagcggcacgatcttggtatattgaaagctacaccttccgaggtcactccatcatcctgcataaaccgtataagtagctggcactacaggtgacagccaccatatccagctaattttttttgtgtttttacaaaaagagagagaaaaag

SEQ ID NO: 13007 - DNA, 409 bp, Homo sapiens
  misc_feature 409: n = A,T,C or G
ggcacgagagatggctcatgggccaccagaagcattactgtattattagtatgatttaacctggacatgcattaaagggtctattacctttctttccgtctgcctcaacagctgagaaggggccgccaaggagtgccaaccttttgctccctcctatctgggagtgacggatgggagagcgtgcgcccaagagggggcgtctcctggctggcaaggagggaaaggcagcgagaggtgcgcgcaggttggcagtcgtcagcaagctggcaatgagaaggctccgaactgatgaatggaaacctgctgagctggagggcgctaggctgaccttgccgagcatctctgacagcaatcggcacagctctctttggaatagaggaaagaagctaaacccacccgccggaggatn

SEQ ID NO: 13008 - DNA, 417 bp, Homo sapiens
gttgctggcccttgattgctggaaggattccgaggaaaaggacaacaacctgtgtgggttccctcccgacaactgaaattgcaccataactcccaagaagaaacactcccagaaacaaaaggcaaagacccctctgaaaccaaagagcaagtatcaccgcctgacacataaacttcatgacctcgacattgagacaaaatctcgccgtgtgacctacaacaccactcatttaactccaccaacttggggtcaaataaaggtcttatcccatcaacagaaaaatcattaagagaaaaatgaatccccaaaacgacagtctgcagatcccgcaaggaatccgaagacaagtccaaagtcaacgacaagcaatgatggcaatggtgatcctagttaataaaaagcggggagaatgtgtgg

SEQ ID NO: 13009 - DNA, 337 bp, Homo sapiens
tttacgcctgcgagattactactgaaagggcagccttgacctcctaggctaatggaatcctcccaccttagcctctccagtagctggaactacaggcatgcatcaccatgcccagctgattttaattttgtaaaggcaggaccttcctattttccccaggctgatctctaactcttggcctcaagcaatccttcctctttggcctcccaaaatgttgggattacagatgggagcccccatacccaccaatcacaaggatctttataagagaatgaggcaggagagtcagaattatagaacgtgatgcggtaatggaagaacatgtcaaagagggacg

SEQ ID NO: 13010 - DNA, 375 bp, Homo sapiens
tacggctgcgagaagacgacagaagggtacggctgcgagaagaccacagaagggtacggctgcgagagacgacagaagggcagcccctcctgggggcacctgagagggttctgtccagacgatcccggtgacagttgctgtggaatttccatgctgggcacacttgaggcccaaagctccgattcccaagaggcgccacagcaaccatgccaggaaactgggccaggctgagggtggcaggagagggagacaggaggaggcaggaagggggcagggcctgtcagatggatccctgacaaccatccgtctcaagtccgaggtaaccttatatctttgcctcagcagataggatgactttgtatgtagggccttcag

SEQ ID NO: 13011 - DNA, 428 bp, Homo sapiens
  misc_feature 20, 24, 25, 26, 27, 28: n = A,T,C or G
ccactgaaactctcggaaancccnnnnnccccatcgattcgaactcggcacgagggacaggctgcgggaggagctgcaggactgatgtacagaggccaggggcccagggcaggacccagcctggacttgactccctgggatcccaggaagggcacaccctttcctcaccacccgagtgagcgctgccccctcacagagacctctttgccccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcagg

SEQ ID NO: 13012 - DNA, 384 bp, Homo sapiens
ggcacgaggagagcaggtctctgctctggtggtgattttactcaagaggggatgtgaatatttatatttttgtgtggatttctgtgtaggagtttttgtatgtatggaagaaagagaagaaaatactcaaatacctgaggataatttgctcaggagtcaaagtgataaactagtttaatgaattaaagcatggttttccatgacaatttttaattacatcctttgccaagacctctagaaaattacacctgctgagcagatatcccaaggagcatgtgctattttaagatccccttggttttctttgacagaagagaaatcagcaggaggacgactgatgagcgtgctggaactggagaagaggaggccccgccccaccgctcc

SEQ ID NO: 13013 - DNA, 345 bp, Homo sapiens
tacggctgcgagaagacgacagaaggggggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacacactcgcatactcatgcacattttccttcatttccagatcctttag

SEQ ID NO: 13014 - DNA, 425 bp, Homo sapiens
  misc_feature 373: n = A,T,C or G
ggcacgagattccagttctggatatatacccaaaagcattgaaagcagggtcttcaagagatagctacacacccatgttcatagcagtatatgagttaaagaaagaggaaagaaacatgaaaagtggctcaatagtcaaagacaggtttattttgaagaataaacctgagaggggcttctggctgatttcggtcaggagcatgttctctcacagactaagattatttaagggttcagggagagacagcttatgacaggcttggaatgtttctgtgtaagggagaagtttatggcggggttggaatgtctctggtcagaggggaggtgaccttggggctgacatctctcctgctggagaggaggttatctcggngctggcatgtctctataaagggaggggtttggaatgtttctggtcagaaatg

SEQ ID NO: 13015 - DNA, 402 bp, Homo sapiens
cgttgctgtcgggcatcccgggggctttgataggagttgtccgggaccccacggagatgagggttcagagggtggtgagggcacataggaggggaggggaagcctggctctcaggcctaggcccctatcctgccccagggcaggtccaggccctggaccccgcctagcgtaggctagtgtgtatccctggaaccagaagagagtaggtgggctctggaggcctcaaaggacccccgctagactctgtgatccccacgccccagaacatgcgtgggcgctatgaggcaagccaggacctgctgggcaccctgcggaagcagcttaacgacagcgagagtgagcggcgggccctagaggaacacctgcgtggcgccgtcggtcttgtcccgcaggcactggcca

SEQ ID NO: 13016 - DNA, 386 bp, Homo sapiens
cgttgctgtcgacgaaagtgcctaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccgtgggacttgggtaaataag

SEQ ID NO: 13017 - DNA, 407 bp, Homo sapiens
cgttgctgtcggggctcaagtgatcctcacgccttggcctcccaaagtgctgggattataggcatgagccactgtgcttggccaggatttttttttttttttttttggaaagggagttttttttttgttgcccaggcggaagggcaagggggaaatttgggttaatggaaccctcccctttcggggtaaaagggattttctggcctaaccctcccaagaagggggaataaaaaatctgcccccccttcccaactaaattttgttttttaagaaaaaacggggtttttccttgtgggcaaggggggtcttaaactcttgacctaaaggaatcggcccacctgggcctccaaaagggcgggaataaagggcggaaccccttgttccaaaaggaaatttttttttaatag

SEQ ID NO: 13018 - DNA, 426 bp, Homo sapiens
cgttgctgtcgaaaatgaaaagacaagccatagactgggagaaataatttgcaaaacatacatcttacagagcacttgtgtccagaatgtataaagaactctttttatttgcgtgtgtgtgtgtgtgtgtgtgtgtgtgtgtgtgtgtgtgtgtgtttaatacagacactgtctatgttgcccacactggtcttgaacccctggctcaagagatcggtctttctcaccctcccaaagtgctaagattacaggtgtgagtgaccacgcccagccaagatctcttaataaggcagcccgcgcttggtggtatatgcttgtaattccagctctttgagaggctgaggtgggaggatgatttgagatcaagagtttgagactagcctagggaacacagggagaccccatctctacataaaattaaaaaaa

SEQ ID NO: 13019 - DNA, 375 bp, Homo sapiens
  misc_feature 44, 45: n = A,T,C or G
ttcgaattccgctgctggcgacgatttgctttagggtcggggcnncgtacgtagcagagcaggtccctctctgcgatctattgagagtcagccctcgacacaagggtttggacacttttaagaaacaaagatagttttctgaacattctgtgtcctgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggaaaatgcaggtttatgaatgatgtggacttttagaggatcaaatcaataaattggattttttattttttgagggg

SEQ ID NO: 13020 - DNA, 388 bp, Homo sapiens
  misc_feature 388: n = A,T,C or G
tacggctgcgagaagacgacagaagggcatctataggaaaaagtctttccctatggaagctactcccttaaactagaagaggtgactgttccaccagatgcacagatatcaacataaagacccaagaaacacaaagaagcaaaaacaaaacgaaacaaaaaacacacaaacaaatgaaacgaaacacaacacttccaaatgaacataataattctcctgttacagaccctaaagaaaagaaaatctatgaaatactaagaagaacttgaaaataatgatcttaaggaaactcagtaagatataagagaatacagaataacaattcaacaaaatcagaaaaacaatttctaaactgaaagagaaattcaacaaggatggagataccatn

SEQ ID NO: 13021 - DNA, 417 bp, Homo sapiens
ggcacgaggttactctttcattcactcaagaaatgatttcttgagttcccggcctttgttagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggggtgcgtgggtgcctggagatgaagctggaaagagctgctgcccaaagggagcaaggaggaacagcgggattacgtcttctacctg

SEQ ID NO: 13022 - DNA, 340 bp, Homo sapiens
tctatcggctgcgagatgacgacagaagggtacggctgcgagaagacgacagatgggtacggctgcgagaagacgacagaagggaattatgtaacatttctgtacacagtacatcagtggacttaattagggtgcctcctacctcttacacaaatgaaatgctttgtgacaggtattcttcctcttgaaaggcttttttaagaaaaaaaataatttttaactgtatactagataatctgagattgcaaaaggagcaccagataagggaggtgttaccatgctgtgcagcagaagaaggcttataattaagcgtactacactttaatgctggggttattcg

SEQ ID NO: 13023 - DNA, 351 bp, Homo sapiens
tacggctgcgagaagacgacagaagggtacggctgcgagagacgacagaagggtacggctgcgagaagacgacagaagggtacggctgcgagaagacgacagaagggtacggctctctacttacaacctgctttctctgctgaagccttacctcctcttcagtttccctcctagacacaaatcgaaaataatatactgatagctggttagtaacctcagtaagaattaaaactgagggtgtttactcattttgcctttaaatcttttatccccttttggtgaaggtttccctttaggaaaaaaggtgtcaaacaaccctgagttttttttttttggcaccatttttataag

SEQ ID NO: 13024 - DNA, 342 bp, Homo sapiens
  misc_feature 304: n = A,T,C or G
tacggctgcgagaagacgacagaagggagaagaaccatggaacatcttaacaaagaaaagatagagttgtaataggatttgggagaatagtggagtttatgtgaaatttaaacaaagcattgttttgataggctaaaagcagtgtaaggctgtgtaaaggggtcaacatcaggtctgaactgtcaatcagacccagggttctgtttgcttggaaactacaaagttaacataaatgtgggatttttgtcttcaaaaacttcttctttgaagctctataccttggttgtaaattgaggctacttanaaattatacgtgtaaattgagtgacttagatctgccat

SEQ ID NO: 13025 - DNA, 395 bp, Homo sapiens
atccgatgctgccgaaaccacaaagctacatactgaccctctttttttttgagacggagttttgctattgtgacccaggctggagtgcagaggcgcaaccttggcgtcactgcaacttccgtttcccgggttcaagggattctccggcctcagcctcccaagtagctggttttataggagcccgccaccagacccggctaattttttagttttagtagagacggggttccaccacgttggccaagctgggcttaaatgaccctcttatttttaacttggatacctgctattctgccaaaagacaatttctagagtatttatgaatgggttgattatccccactcccacaaactctgaagccagtgtctagcttactaaaaaaagagctgtatata

SEQ ID NO: 13026 - DNA, 160 bp, Homo sapiens
gaacttcctacacaacccgtgtattcatcccccagacgtttaaattgtgcggaaatatctagtatcagctttcatgttacagacccagccccttgctctacctctggagtcacagctggattaactaaattaactacaagaaaggacaactatactgcag

SEQ ID NO: 13027 - DNA, 422 bp, Homo sapiens
cgttgctgtcggagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagt

SEQ ID NO: 13028 - DNA, 154 bp, Homo sapiens
  misc_feature 11: n = A,T,C or G
gatcaactcanccaggacccgccagcagatgcatgatgcccatacctttcacagcaactctgttttgacccaagaagatgcagcagctgctggggatcgcagaccagcccctgaccctggatttatccgctgattcagatgaagcccttcgaag

SEQ ID NO: 13029 - DNA, 351 bp, Homo sapiens
tactgctgctagaagacgacagaagggtacggctgcgagaagacgacagaagggtacggctgcgagaagacgaccgaagggtacggttgcgagaagacgacagaaggggactgcggcttgtgccgcttccgcatgaaggtttcctggcctgttgcagccatggtgcattgcacctgcgtgttgttcagaaagattcccaaatgctggaaaatcctctttgctaagctgcgtgtcttatgcagaacctgctattgccgattacgcatttacaacattacagcctgaacttggaaagatcatgtctcagtgattcaaacagatattagtagctgatcttccggctttaataga

SEQ ID NO: 13030 - DNA, 391 bp, Homo sapiens
  misc_feature 282: n = A,T,C or G
gacccttgcactctcagacaccttgaggttcatcagaggaaaaaggtaccacagaagaatttgaaccgagggcctgatgaaacagtgaggtttcacataacccaagccttgaacatttttcaagagaaaaagaacggacagttccatctattgatgtttgagaaatcagatgagattaagtgagagaagaaactattgcgggaactaaatgatactaacttactaacacaaagaaggaaacaacacatactgaggtctacttgaagtgaggggaggtgttgnaagtttatcacacaccaaaagaagtgagggtccccgaaccaggagaacggagggtaccacaggacaatcgctgccccccaacctcgtagcaacagcggtaccgtgggag

SEQ ID NO: 13031 - DNA, 396 bp, Homo sapiens
  misc_feature 6, 7, 8: n = A,T,C or G
gggttnnngccggcctacggctgcgagaagacgactgaaggatacggctgcgagaagacgacagaagggtacggctgcgagaagacgacagaagggggtccggcagaacctgcatcgccccggagcttatgagaggtgtgaattcatggacccatcctggaatcagaatcaggccccacttctgcatcagaagccctgggtggcaccagcaagtgtttggcaagcccttgagaagcagtgtctttgagaacgtgacctgtgccccaggcaccagatttactccccgagcccagcaggacatctgcatataacacacagccgaagtcagaaaatatatttttggtgactaaacggagcacctggagtacatgataacacacacacacacacacacac

SEQ ID NO: 13032 - DNA, 179 bp, Homo sapiens
cgttgctgtcggagagacagaaggaactggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgta

SEQ ID NO: 13033 - DNA, 352 bp, Homo sapiens
tctactgctgcgagaagacgacagaagggtacggctgctagaagacgacagatgggtacggctgcgagaagacgacagaagggtacggctgcgagaagaccacagaagggtacggctgcgagaagactacagaagggtacggctgcgagaagactacagaagggtactgctgcgagaagacgacagaagggtacggctgcgacaagaccacttaagggtaccgctgcgagaagacgacagaagggtaccgctgcggtagaccacagaagggctattgcatgccagcagctatctggggccctgggacatctgtgccagtccttgagcgcggagccgctccagccaccgttct

SEQ ID NO: 13034 - DNA, 333 bp, Homo sapiens
tacggctgcgagaagacgacagaagggtacggctgcgagaagacgacagaagggtacggctgccagaagacgacagaagggatatactaagagaaagccatcccttcctcagtccagaggaggaatcctaattaagccaatcaggtaatttcattctgctctgtcagtgactggccatgaggacagatgggaaaatctagaagcttctggaaatatgtttctctcttctacaccttctacagaaggtgtgggaggaagagtgccctttctcctctcacccttcctcccaaccggtagaaaattcaacagaattatttttttaaatgctggcat

SEQ ID NO: 13035 - DNA, 346 bp, Homo sapiens
tacggctgcgagaagacgacagaaggggctccaatcaaggggttctgggtctgtaacagggcttaagtttaggaactgattaaggagctatgactggtgatttaagttaggcatctgttcacttaccttagaactcttccttttgtacagatcaatttagaatttagtggaatgcccatcttttgtttttttctaggaacactatgaccagccagccaatgctgtaggtttctgtgaatcagactattcagattattgctttgactttgccgtccattatggtaaccataactactttatctttagtgattaagtgctgccacttggcccctgccaccccaggatg

SEQ ID NO: 13036 - DNA, 343 bp, Homo sapiens
tacggctgcgagaagacgacagaaggggtgagactctgtctcaaaaaaaaaaaaaaaaaaattagacttcaaaaggggtgggctcctgaaatcccgcccttttggggaccataacccagggcgggaggatcactcgacccagggaattaaaaataaccctgaccaaaataaaccccgtttttgaaaaaaattttaaaaaactaacttggcttgggggctcacccctgtagccccacctattaaggaggctgggtggggaggaccacttgattctaaaaggttaaggctgccttgaccctttatcacaccactgttttccaccctgggtgacaaaccaaaatct

SEQ ID NO: 13037 - DNA, 403 bp, Homo sapiens
ctgggatcatgccattgcactccagcctgtgtgatagagcgagacttcgtctcagaaaaaaatctaattttaaagtcttaagattttgccattcctcctactcccaaacaaatctttggggaaaaaaaaactaccaactgtcagccatgggcctgacggcgctaagctctggggctccgtgcactgacgtggggccagccacagggaggcggggatcaagtagcggaggccaggattttggccacctcccgggcaagttgcagggcagtggcgccgggagcaaaagcagcatgatgcagctcatgcacctggagtccttttatgaaaaaacctcctcctgggcttatcaaggaagatgacactaagccagaagactgcataccagatgtaccaggcaatgaac

SEQ ID NO: 13038 - DNA, 357 bp, Homo sapiens
tatcggctgctagaagacgacagattggtacggctgcgagaagacgacagaggggtacggctgcgagaagacgacagaagggtacggctgcgagaagacgacagaagggtacggctgcgagaagacgacagaagggcctctcctacaccccagggccttgtcatcagactccctcagctccagacctccctgtgcagtaactcccccctcaaagaattcacatccctggacagcagtggaccttttaaactataaagcccattctgctcctacttttagacgatcctaccaagtttagagaagaaggtatctaggattgaaagtaccccataagaagatattccgaataccatagag

SEQ ID NO: 13039 - DNA, 404 bp, Homo sapiens
  misc_feature 404: n = A,T,C or G
ggcacgaggccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccaccn

SEQ ID NO: 13040 - DNA, 372 bp, Homo sapiens
tctacggctgcgagaagacgacagaagggtacggctgcgagaagacgacagaagggtacggctgcgagaagaccacagaagggtacggctgcgagaagacgacagaagggtacggctgcgagaagacgacagaagggtacggctgcgagaagacgacagaagggctgcagcagaggagttgggagatcagtctcaaatccatgtccctgactaactaaaattgaagggttatatagcagaaaaggaatgtagctatgtgcaggaaaacagcaattagagaggggtaaggaagaggagttgtcaataggaagcaggtggtcccttagtaaaccaataattacagcaggtaaagaaacaatcacgatgaatgag

SEQ ID NO: 13041 - DNA, 387 bp, Homo sapiens
cgttgctgtcgcattggctttgcttgaatttttgcttggttggttagtggaattagaatgaataggttttaaggccatttatggtggctcatacctataatcccagcactttgggaggccaaggcgaaagaatcagttgaaaccaggagctcaagaccagcctggacaacatagcgagacccccgcctctataatttttttttttttttaaattatccaagtggggcggcacacccctttagtcctatctactctggaagctgaccaggaggatggcttgaccccaggagggcaaggatccagggagctatgattgccccactgctttccaccctgggtgacagagaaggaccctgtgttaaacaaaaaaaaaaaaggcccgggacc

SEQ ID NO: 13042 - DNA, 342 bp, Homo sapiens
tacggctgcgagaagacgacagaagggtacggctgcgagaagacgacagaagggtacggctgcgagaagacgacagaagggcttctgatagcattggctattataagaaacaagtatttgctctcgtttttaacgggataataatgctatgtctacataaaatgatttctgccaccttaaatagctcactgtagaaattcatgtataaatggaaccatatagtacatacatatactcttaggtctggcaaatatttgaggttcatccatattttatattcactcatcagtagttgtaaacacattcttaaagtagcattttcagttatgaataagcaaggat

SEQ ID NO: 13043 - DNA, 338 bp, Homo sapiens
  misc_feature 338: n = A,T,C or G
tacggctgcgagaagacgacagaagggtacggctgcgagaagacgacagaagggtacggctgcgagaagactacagaagggtacggctgcgagaagacgacagaagggtacggctgcgagaagacgacagaaggggcttcacgacttatggcatgtcttatttaaaaaaaaaaaaggactaggggcaaataacattttgagggggtatttaattaaaaatccatgcagggacagctgagttcgggttttatgttgggctaatacttcctaaaattatttagaacaggactggctagaaaaactttctgcgatgatgcaagggttctatgtctatgctn

SEQ ID NO: 13044 - DNA, 393 bp, Homo sapiens
ctttaggaacgagtttctgcctgtgcactgaagaatttgcctccaaagacatgacgccactgaagccagcagaaatgcaggaagccaacctaacaagcatggggctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctg

SEQ ID NO: 13045 - DNA, 325 bp, Homo sapiens
tctacggctgcgagaagacgacagaagggtacggctgcgagaagaccacagaagggtacggctgcgagaagacgacagaagggtacggctgcgagaagacgacagaagggtacggctgcgagaagacgacagaaggggacccagaattatctgggtcaataaaaataattggcctattcttctataattgttggggctaaaatgaccaaataaattagttcacttcagtaacctaaactcaagcattcctatgtgccttgctctctttcttgcctctgaatcttatacatgagtatatgctttaaatggacaatagcatattatc

SEQ ID NO: 13046 - DNA, 325 bp, Homo sapiens
taccgctgcgagaagacgacagaagggtacggctgcgagaagactacagaagggtacggctgcgagaagacgacagaagggtacggctgcgagaagacgacagaagggtacggctgcgagaagaccacagaagggtacggctgcgagaagacgacagaagggtacggctgcgagaagacgacagaagggtacggctgcgagaagacgacagaaggggctcgcgatagccagccgcggctgcccttgcgcttcccgagctggcggggtccgtggtgcgggatcgagattgcgggctatggcgcccaaggtttttcgtcagtactgg

SEQ ID NO: 13047 - DNA, 375 bp, Homo sapiens
tactgctgcgagaagacgacagaagggtacggctgcgagaagacgacagaagggtacggctgcgagaagacgacagaagggtacggctgcgagaagactacagaagggtacggctgcgagaatacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagactacagaagggtacggctgcgagaagacgacagat

SEQ ID NO: 13048 - DNA, 377 bp, Homo sapiens
tactgttgcgagaagacgacagaagggtacggctgcgagaagacgacagaagggtacggctgcgagaagacgacagaagggtacggctgcgagaagacgacagaagggtacggctgcgataagacgacagaagggtacggctgcgagaagacgacagaagggtacggctgcgagaagacgacagaagggtacggctgcgagaagacgacagaagggtacggctgcgagaagacgacagaagggtacggctgctataagacgacagatgggtacggctgcgagaagacgactgaagggtacggctgcgagaagacgacagaatggtacggctgcgataagacgactgacgggtacggctgcgagaagactacagaagg

SEQ ID NO: 13049 - DNA, 337 bp, Homo sapiens
ttacggctgcgagaagacgacagaagggtacggctgcgagaagaccacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagaccacagaagggtacggctgcgagaagacgacagaagggtacggctgcgagaagacgactgaagggtacggctgcgagaagacgacagaagggtacggctgcgag

SEQ ID NO: 13050 - DNA, 336 bp, Homo sapiens
tacggctgcgagaagacgacagaagggtacggctgcgagaagacgacagaagggtacggctgcgagaagacgacagaagggtacggctgcgagaagacgacagaagggtacggctgcgagaacacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgag

SEQ ID NO: 13051 - DNA, 379 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggt

SEQ ID NO: 13052 - DNA, 338 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggattcaaaccaaaggcaaagaagttgaaaactttgaaaaaaatttagaggaatgtataactagaataaccaatacagagaagtgcttaaaggagctgatggagctgaaaaccaaggctcgaga

SEQ ID NO: 13053 - DNA, 334 bp, Homo sapiens
tacggctgcgagaagacgacagaagggtacggctgcgagaagacgacagaagggtacggctgcgagaagacgacagaagggtacggctgcgagaacacgacagaagggccttaatggtgggacttgcagaaaccgtggccatttttcatcacagcctttcctatactgtgtgacctcaagaacttcctgctttaggatgcccagttaataatatggtatctgtgggatggagtgaactctttaacaaatatttaccaaatacttactttgagcaagacactgtgcttggtgatggttgagtaccgagaagttgcaactggtggttcattctctg

SEQ ID NO: 13054 - DNA, 344 bp, Homo sapiens
  misc_feature 344: n = A,T,C or G
gcctacggctgcgagaagacgacagaagggtacggctgcgagaagacgacagaagggtacggctgcgagaagacgacagaagggtacggctgcgagaagacgacagaagggtttagctttttaattatgctaaatgacacatataattattctttaatatggaaatatggtatgtagaatttcatcattatgaaatttatatatcaaggaagtaataaatatgcccagcagatattccctaaaaattctataccattttagagggtttctttctttgctttcaccatgatgttcttcctaaattatcaataacacatatattaactatagtttttcattatccn

SEQ ID NO: 13055 - DNA, 353 bp, Homo sapiens
tacggctgcgagaagacgacagaagggtacggctgcgagaagacgacagaagggtacggctgcgagaagacgacagaagggtacggctgcgagaagacgacagaaggggcaaagccaagatcgtgccactgcactccagcctgggcaacagaaggagactccgtctcaaaaaaaaaaaaagaggggggctttttaagggaaaaaataattccctttttttttcataggcgggaggggcaaactttgccacaaagtatttaaataccttttaccttggttcaaaaaatctttaggggacataaaaccgtttttgggcgggggggttccccccgtgaacccaaccttttgggggg

SEQ ID NO: 13056 - DNA, 384 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaaggggacccagaattatctgggtcaataaaaataattggcctattcttctataattgttggtgctaaaatgaccaaataaattagttcacttcagtaacctaaactcaagcattcctatgtgccttgctctctttcttgcctctgaatcttatacatgagtatatgctttaaatggacaatagcatattatagatcctgagaaatcctgtgttaagtaatccttgagattttgcttaaccaagtatttctcgt

SEQ ID NO: 13057 - DNA, 403 bp, Homo sapiens
ttacgagcccagtgcgactcccaatacattgttgagtcccagcacgaggtctactgaggacctggcaggctcgcaggccaccctgagccagaggtccacacctgggtctaccccgagccggtggccgtcacccttacccacaggcatgccatctcctgaggatctgcgggtggtgctgatgccctggtgcccgtggcactgccactggaagtcagggcaccatgagacggagccggtctgggaagctgcacggcctttccgggcgccttcgagttggggcgctgatccagctccgaacggagcacaagccttgcacctatcaacaatgtccctgcaaccgacttcgggaagagtgccccctggacacaagtctctgtactgacaccaactgtgcctctcagag

SEQ ID NO: 13058 - DNA, 335 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtctagggccaccaaagagaggttaatcagataaagacagaaagtcccctgtgtgttttagccattagaaagtcttggggatcttgggtgagaccagtttcaatgtcgaggtggcggaggtagagtccagacaagccctcggggcattgtggctgggggagagggaaaatgat

SEQ ID NO: 13059 - DNA, 350 bp, Homo sapiens
tacggctgcgagaagacgacagaagggtacggctgcgagaagacgacagaagggtacggctgcgagaagacgacagaagggtacggctgcgagaagacgacagaagggtacggctgcgaagacgacagaagggtacggctgcgagaagacgacagaagggtacggctgcgagaagacgacagaagggtacggctgcgagaagacgacagaaggatacggctgcgagaagacgacagaagggtactgctgcgagaagaccacagaagggtacggctgcgagaagactacagaagggtacggctgcgagaagaccacagaaggataccgctgcgagaagaccacagaagggt

SEQ ID NO: 13060 - DNA, 371 bp, Homo sapiens
tacggttgttagaagaccacagaagggtacggctgcgagaagactacagaagggtacggttgcgagaagacgacagaagggtacggctgcgagaagacgacagaagggtacggctgcgagaagacgacagaagggtacggctgcgagaagacgacagaagggtacggctgcgagaagaccacagaaggggatccttgcatctgttacttagggtcaaggcttgggtcttgccccgcagacccttgggactacccggccccagcgcagctatgaacctggagcgagtgtccaatgaggagaaattgaacctgtgccggaagtactacctgggggggtttgctttcctgccttttctctgggtggcaacatct

SEQ ID NO: 13061 - DNA, 370 bp, Homo sapiens
tacggctgcgagaagacgacagaagggtacggctgcgagaagacgacagaagggtacggctgcgagaagacgacagaagggcccggctgcaaaacgacaatccatcggtacggctgcgagaagacaacagaagggtgcggctgctttaagacgacacaagggtacggctgccatatgacgactgaagggtaccgctgctataagacgacagaagggtacggctgctttaagacaactgaagggtactgctgttttttgaccacctaatggtacggctgcgagaagacaacacaacggtacggctgcttttttactacacaagggcacgggtgcgagaagacgattaagggtacggctgcgataagacgag

SEQ ID NO: 13062 - DNA, 377 bp, Homo sapiens
tacggctgcgagattacgacagaagggtacggctgcgagaagacgacagaagggtacggctgctagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggttggaagcagaaatgctctgatggccttgaagattgccttttgtattagtcaggattctccagggtaggatatatgtaaatatgtagaaagaaatgtattatgaaggactggcttatacaactatggaagcctggacatcccacgatctactgtctgcaag

SEQ ID NO: 13063 - DNA, 357 bp, Homo sapiens
  misc_feature 334: n = A,T,C or G
tactgctgcgagaagacgacagaagggtacggctgctagaagacgacagaggggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtctgtgcatatggagaccttcctattcctagaatgtgagggctggggcccaaagcaagtcccaaatgcagcagcttttctcttggtttaatcccttaagactttcttacctctgtagntaccaaatgggaccatatatttt

SEQ ID NO: 13064 - DNA, 447 bp, Homo sapiens
  misc_feature 425, 447: n = A,T,C or G
gagtcagctagcttgttgtttgggcctaagcgggctacggctgacagatgacaacagacgggtacgggtgcgagaagacgacagaagggtacggctgcgagaagacgacagatgggtacggctgcgagaagacgacagaagggtacggctgcgagaagacgacagaagggtacggctgcgagaagacgacagaagggtacggctgcgagaagacgacagaagggaggaaggcttttggcctgagctgctgagaggatggattccgggttcagcagtgacttgggccagagcagaggcagagagacaagttaggaagctcctccagtcatcccactgagagacgcgggtggcttggtccgggactggagctgcagaagtatgagggatggtcagactggatatttctgaaggcagggctgctgtancagctgtggtccggaggagtgn

SEQ ID NO: 13065 - DNA, 344 bp, Homo sapiens
tacggctgcgagaagacgacagaagggtacggctgcgagaagacgacagaagggtacggctgcgagaagacgacagaagggtacggctgcgagaagatgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtttttttttcttgctgcagcaacgcgagtgggagcaccaggatctcgggctcggaacgagactgcacggatt

SEQ ID NO: 13066 - DNA, 375 bp, Homo sapiens
  misc_feature 341: n = A,T,C or G
tacggctgcgagaagacgacagaagggtacggctgcgagaagacgacagaagggtacggctgcgagaagacgacagaagggtacggctgcgagaagacgacagaagggtacggctgcgagaagagacagaagggtacggctgcgagaagaccacagaagggtacggctgcgagaagaccacagaagggtacggctgcgagaagaccacagaagggtacggctgcgagaagacgacagaagggtacggctgcgagaagacaacagaagggtacggctgcgagaagacaacagaagggtacggctgcgagaagacgacagaagggtacggctgcgagaagacnacagaagggtccgtcagtccatctccaaagccct

SEQ ID NO: 13067 - DNA, 373 bp, Homo sapiens
tacggctgcgagaagacgacagaaggatacggctgcgagaaggcgacagaagggtacggctgcgagaagacgacagaagggtacggctgcgagaagacgacagaagggtacggctgcgagaagacgacagaagggtacggctgcgagaagacgacagaaggatacggctgcgagaaggcgacagaagggtacggctgcgagaagacgacagaagggtacggctgcgagaagacgacagaagggtacggctgcgagaagacgacagaagggtacggctgcgagaagacgacagaagggcgattcctgggatttgaccatgctcccttctcctccattcggggggaaaagtgtgaaatgaagctacatggacctc

SEQ ID NO: 13068 - DNA, 374 bp, Homo sapiens
tacggctgcgaggacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgaccgaagggaaccggctgcatatctatgacatag

SEQ ID NO: 13069 - DNA, 372 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggcacggctgcgagaagacgacagagggtacggctgcgagaagacgacagagggtacggctgcgagaagacgacaga

SEQ ID NO: 13070 - DNA, 381 bp, Homo sapiens
tacggttgcgatatgactacaggagggtacggctgcgagaagacgacagaagggtacgggtgcgagttgacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcggaagacgacagaagggtacggctgcgagaagacgacagaagggtacggctgcgagaagacgacagaagggtacggctgcgagaagacgacagaagggggag

SEQ ID NO: 13071 - DNA, 395 bp, Homo sapiens
  misc_feature 4, 6: n = A,T,C or G
ggcntnccccgcatcggcctacggctgctagaagtcgacagaagggtacggctgcgagaagacgacggaagggtacggctgtgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgctagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaag

SEQ ID NO: 13072 - DNA, 374 bp, Homo sapiens
  misc_feature 348: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggtggataactgtggtaattctagagctaatacatgccgacgggcgctgacccncttcgcgggggggatgcgtgcattta

SEQ ID NO: 13073 - DNA, 375 bp, Homo sapiens
tacggctgcgagaagacgacagaagggtacggctgcgagaagacgacagaagggtacggctgcgagaagacgacagaaggggagtatgctgggtgagagaatgcaagagggaaacaatcagcctgcggagctaacagaccagcttatacagggcctgtgtgtgaagtggtagagttcggagttttctctgaatttcaatgagggagaaggaaggtagcattaaaggctattaaccaataagacaccaagattcaatttatgttttagatcattctggaagtgctatgtagagcaagttagaggagagccagactagcagcagagacttcccagcagagttgggaaagtgctacagtaatcttggtgagaaatggt

SEQ ID NO: 13074 - DNA, 410 bp, Homo sapiens
ggcacgaggctcacagaggcagccacgaggctctacaccaagtattatataaaagccattaaatttgaatgcccttggacaagcttttcttaaaaaaaaaaaaggtgaatatacttgttaaaaatttttattaaaatccaaattttttgggtgaagccccaggcagcatgtggggccatgcaccatttatacttaatatttggggaggggaaaggggaattttcaaggtatatatattttatccctgcctatatttagaaatatgcctttacctttaacaaggctaaaattgctcggtggattatttcacaaaatacgctagggggaggcagtaatactatgttaagctattaatagatgctaaaagtctccaagcacagggcatattttatacggctcttttcaaaatg

SEQ ID NO: 13075 - DNA, 376 bp, Homo sapiens
tacggctgcgagaagacgacagaagggtacggctgcgagaagacgacagaagggtacggctgcgagaagacgacagaagggtagtaaggggaagctggaagactcagccagtctagcctttccacattccattagcagctgattagatgggcccacccagactgagggtggtctacctccccagtccactgactcaaatgttaactcctttggcaacaccctcatatacacacccaggaacaatactttgcatccttcaatccaatcaagttgatactcagtattaacatttcgaggctacaccctagaccaaacctacgccaaaatccatttcactatcatattcatcggcgtaaatctaactttcttcccacaa

SEQ ID NO: 13076 - DNA, 411 bp, Homo sapiens
  misc_feature 411: n = A,T,C or G
gcgttgggagccaggtgtcgtgccggacgtgcttggagcagcggctgcagggcgaggtggtagccgttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatgggagaagttgttattacacccccatatn

SEQ ID NO: 13077 - DNA, 384 bp, Homo sapiens
cgttgctgtcggccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggagg

SEQ ID NO: 13078 - DNA, 439 bp, Homo sapiens
gcggatcccatcgattcaattccgacgagccggcgagcagtccgctacggtttctccagcccttctttgagacggggaccaggggatggcagccatgcacctgacagcctggccccaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgtagatattcagactgacaatgatttgacaaaggaaatgtatgaaggaaaagagaatgtatcatttgaacg

SEQ ID NO: 13079 - DNA, 373 bp, Homo sapiens
  misc_feature 373: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggactcctgctcagcatggctgctttagggactgttctcttcacaggtgtccggaggctgcactgcagcgtagccgcttgggcgggcggccagtggcgactacagcagggactggctgccaacccctccggctacgggccccttaccgagctcccagactgggcatatgcggatggccgccctgn

SEQ ID NO: 13080 - DNA, 369 bp, Homo sapiens
tacggctgcgagaagacgacagaagggtacggctgcgaggagacgactgaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacgcctgcgagcagacgacagaagggggagcctcatctgcaatgtaggggccggcggacctgctccagcagctggtgctgcaccagcaggaggtcctgccccctccactgctgctgctccagctg

SEQ ID NO: 13081 - DNA, 421 bp, Homo sapiens
ggcacgaggagagagagagagatctagtttcgagagcaggctttttttttttttttttttaacctcggcaaaaaatttttttgaaaaaaccccccttaattggctactgggggatttaattcccgggatttttgggacgcccttggcttgaaagggggaaaagtttaaatttatggaaccaaacctggggcctatttggaaaatcaggcccttggggcaaaacagaaaaaatcttttgccccccaggatccgggattccctggggaaaaaaaaatcagggaaaaaaaccccccccttcagggaaggtctttgtacaaaagggaaaggtttaaaaaaaagggcgggggaaaaaaaaacggaggagggacgaggtttcaggaaaatgccagggaagggaaggcccctggaaaaaaccttttta

SEQ ID NO: 13082 - DNA, 398 bp, Homo sapiens
  misc_feature 334: n = A,T,C or G
ggagaaaggtgggcatagtacaacccccaggactgtgccttccccaggacaccctcatcccccccagtcaggatatcttgctgactgggtcacccttcttcacaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggngggctgaggtgttcacgaacagtcccagcccctggggctgcatgtccagttctgtgcggcatga

SEQ ID NO: 13083 - DNA, 396 bp, Homo sapiens
gaccactgctgccattcatgtgcaccatactatacactgcaggattcccctggtgggcaaactgctgctgggaaaaggagctgtaagtaaacaaatggtaatattacctctggaagtcactttagcgacaaagggcatgcccacagaaattactacaattgtgtcaaacattgctatacttaagctgggaatgttagagaaaactccctgacagcctgtgatccatttttcacagctttctgtactagacaccctaatagatatgtgcgtgcttgaaggactctcaaaatggacaagccaaatcacaccttctaatatgaacccagtcctttcaacctctccatccaaaaaggcttgactgaaaaatacattaagttcttggacttctgggactag

SEQ ID NO: 13084 - DNA, 408 bp, Homo sapiens
ggcacgaggtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagccaccctaaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagctt

SEQ ID NO: 13085 - DNA, 457 bp, Homo sapiens
tgtaggatcccatcgactcgaattccgttgctgtcgacctgcttctgggtcggtgttttgtacgtagcacagcaactccctcgctgcgatctattgaaagtcagccctcgacacaagggtttgtccgacagcaacggtggaataatatataccatgcttacgctagtcaagagaaagctagagtagaaatactaatatcaggcaaagcatatttcagagttaaacacaacatttttccactatttgcagtcaaaagtatcgagaacactctctttactctgctcaaagttacagagttcttttgtataaacattagaacacttatcacagcctgccaataatggagaataattccatgttgtatactatacaacactcttactaaagtccattagacagaaatatgtagcatttgagacaccttccaattataaaactctatgcagacaaaaattaa

SEQ ID NO: 13086 - DNA, 397 bp, Homo sapiens
gctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgag

SEQ ID NO: 13087 - DNA, 334 bp, Homo sapiens
  misc_feature 276: n = A,T,C or G
tacggctgcgagaagacgacagaagggtgggcttgacatgatatttattatgttatgatatattccttttatacttaatttgttgagagttgctttttaattatgaaaggttatgaacttgttttattattagttttgtcaaaggctctttctacatctattcaactgatcatatgattttatctttcattttgttaatgtgctatatcatttttataaatttgcatatgttgaaacagtcttgcatatcagagataaatcccatttgatcatggngtatgatccttttaatgtgctgttaaattcagcttgataatattttgttaacaatttg

SEQ ID NO: 13088 - DNA, 387 bp, Homo sapiens
  misc_feature 387: n = A,T,C or G
ggcacgaggcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaaaaggatctgcgctggtggcgcagcacccacgggccaggcatggccatgaactggccacagttcgaggagtggtcctn

SEQ ID NO: 13089 - DNA, 408 bp, Homo sapiens
ggcacgaggtttgcttagctgtcaacaaaaagaaaacctgaaggagcatttggaagtcaatttgagggttttttttttgttttttttttttgggaggggggaacggcccccaaaaggggggggggggcaaaatttttaagaaaaaagaaccttcccggttttttttttaagcccacaaggggctgggtttttccacccggcgggtttaattttaaaaaaatttaaaaaaacaaaacaaaggggggtttttctaatttggggaggaacccccccttggtccaaaagaaaaaggcgttaaaaaagaattccaaaaggaaaaccttggggggggcccaacgggccccgtgcccaataaacttttttctggggaacgggagggggagaacctccccccccttcccaaggcgc

SEQ ID NO: 13090 - DNA, 405 bp, Homo sapiens
attcgaattccgttgctgtcggttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagg

SEQ ID NO: 13091 - DNA, 400 bp, Homo sapiens
cgttgctgtcgacgacctgcttctgggtctgggtttcgtacgtagcagagcagctccctcgctgcgatctattgaaagacagccctcgacacaagggtttggacacttttaagaaacaaagatagttttctgaacattctgtgtcctgcctgtctcctgttgattcgcagatgtaatatcgagtattcatcaactggtctcaatttcctgaacacattcactgtatccctcattgtaaccgttatccccctgcttcaaaatgtgccagttccacttggtaataacgttgggaaaatgcaggtttatgaatgatgtggacttttagaggatcaaatcaataaattggattttttattttttgagggcagctgccctcacttgtttaaataaagaatcttac

SEQ ID NO: 13092 - DNA, 478 bp, Homo sapiens
  misc_feature 18, 19, 57: n = A,T,C or G
gcaggaatccccatcgannttcgaattccgggcgctcgtcgagtccattatatacantgtgacgtgccagcgtgatcataacttatgagtagcagacattggatagcagtattcttttcgtactagggtgtggacataacccgcactctagtaatgcgatcgccttataactgctcctattccgcagagaatattgtagaatgcgtatcagcggttatattgttttctcataatatagcgagcaaacatttctaggttagacaaccaacgaattgaattacaattttatgttgaagaggcattattaacatgtgtagaggggttaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatct

SEQ ID NO: 13093 - DNA, 412 bp, Homo sapiens
atcgattcgaattccgttgctgtcggctgattctcttcgcctatcggtgactgggctttccctatgttgcccaggtgcgtctcagactcctgggctcaaaagatcctcatcttctcaagtggctgaatatacacgctccagcgaccatgcctggctgaatgaagagctttgagattttgaagaaacaggaaccatgaaatttgctttgcaactgtttgcaacctttaaggaagactgaaaaggcattcctgaagcatgtgccttcagccgctacaagagcagaagcagtgggcattggatggagctgagtacaggaccatacaggctaattgcaccggcacaggaatcggatataacattatctgggtacccatggccagctgtgacttctccatccgcacctacacctatg

SEQ ID NO: 13094 - DNA, 171 bp, Homo sapiens
  misc_feature 11: n = A,T,C or G
taacgcatgangcatacacacgggctgtggactggtgggggctgggtgtgctgctctacgagatgctggtgggtgagtgcccgttcccaggggacacagaggaagaggtgtttgactgcatcgcaacatggacgccccctaccccggctttctgtcggtgcaagggcttga

SEQ ID NO: 13095 - DNA, 384 bp, Homo sapiens
ggcacgagctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaatt

SEQ ID NO: 13096 - DNA, 393 bp, Homo sapiens
cgttgctgtcggcaagatgctgctattgaagaggtagagatggaagattttgatgcaaatatcgaagaacagaaagaagaaaagaaagatgcccaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgtgagaagatcacagat

SEQ ID NO: 13097 - DNA, 389 bp, Homo sapiens
cgttgctgtcggtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcagga

SEQ ID NO: 13098 - DNA, 426 bp, Homo sapiens
ggcacgagggcggaggttgcagtgagccgagatcatgccattgcactccagcctgggtgacagagtgagactctgtctcaaaaaaaaaaaaaaaaaaaagggggttcccatattttggggggtataggaatatatgggggggggtctatttctttttttatataaccttccccccgggatttttgggtttaaaagttccggttacccccaaaccaaaatgggttttttacctttggagttttttttttggtccccctttttccttccaaagggggaaagcccccaaataccagggtctttaggagggggggtttagccaaacccaccccagggcaaatttttggggggaaacctgaaagggggaaaatatttggggcccttgccttttgtccaaccatcctgaaaaaaacccactttgtttttaaa

SEQ ID NO: 13099 - DNA, 383 bp, Homo sapiens
cgatgctgacggcccgttgtccccgcagtccccgacgggagcgccatggcccagccgccgcccgacgtggagggggacgactgtctccccgcgtaccgacacctcttctgtccggacactgctgcgggacaaagtggccttcatcacaggaggcggctctgggattgggttccggattgctgagattttcatgcggtgagactgctctgtgtcccttccctgctcctcgcttctccctgcccgggccctgctggatgcccgacccctggaaagatgttggtgggaggtagatgtcccctgctcacctacccgacaggatccaggtgcctgccagagggactggggagcggtcgaggattgccctgggggagtcaggacttcaa

SEQ ID NO: 13100 - DNA, 372 bp, Homo sapiens
  misc_feature 351: n = A,T,C or G
cgttgctgtcggagatttgcttattattgttgtactgctgccatttttattggtgtttgattattggaatggtgcgcatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcangaggctgaggagggaggtttg

SEQ ID NO: 13101 - DNA, 372 bp, Homo sapiens
ggcacgagattaacctcagaaatcctgtctggctggcagatttcaagtaaaaaaaaaaaaagggggggtgggggggacccttttttttctagtggcctttagggaaaaaaaatttaactttttttttggttgggcccaaatttttaagaaaaaatctccaattggtttcccctttgaaccgggtaaaggctaatacttgccacttttaaaggagggggggaaaacccccgggttttttttttaaaggaaaccccttgttggggggcggcccccttaaggggggggggggggttttttttctggccccttttggggatatcaggggtacttttgcaaaccttccggggggttttaatgggaaaccactacccg

SEQ ID NO: 13102 - DNA, 389 bp, Homo sapiens
ggcacgagggaggatgtcctcaacacccagtgtggctaccacgttcggctcaaactggagctggagcagcagggcttcatccacaccaaaggctgcgtgggccaacttgagaagaggctgcaggacaacctgaatgtggtggcgggagtcttcatgggcatcgccctcctccagatctttggcatctgcctggcccagaaccttgggagtgacatcaaggcagtgaaagccaactggagcaaatggaatgatgactatgaaaaccactgtgttacgcccaccatttgcgaggtcctgtccacggtggggcctcaacagaactctctgactggggcccctggcccggacccacccagacgacatgttttctttggcctgggtggatatag

SEQ ID NO: 13103 - DNA, 451 bp, Homo sapiens
  misc_feature 1, 19, 23, 25, 30: n = A,T,C or G
ngacatcctttacggccantcgntnttttntgaggaacccatgcgatgcgaattccgttgctgtcggaaaatcagaaagagtttttattttactagtgatttacaagtatgccctggacagagtttcaaaacaagatgcccaggaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctga

SEQ ID NO: 13104 - DNA, 409 bp, Homo sapiens
ggcacgagaacaaagccacccaaactgcttcttctgtcacagattcgttcccacctgcacaggagcgagcctcactggacgccggagcccgacacacctctcgattactgctatgtgcggccaaatcacatcccaatgatcaactccatgtgtcaggagtttttttggcctggcattgacctgtctgagtgtctgcagtacccagacttcagtgatggtgctctttataaaaaagtcatcattgcctttggcttcatggctcctgatgtgaaatacaatgaagcttacatttcatttttgttcgtccaccctgaatggagaagagcagggattgcaactttcatgatctatcatctgattcagacctgcatgggcaaggacgtaacccttcacgtatgaccaagcaacg

SEQ ID NO: 13105 - DNA, 396 bp, Homo sapiens
ggcacgaggtgactctaggtataggagtgtccaggccctgctcacccaggctagagcttatggagccagaaggaaggaggtgcatgttggggtgcaggacaggagggaaaaatactcgaattgcaaggtgagggcacagtctgtttatattgggttgaattaactcttctcccgatgccactaaagcaggaatcacactgcagatggcactgatttgattggcaagagacatgccaggaagaatattaagggaccaggcccctataattaggcctaatcatagcctgttgtttgaaaagggcatgagggacattcatccggcctggcactgtgccctagacctgctctcctgggtagtggggccctccattgcaacagaggtgtgggtgggcctgg

SEQ ID NO: 13106 - DNA, 412 bp, Homo sapiens
  misc_feature 412: n = A,T,C or G
ggcacgagggaggccgctgccgtcgcgcgccttggtttttctgttccttttttttttttttttttaaaactcctggctaaaacccccccacctttaaccccaaaaaaaattaattacaaccggggccccttggccccaaaatggccttaacccctaaaaatggaaaatttttgtcctaaagaaccccccccccgggaaaaaacggggggcctttttttttgcaaaaggggtttaatccggacccacttgttttttgcaaggccggcttgcgtttgcccattggggaattggggggaaattgcccttgtcttgtttggaagggggggggttatttccctgggaaataaagggtggtttctttttttataaaaaaaacttgttggaaaacaaacctttttatattaactttgan

SEQ ID NO: 13107 - DNA, 404 bp, Homo sapiens
ggcacgaggagagagagcgcgagagagagcgcgtgaggcagagagagagagagagcgagatggagagagagagcccgagagactgtgagagagccagagagtttgagcgtgcgcgagcgagagagagagagagagagatggagcgatggactgtgacagcctacaggaggaaaagcacggcttacagaaggatgtttccttcttgaggaagcagcactattagcactctgagtcaagatgagtgggaaaccatctcaataaacacattttggataaaaaaaaaaaaaaaaaaaaccggctctcggccctttaaaactatggggggcctttttccttttatccggggggggggaaacctttgttgggttggcccaccccctttttaatggccgggaaaaatagtt

SEQ ID NO: 13108 - DNA, 334 bp, Homo sapiens
  misc_feature 334: n = A,T,C or G
tacggctgcgagaagacgacagaaggggaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctn

SEQ ID NO: 13109 - DNA, 393 bp, Homo sapiens
ggcacgagaaaaagcagagtctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccaatgaggtggtggcaattaagaagatgtcctatagtgggaagcagacccatgagttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatat

SEQ ID NO: 13110 - DNA, 385 bp, Homo sapiens
ggcacgaggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagctaaagtgaatttcagagtaaaagtaaggcatgtttctgagcaacattgataatttcttaatttgcaaatttcttcttattttggtacttgga

SEQ ID NO: 13111 - DNA, 397 bp, Homo sapiens
cggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgag

SEQ ID NO: 13112 - DNA, 395 bp, Homo sapiens
  misc_feature 395: n = A,T,C or G
ggcacgagaccgagctcacactgcagagattcctcacttgagcttgcaatgagggacagccttcatacttgcctgactctttaatacacacgggagcactcacaccggacatactccctctgcatgttgggcacgcgcaaaaccattcattagtgttttctttctctcgaccacatgaaacgatgcacacagaacataagccgtatgaatgtaacgtttatgggaaaacattcagtttgcccagtttatttcatagacatgaaaggactcacactggaggaaaaacctatgaatgcgggcagtgtggcagatccttcaactgttggagctgctttcgatatcatggtgggactcacactggagagaaaccctatgaatgcaagcaatgtggaaan

SEQ ID NO: 13113 - DNA, 352 bp, Homo sapiens
tactgctgcgagaagacgacagaagggtacggctgcgataagacgacagaaggggcggttctatgctcacagtgtaaacaaaacagggaagcttgaacttggtagagcccactgcagctcagcaaggcctactgcctctatagattccacctctgggggcaaggcatatctgaacaaaaggtagcagacagcttctccagacttaaatgtccctgcctgaaagctctgaagagagcagtggttctcccagcacagagttcaagctccaagagtggacagactgcctcctcaaatgggtcgctgacccccgtgtaacctgactgggagacacctcccagtaggggctgacagg

SEQ ID NO: 13114 - DNA, 394 bp, Homo sapiens
ggcacgagggaggatgtcctcaacacccattgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcatatggaatgatgactttgaaaaccactggcttacgcccaccatttccgaggtcctgtccacggcggggcctcagcaaaactctctgactggggcccctggcccggccccacccagccgacatgttttctttggcctgggtggtttataccctg

SEQ ID NO: 13115 - DNA, 374 bp, Homo sapiens
ggcacgaggagagagatattgaacaaaattttcgcagcatagcggctcgctatggaacacatgtaggaactctgaagttggaatagattcgactgcattaaatgttggcgagagactctctttgatacattaataaaactgcttgcataagcagttctatggaagacactggtgtaattatggccggcgcacttgtacccgttttaatggtacatattcttgatcttccacatttttctttggttcttttttccttttttaggaaaaacaaaacaacacacttcttccttatgttttctcaagattcaagtgaacacatttacacatattaattccttaaagaaccccaaacgtttcctccctacaaaaccaat

SEQ ID NO: 13116 - DNA, 401 bp, Homo sapiens
cgttgctgtcgagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggca

SEQ ID NO: 13117 - DNA, 392 bp, Homo sapiens
  misc_feature 157: n = A,T,C or G
tacggctgcgagaagacgacagaagggatttgaggatagaatccgaggcattgatatcattaaatggatggagcgctaccttaaggataagaccgtgatgataatcgtagcaatcagccccaaatacaaacaggacgtggaaggcgctgagtcgcanctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacggg

SEQ ID NO: 13118 - DNA, 134 bp, Homo sapiens
  misc_feature 1, 2, 4, 5, 6, 8, 9, 10, 14, 15, 39: n = A,T,C or G
nncnnncnnncctnnccacccacccctgaaaaagcacancaaaaccccacgctgctggcggagctgcggctgctgaggcaaaggaaggatgaactggagcagaggatgtcgggcctgcaaaagagcaggcgggc

SEQ ID NO: 13119 - DNA, 393 bp, Homo sapiens
ggcacgagccggaacacgctgtcctcgcgcttccttcgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtgg

SEQ ID NO: 13120 - DNA, 452 bp, Homo sapiens
  misc_feature 341, 423: n = A,T,C or G
cgttgctgtcggatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagnttattactgccacatctccatgcatcagcaaaatggtggtgacatttttctagcctggcagaacagattacttaaagctatntcattttcaagcagacttgatgtgacttt

SEQ ID NO: 13121 - DNA, 403 bp, Homo sapiens
ggcacgaggtcctttttgggcgatgagtatcaatacaaatggattttgtgagtgactcatgaagtgaagaatgcaccagagtggatcacaagatggaatttagccaaccctagccttgcttgttaaaattttttttttttttttaaaaataactgcccgggtactgactttgctggcttggaacatctctttttttttttttttttcctgactaaggtctttgatgattctgaattagaaagacaaggcatatcttgcctgaagcttttatatttttaaaaaagcctgtcttcgggactgaaacaccaaatccgcaacatcatccaagagtacggcctggactaccgcctggatcctctggtccagcttttctgctcaaacgagatctccagaatatgggctg

SEQ ID NO: 13122 - DNA, 404 bp, Homo sapiens
ggcacgagcatgggttccctcccctcagattcttttgagccaaagaggaaacttccagctggtgcttgcgtgtcttctgtgtgcgtgaattatgaatcttttgaagttggcgccggacaggattctggtgcttacaactcattagattctgacccacagatattctttgccttggggtcttcaattgctatgtttctcactattcgaggagttgattggatagatgagaattacagccttcctacctgtaaagggttcttcactatttatcatccgcttgatccagtggcatatagattagaacctatgattgttccagatttggacctataagctggtctcattccacatcacaaaggcagaaaaagacttcatttagaattgaaagagagtctctctcgtat

SEQ ID NO: 13123 - DNA, 378 bp, Homo sapiens
cgttgctgtcgcattgatgatcattgctgagatccacactataattaggggcggcagaacaggtgtttttctaattctgctatccctttggcatttgttagttggaattcttctataaaaacataggccgggtacagtggctcacgcttgtaatcctagcactttcggaggccaaggcaggcagatcacgaggtcaagagatggagactatcctggccaacatggttaaaccccttctctactaaaagtacaaaaattagccaggcatggtggcacacgcctgtagtcccagctacccaggaagctgaggcaggagaatcgcttgaacccaggagacagaggctgcagtgagccaagatcacgccactgcactccagc

SEQ ID NO: 13124 - DNA, 419 bp, Homo sapiens
ggcacgaggtttaaggagaagcctgaggccccgactgagcagctggatgtcgcgtgcggccaggaaaacttgccggtgggcgcgtggcccccgggggccgcgccggcgcccttccagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggcca

SEQ ID NO: 13125 - DNA, 409 bp, Homo sapiens
ggcacgagagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagctgctgtggtgg

SEQ ID NO: 13126 - DNA, 390 bp, Homo sapiens
ggcgcgacgtctgctctgacacttttgatttggaggaatatgacgacggcgagaagcccctccatgtttactactgtttgtgcggtcagatggtcctagcgctggactgtcagttatagaaattgcccatgaggccccgggaccggtcccgtgtgattgatgctgccaaacatgcccataagttttgtaacacataagatgaggagactatgtatctgtggagacctgaacgcattgaacgacagtacaggaagaaatgtgcaacgtgtggactgccgctcttctaccaatcccagccaaagaatgctcctgttaccttcattgaggatggagcagtaatcaagtttggccacggttttgggaaaacgaacatatatactcagaaacaaa

SEQ ID NO: 13127 - DNA, 350 bp, Homo sapiens
tacggctgcgagaagacgacagaaggagacaaaaagaagaaagataagaagaaaaagaaaggagaaaaggaagaaaaagagaaagagaagaaaaaagaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaaagagaaaggaaaaggcccaaggaaaaagaaagaaaagaacgcttgaaaaaaagaagggaaacttttaactaaatcccagagagaagccagagcca

SEQ ID NO: 13128 - DNA, 341 bp, Homo sapiens
  misc_feature 341: n = A,T,C or G
tactgctgcgagaagacgacagaagggacaatacaatggaaaaatgcatagaaaaacaggaaagattttgtcaactaaaaaaacaaagtatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaan

SEQ ID NO: 13129 - DNA, 380 bp, Homo sapiens
ggcacgagggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttattttttttcccccctggggcctaaagcccctggtttagggggcttttttttttaaccccggggtccacaatgattgggggggaaaacccttgggccaaataacgggggaaaagaggttctacccctttttggtcaaaggcttatttaatccctttcgggggggaccaaacggtgggggaaa

SEQ ID NO: 13130 - DNA, 406 bp, Homo sapiens
atcggcacgagagcacagatcccaaaccttactgcaaactttccatcatactacaagaaaactgaactgtgggttctctataagtggcattttgggctttccctcttttttgtaaagcaatgtctgcctagtttattgtccagttaactttagtgaccttttaaaagttggcattgtaaataaaacaacttgcaaaaaaaaaaaaaaaaaattggtttttgacctttaaaaatttagggggggcgttttcttaaactccaaccttaaaaaaaccctttgaggggttgggccacccccaatttaaagggggggaaaaaatgggtttttttgggaaaattggggggcttttggttttttttggacccttaaaaaccggcaaaacaaagttaacaacacccatttgttt

SEQ ID NO: 13131 - DNA, 391 bp, Homo sapiens
  misc_feature 391: n = A,T,C or G
ggcacgagaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacatgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcn

SEQ ID NO: 13132 - DNA, 388 bp, Homo sapiens
  misc_feature 388: n = A,T,C or G
ccagtgcaggaattgttctgccagttatttgtataggaacaaaagattgttaagagttacctgggagaggagagatacacagttagggatactatggcattgagtgtttactgtgagcaatgtctcacattcctggttctttcaaagaactttttttataacttggtctgtttatttctaggtgactccatttggccttacgctaaacttcctcacattcttcacgggcgtggttgactttatgcacctggatcccaagaaagctggaacatatttctcaaatcaggcagtaagaaatgttgagcctatattttcttgattccagttgtggtccatttgctgtccagtatcacagctagctacagggaggtcctaggactgcatgcan

SEQ ID NO: 13133 - DNA, 340 bp, Homo sapiens
tacggctgcgagaagacgacagaaggggatgggaagggtaggaacaggggatgctggtgacataaccagaggagaagctgaggagcccctcttcactggtacatccttccctttacagcggctggatctctgctctggtggtgccgaagggcaacacagcagtatacgcgctcatgctgctggccgccctgctcttcactggcattgctgtgctaggaattgtcatgctgaaacgggtgagggctgtgtcgaaggtggggccgggatggtgagatcatgggtccccaggggcgtgggtggaacattcaggagcaactggcacaggtcaggctgctgggtt

SEQ ID NO: 13134 - DNA, 369 bp, Homo sapiens
tacggctgcgagaagacgacagaagggggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagctgaaagacatg

SEQ ID NO: 13135 - DNA, 384 bp, Homo sapiens
cgttgctgtcggataaagatacaccatgctgacactaaccaagtgaaagtgggagtagctacattaatttcagactgaacagacttcacagcaagaaaagttattagggatcaaagaagagtattacacaatgataaagaggtcagttctccaaaaaaacatgtctttaatgtgtatattcttaacaataagcatcaaaatatctgaggaaaaaactgatacaactgcaaggagaaatagatgaatccactatttatagttgaagtcttcagcactcctatcagtaatggacagatgtagcaggcaaaaaatcaccaaggatatagctgaagtgaacaggatcattaatcaactaaatctaagtatcatttatgtactactaca

SEQ ID NO: 13136 - DNA, 387 bp, Homo sapiens
cgttgctgtcgcagatatttcaaaaaagttcatgtctttttatctttgaaatatctatttatcaaaggcgtgagccactgcgctcggtcccatctgcatactcttacccactccaaattggacctagcagttccccatctctactccttccaggaagccaggcccacaactcatcctgggtttccctacataccacaaccactccttgtctctagccagtctttgtctctcaagggttggggttctgatttcctcttacagataggctcaccttatcttccaaggctcaccttatcttccaaggccaaggagaggtcaaggactggatctggctttgccaggtggctgaaaggacccgaaggagtaggatgcatacctgaggggctc

SEQ ID NO: 13137 - DNA, 383 bp, Homo sapiens
cgttgctgtcgggcggttgctggtcagtatacagccaagatgctgcggaatctgctggctcttcgtcagattgggcagaggacgataagcactgcttcccgcaggcattttaaaaataaagttccggagaagcaaaaactgttccaggtactgaagtattttataggagatgttacttgtaattattagattaccaaaaggtaagagttgggataaacaagtatgtgtataaattagatcatatgacaatataaacattacaaaaaaagtcaaggacatgtaccatagtgctaatagtggttgtctcttggggaaagacctggtggagcagagcaatttacctttataagtagtttgattatgagtgatttttgttttattat

SEQ ID NO: 13138 - DNA, 412 bp, Homo sapiens
ggcacgaggtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacag

SEQ ID NO: 13139 - DNA, 133 bp, Homo sapiens
  misc_feature 2, 4, 5, 6, 7, 8, 9, 10, 12, 18: n = A,T,C or G
antnnnnnnncntgctgnggtggcggtcactccctctgccactatccccagggaaggaaaggctccgccatttgggaaagtggtttctacgtcactggacaccggttctgagcaatagttagagaactcgttc

SEQ ID NO: 13140 - DNA, 170 bp, Homo sapiens
tgtcacggggactgatcaggaagatatattcctgcataactcaatctgaaccaaggattgtagtttagttttcctccttgccttcccttctgtgtgaccgaccccttggccaaaaaaaaccaaaaggcaaaaaacaaaagcctaccctgttctggttttttttcctcctt

SEQ ID NO: 13141 - DNA, 417 bp, Homo sapiens
ctcggcacgagggacagtggaggctgttatcttttgttgaaagcactgcatgttaagagggggcacagccctcctcccaagggaaagtgtctttgcatataatgtattttttcacttttggaggattctttttgtataacttcaataaagattgtaagcaaaggttgaggctttgatggtttttttcttaattattggctgaatctgccttggagcactgcctggtttatatattaacccaaaggtttgttctggccttctgtactgatctggggtcctgatcctaattcctatctggctaacgcggaggtgatcaagtgtgggtgtaggccctttgtttccaatggtgctatattctggtttcaaacacttcactgaacccagctatcttgcaaactttcagtggtgctgcccctg

SEQ ID NO: 13142 - DNA, 396 bp, Homo sapiens
cgttgctgtcgccagggtggaatcacagggagttgaaactgtccacttgtgctgagtcagttcctaggtgggggccataagaccagataagccagtttaccagtctgggtgtctccagcaggtccttcagtatgcagggtctgaaaaatacctcaaacaccaatcttaggttttacaatagtaatgttatctgtaggagcaagtgggggaggttagtgatattgtggcctctggctacatgacttctgagccataatttctaatctagtggctaatttgttggttttacaaacgcagtctggttcccaagcaaggagggagtttgtttcagggagagtctattaccgtctttgtttggttttttgcgttgctttggtttttgagccaaggtctcgc

SEQ ID NO: 13143 - DNA, 407 bp, Homo sapiens
ggcacgagttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctatcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaa

SEQ ID NO: 13144 - DNA, 382 bp, Homo sapiens
cgttgctgtcggcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcag

SEQ ID NO: 13145 - DNA, 427 bp, Homo sapiens
  misc_feature 427: n = A,T,C or G
cgttgctgtcggcaaaaggaaatggcattctctcaaaagcatgaattctcaagaaatttgaggaagaagatttggatgacattttaaggaaaagattgaaggactcaagtgaaatacctggtgctctgtggcatattatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcn

SEQ ID NO: 13146 - DNA, 398 bp, Homo sapiens
cccgcctgcacccaggtgaaataaacagccttgttgctcacacaaagcctgtttggtggtctcttcacatggacacatgagacacttggtgccgaagacccaggtcagtgagactccttcaggagaccagtcccctgtcctcaccctcactccgtgaggaaatccacctatgaccttgggtcctcagaccaaccagcccaaggaacatctcaccgattttaaatcagatctacttggcttagctgctgaagactgatgctgactgatcccctcagaagcccccagaccatcacggacaccaagctttgggtaactcttacagtggagggaaggcaggaatgtcaggcctctgagcacagctaagctgtcatatcccctgtgacctgcacgaatacatc

SEQ ID NO: 13147 - DNA, 422 bp, Homo sapiens
cacacatcctttttgcttacaaatttcctagcttgtgaccattctccaccatctccccccaagttttaccattctctatttgtgccctacaacggctccaccctttgaaataacgcctggtctaaatgttactttttctagtgggccttccttgattatccatcccactgtgattccttttcctgcccatagcctctccgacaagccttgcattctcattcatatgaccttgtttgccaagctacctgtgctgtctctgtgtgttttaaactattttactgagccaccatgcccagccaaagatcatttttttatatagacttcagccctttgtaaatattgtaactggggagtatagagtacaaaaaaagtatagttaaaacatttgttctacaaattaacctttataaatataattactg

SEQ ID NO: 13148 - DNA, 413 bp, Homo sapiens
ggcacgaggcagagtccatcacttcgccaggtggacatgctgtgggtggatgttcccggcgtgtgccgggcctgaatggacaggggccacttcacagcatgtcagggaaaatcactgtcacacaattccaatggattttgtgctcttttttttcaaaaagagcacacaatccattggaactgagtgctctttctgaaaaataaaaaatctttagcgtaaacctgaattttttttcaatgtatcccctggggaatgaatgaaattttgagctttttccttacgtaaaactaaatttataccactgacggagagaccctttttgaaagaagtatggccaaaaccactttaatgctgctgacaatgctgctctatgtccatttgtgcagccctgacctgctaaggagcgaatcttt

SEQ ID NO: 13149 - DNA, 146 bp, Homo sapiens
gcatcatttctatccaaataaagccttatcttgacctgatctattaaaacctgccacacccgccctttcctacctagatttaatgagcccaagtttttaaaatggaagaaatgactctggggcaaagacccctaatgaactagggg

SEQ ID NO: 13150 - DNA, 380 bp, Homo sapiens
ggcacgaggctaaacctgggaacattttgaatgtgggactaagagaggagggctagattgctctacaatgctgcagaagtttctacctgcctggctgggaggtaggagggtctggtttggggatgtggccctgaggagaggaccagtgtttggcagtggccatgtattgatctcccagttcttcctgtggcaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcg

SEQ ID NO: 13151 - DNA, 182 bp, Homo sapiens
  misc_feature 182: n = A,T,C or G
agaacaagtgcttataggtttgccaccattgtgacagcagttggcttctccaagggcctctggatggaatgtgccacacacagcacaggcatcacccagtgtgacatctatagcacccttctgggcctgcccgcttgcatccaggctgcccaggccatgatggtgacatccagtgcaatctn

SEQ ID NO: 13152 - DNA, 396 bp, Homo sapiens
  misc_feature 396: n = A,T,C or G
ggcacgagggataaggcagctgctgcatcatcggcactacaagccaaatcatatgagaaggcggcggttgcaggcaagaagcctgtgctcgtcccccgcggagtggccaggctacggcgggcgccggaagggggcgcactcctcgcctttcctcaatgtgtcgggcagccccgcctccccgctcggtttccgggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctan

SEQ ID NO: 13153 - DNA, 342 bp, Homo sapiens
tacggctgcgagaagacgacagaagggtgtagtcccagccacttgggtggctgaggtgggaggattgcttgagttgaggctggaagcttgaggcggcagtaagaagtgatcacactactgcactcttgcctgaatgacagagcaagaccctgtctaaaaaaaatttttttttaagttggctggcgtggtggctcacacccataatcctatcactttaggaggtcgaggtggatgggtcacttgaggtcaggaattcaagaccagactgggccgggcgcagtggctcacgcctgtaatcctaacactttgggaggccgaggcaggcgaatcacgaggtcaggg

SEQ ID NO: 13154 - DNA, 377 bp, Homo sapiens
ggcacgaggccaccaacaccatttgtctttataatggacctcaaggcctacgaacaggtgatgcactaccccggctacggatcccccatgcctggcaggatggccatgggcccggtcacgaacaaatcgggcctggacgcctcgcccctggacgcagataccttctactaccacggggtggactcccgggccattatgaactcctcttaagaatacgacggcttaaggaccggctaactatttcaccccggatcgaggacaagtgaaagagcaagagggggtcgagactttggggagacagtgctgcacatacacaagggataataaatacataacaccctcaaccgaacacccccaatacagaagacttattcacc

SEQ ID NO: 13155 - DNA, 390 bp, Homo sapiens
cgttgctgtcgctcctcccgcctgaggtgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggata

SEQ ID NO: 13156 - DNA, 347 bp, Homo sapiens
tacggctgcgagaagacgacagaaggggatagaaaatcagtaaagaaacatgtcacttaatctgcactatagagcaaatgcatctaacagatatttacagaacatttcatccaacagctgcaaaatacacattctttttctcaacacatggatcattctccagggtagaccatatattagatcacaaaacaagtctaacaacattcaataaattgaaataatatcaagcatcttctctgaccacaatggaataaaactagaaatcaataatgaggaattttggaaactatacaaatacatggaaattaaactatatgctcctgaatggccagtgggtcaatgaagaa

SEQ ID NO: 13157 - DNA, 139 bp, Homo sapiens
gtctgagtcagagatctgtgcacactttctaaacagcttgtgatgcaagtgtgagcctattgtgttacttgaccttattttggaagttttgaattggcctaggaggaaaccctagaatgaaccaggggtatgtcatcac

SEQ ID NO: 13158 - DNA, 399 bp, Homo sapiens
ggcacgaggatctggcacactcaggctcattggcaggtacaagaaggggaataaaggggctgtgtgaaggcactgctgggagccattagaacacagatacaagagaagccaggaggtctatgatggtgacgatttttaaaatcaggaaataaaagatcttgactctaaaagaaaaaaaaaaagaacgcgtcctagggctggatggactaatcaggtggaatttctaaaatcccactttggcagaccctcttgtcttgaatctggcttttcacaacatggagggggagaaaaagaagcttctttctctgaaaagagggggttttttgtttttttagaaaactaggaggggggggagcataatggctcaacagaagagttttttctttttatgttcctgtg

SEQ ID NO: 13159 - DNA, 387 bp, Homo sapiens
gcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcag

SEQ ID NO: 13160 - DNA, 160 bp, Homo sapiens
ccctctagaggagcctgatatgcatttcgataaaccccgatcaacctcaccacctcttgctcagcctatattccgccatcttcagcataccctgatgaaggctacaaagtaagcgcaagtacccacgtaaagacgttaggttcaggtgtatcctatgatg

SEQ ID NO: 13161 - DNA, 379 bp, Homo sapiens
ggcacgagatcagccagcccctgcagaacagcttcatccacacagggcatggcgacagtgacccccgccactgctggggcttcccggacaggattgacgaactgtatctgggaaaccccatggacccccccgacctcctgagcgagaactactggtggcgtggccagaacacacggacgctgtgtgtggggcccttccctcgcaacgtggtgacctccgtggccggcctgtcggcccaggacatcagccagcccctgccacagaggggctgccctggcgatgggccagaggcgggccggccagcagacaagatccagatgctgcaggccatggtgcatggggtgaccacagaggagtgccaggcggccctgcagtgcct

SEQ ID NO: 13162 - DNA, 462 bp, Homo sapiens
gcggtgctgtcgcttcaagagcgttctgatgccccatgacctcatcactcagctgtggcgggggctggccatcgagaccaagcacgagaaggcgatggcgcacgccgaccccacggagctggcgctgagcgggctggaggccttctctttcgactacatcggcaagtggcccctttcgctcatcatcaacaggtgcgggtcggctgctcgggcacctgccagatcttcactcaggtttggcagaagcgagaactgtgccacgcggtggccacctcgtcgcacagaggacccaaggcggctctccccagccttcagagtccgggagattcacgggctgtccgggggccacggcgcggactgtggagtacagacgccgtgtacacgacgccgtcggtcacggaggcccacctgaggtgccgccacgtgtctggcaggaaagccctcactcgctaccagatgctg

SEQ ID NO: 13163 - DNA, 392 bp, Homo sapiens
cgctgctgtcgctatctctgtgccttcttcatctcctgcacaaatggagggagctcctaagaactagtaaacgtctgagtgccagcactatgctgaatgctttacgtgtttcccatttaattatggcaaacttgggagacaaggcaagtgttctcacagatgaaagacactgatgtacaaagataagtaacttacccaacatcacagtcaaccaggatttgaacccagatagtccacttctcccaaaatttcattttctcaccttggttccgatactcaaaaagacggggatcagcatgaatgggaatgagccccagacggtgagcaagaatctcatcctgaacaatggatgtattattgtacaccaggaccttctccacagccatagttgg

SEQ ID NO: 13164 - DNA, 144 bp, Homo sapiens
  misc_feature 8, 9: n = A,T,C or G
atatgcanntcttctccacctaggaccgccagcagagcggggggatctccctgcccccaccccagttccccaacccactcccttccaacaacaaccagctccaactgactctggtcttggaggtgaggcttcccaaccacggaa

SEQ ID NO: 13165 - DNA, 433 bp, Homo sapiens
ggcacgagagccctcgataagttttccactgaatacacaatgtagtctggctcacagaatctgcatttttacataaatgataggggagaggaagcaatcagatactcatttgtctcaagtgaacctcaagggatgactttgaatagaatgagaggcagatttcccctaagcagttcccaggttgacttttccctttagcttagagattttggggtcccaatatttgttttcatttcacacccatcttctgcacccccatgactcacaagagtcctcacacctggcctacgttcaactctccacggctcttgccagaaggctgcacgtacaacacacacagaggcgggcatttccctgaccactcctgtgtgccgagggggaacggtagatggcccaacccccagtggttcgaactttctggccaaacatattg

SEQ ID NO: 13166 - DNA, 232 bp, Homo sapiens
ctcccccctacttcaccaaccacaggattcagtgtatgtcacatgctcaggcggaggtgtggaaacgttacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggg

SEQ ID NO: 13167 - DNA, 427 bp, Homo sapiens
  misc_feature 370: n = A,T,C or G
ggcacgagggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcttgggccaaaaccaaaagaagaangctgagggcacgtggtcaccgaggaagattccagaaggtcagcacgaatacttttgg

SEQ ID NO: 13168 - DNA, 401 bp, Homo sapiens
ggcacgagctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagc

SEQ ID NO: 13169 - DNA, 145 bp, Homo sapiens
  misc_feature 6: n = A,T,C or G
atagcncatccatcctggagtacctcaccgcagaggtacttgaactggcaggaaatgcatcaaaagacttaaaggtagagcgtattacccctcgtatcttgcaacttgctattcgtggagatgaagaattggattctctcatcag

SEQ ID NO: 13170 - DNA, 388 bp, Homo sapiens
cgttgctgtcgggacagtggccgcaccagacaacctgcccaactacgagaacaccgtggtcttctctctgtccagcttccagtacctcatcctggctgcagctgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttc

SEQ ID NO: 13171 - DNA, 380 bp, Homo sapiens
  misc_feature 372: n = A,T,C or G
tacggctgcgagaagacgacagaagggacagtaagacatcagaaagtatatgtgagatcaataataattccgaacatggagccaaactaactcagcaacaagacattagaaaggacagtaagacatcagaaagtatatgtgagatcaataataattccaaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcanactgtcag

SEQ ID NO: 13172 - DNA, 154 bp, Homo sapiens
  misc_feature 8, 19: n = A,T,C or G
aatgtttnccaacatccangctgtgtccctcaagatccagacactcaagtccaacaactcgatggcacaagccatgaagggtgtcaccaaggccatgggcaccatgaacagacagctgaaggtgcccagatccaaaagatcatgatggagtttg

SEQ ID NO: 13173 - DNA, 460 bp, Homo sapiens
cgttgctgtcgcttcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggtgcgggtcggctgctcgggcacctgccagatcttcactcaggtttggcagaagcgagaactgtgccacgcggtggccacctcgtcccacagaggacccaaggcggctctccccagccttcagtgtccgggagattcacgggctgtccgggggccacggtgcggactgtggagtacagacgccgtgtccacgacgccgccggtcacggaggcccacctgaggtgccgccacgtctcttgcaggaaagccctcactcgctaccagatgct

SEQ ID NO: 13174 - DNA, 382 bp, Homo sapiens
cgttgctgtcgaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatatg

SEQ ID NO: 13175 - DNA, 431 bp, Homo sapiens
ggcacgagatggtgacaaggctggagttgctttgggaactgcactgacacctcacttggagaattaagtgtctcaagctgtccttccctccttaattttcctggaattttgctgagcattttaccttctcattctttgtaaatttctcattaaacattctaggaagagagatagctccctacctctggaggttggggttacggggataggtagggggtctgttgggtttttgcagataagtggttatttttccttgggcaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaaattttgggagaagtggactatctg

SEQ ID NO: 13176 - DNA, 424 bp, Homo sapiens
ggcacgagatggtgacaaggctggagttgctttgggaactgcactgacacctcagttggagaattaagtgtctcaagctggccttccctccttaattttcctggaattttgctgagcattttaccttctcattctttgtaaatttctcattaaacattctaggaagagagatagctccctacctctggaggttggggttacggggataggtagggggtctgttgggtttttgcagataagtggttatttttccttgggcaggtgccaactatggctgtggagaaggtcctggtgtacaataatacatccattgttcaggatgagattcttgctcaccgtctggggctcattcccattcatgctgatccccgtctttttgagtatcggaaccaaggtgagaaaatgaatttttgtgagaagtggc

SEQ ID NO: 13177 - DNA, 399 bp, Homo sapiens
cgttgctgtcggattcaggcgtgtataccagccggagcggcgcggcagcggcaggaccgccgtggcgcctatagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttggagcaatttacagcaatgagggatttatacatgaaaaatggacaaggatttgcattagtttattccatcacagcacagtccacatttatcgatttacgagacctgagagaacagattcttcgagttaaagacactgatgatgttccactgattcttggctgcaataagtgtgatttgtaag

SEQ ID NO: 13178 - DNA, 344 bp, Homo sapiens
  misc_feature 344: n = A,T,C or G
tacggctgctagaagacgacagaaggggtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaan

SEQ ID NO: 13179 - DNA, 423 bp, Homo sapiens
ggcacgaggcggagtattccaggaagaggccactgcctatgtgatgacctcaaggcactgcatagcttggcatattttgattacataaggaaggcacaggagccttctaatatctattccattactatgctaagcgaggtctaataactggaaacagttgtatgagctgcagacatgcaggcactgccgtgtacttttgtccgcacatatatatctatgtgcctagctcttgttcctgacacacatgtttctatatacacatacacatacatgcatataccaacagatttaatattatattgcatttttcaacgatgcagaatgcagctgcaattgtgttttaaggagaagccacatggggatggttgtccctgcaacatggtgccactcctgggccatgtgcagcctcagtggacactcttg

SEQ ID NO: 13180 - DNA, 382 bp, Homo sapiens
ggcacgagggagtctctatccttttctaaaatcgcattttgtaagaaaagaaagaaaaaaaaaaaaaggaatggtccccccccacctccggatttaaaaaaaacccctggaatttttaataaacatttttaacccacggggattttttttttaaccgggcctttgggattccaaagttaaaaaggtaaaaagaaaaggctaacttttccttttttttgggggggggggcccctgccaaaaatgtatttactttggctcaggggctttattggagggccctggccaccccttggaatggctgcccacagtaaaactttcccagaaaaatttcgtaacgggccccagccctttcataaccccggttttttttgaccttgaaaaa

SEQ ID NO: 13181 - DNA, 381 bp, Homo sapiens
  misc_feature 381: n = A,T,C or G
cgttgctgtcggcgacccgccggggatgctgggtgctcaacgcgctgccacctggggcccaacgcgttgacctcgcggtcaggttgcttccgcggactacggatctggctcgctagctctggaagggagcaccgggagggaatggtggcaactcccaaggaggggacccagggatccgagaaaggaagacttgggactgtggtacagacctccatgagccggtcccaggtagccctgctgggcctgagtctgctgctcatgctcctactgtatgtggggctgccaggcccccctgagcagacttcctgcctctggggagaccccaatgtcacagacctggctggactcacccctggcgactcgcccatcttttaccgcgan

SEQ ID NO: 13182 - DNA, 336 bp, Homo sapiens
tacggctgcgagaagacgacagaagggaatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtaggctttgaattgtattccatggtgccatctatttgtcctctagaaactcttcataatgccctatctttaaagcaagtggatgaatttcttgcttccatt

SEQ ID NO: 13183 - DNA, 455 bp, Homo sapiens
tgcaggatcccagcgactcgaattccgttgctgtcgaggggctcccagtcctttcttctgggaggccaaggcggcttcgcgttctgagaatagacagaacctctgttactctgtgaccggcaggcaccgggagatccgtagctcagacgccaggacatcccggaagctgggaaatggtgaatgtgccagggactgttgacattcagggatgtggccatagaattctctcggggggagtgggaacacctggactcacatcaaaagcttttatatggggatgtgatgttagagaactacggaaacctggtctctctgggtctcgctgtctctaagccggacctgatcacctttttggagcaaaggaaagagccctggaatgtgaagagtgcagagacagtagccatccagccagctcctgaagagcaccattctgcctaatgtttctatgagtttgg

SEQ ID NO: 13184 - DNA, 165 bp, Homo sapiens
tgttgcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcaaaggaccggt

SEQ ID NO: 13185 - DNA, 148 bp, Homo sapiens
  misc_feature 148: n = A,T,C or G
aggcacgctttcaggtttttattatggcagccactaacaggccagatataattgaccctgcaatcctgcgcccgggccgcctggacaaaacactgtttgtgggtttaccgccccctgcagatcgccttgccatcttaaaaactatcan

SEQ ID NO: 13186 - DNA, 386 bp, Homo sapiens
cgttgctgtcgggccaccctgaagacctatggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgt

SEQ ID NO: 13187 - DNA, 424 bp, Homo sapiens
ggcacgaggcagaccctccaccctcctgtttacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattatgagggccctggaatggcaaggaagttctctgcacctgggcaactgtgcatctccatgacctcgaacctgggtggctctg

SEQ ID NO: 13188 - DNA, 410 bp, Homo sapiens
cgttgctgtcgcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctca

SEQ ID NO: 13189 - DNA, 389 bp, Homo sapiens
cgttgctgtcggagaaccctgttataatgggactgctcagcctaaatggtcaggtgacaaggcctgtgaaacccactggtggccctggaggagggggcgcacaaacacagcctcagaagagccagctgattaacaccaacacaatcgctaatggcactcagcagcacgcacagagtatgaccaccactattaagtatgtggtagagtaaattatgtattatacacttgcggggaaccaagatatgggatactttggagttgactattaatacttatgccttaagttaaccattttgattgcaaatagaggacagatgactttgttttatggccagtatgtatttgcaatacaataatatatatctgccataatttgtgcagcatgtagg

SEQ ID NO: 13190 - DNA, 374 bp, Homo sapiens
cgttgctgtcggggcctccggggaagcgtccccgctaggggtggggtcttgggactccctggggcttccggagctgacccgtggggggtctgctgccctcagttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtctctggacctctgactgacactgtgcctgcccaggtccctgtatgcactgccacagtgccctgggccccatgtccacccctgtcctgcccttctctgggatagggctggccttcctctgcctctgcctggg

SEQ ID NO: 13191 - DNA, 381 bp, Homo sapiens
  misc_feature 381: n = A,T,C or G
cgttgctgtcggggcctccggggaagcgtccccgctaggggtggggtcttgggactccctggggcttccggagctgacccgcggggggtctgctgccctcagttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtctctggacctctgactgacactgtgcctgcccaggtccctgtatgcactgccacagtgccctgggccccatgtccacccctgtcctgcccttctctgggatagggctggccttcctctgcctctgcctggctgcatan

SEQ ID NO: 13192 - DNA, 290 bp, Homo sapiens
agcgaggtcagaggccatgagggaaaggcagactcgggaggagagtggagtacttccacatctgggcggctgtggggggaacaactgtgtgtgtgctttacatccatcccctgaaccttcagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttccct

SEQ ID NO: 13193 - DNA, 382 bp, Homo sapiens
ggcacgagctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacg

SEQ ID NO: 13194 - DNA, 403 bp, Homo sapiens
  misc_feature 77: n = A,T,C or G
ggcacgagggacaagagagaagagagactgaaacagggagaagaggcaggagagggggaggtgtgggaggctttaanctggaggccgacactgagggagggcgggaggaggtgaagaaggagagaggggagaagaggcaggagctggaaaggagagagggaggaggaggaggagatgcgtgatggagacctggagttaggtggcttgggagagcttaatgaatagagaacggagaggaggtgtgggttaggaaccaagaggtagccctggtggcagcagaaggctgagaggagtaggaagatcaggagctagagggagactggatggttccgggaaatgagcagaggaaagaggaaagacacagagagacgggagagagaagaatagtggttttgtatggcgg

SEQ ID NO: 13195 - DNA, 405 bp, Homo sapiens
ggcacgaggaggaacaagaagcacctctacagggagctcccagttgaggtgcgacaggcactcggccaagtccctgatggcttcgtccagtacttcacaaaccgcttcccacggctgctgctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgaggctggcctcacaatcaagctgggtgcagtggctcacacctgtaatcccagcattttgggaggctgagtgagaggatcacttgagctcaggagttcgagaccagcctggccaact

SEQ ID NO: 13196 - DNA, 377 bp, Homo sapiens
cgttgctgtcggcgattttcctgcctcatcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggccca

SEQ ID NO: 13197 - DNA, 384 bp, Homo sapiens
ggcacgaggagagagagagagaataagatttttgaatcattttgtctgctaaataagacatataagaactctgaaggtggaatagatttgactgtattaaatgttggcgagagactctctttgatacattaaaaaaactgtttgcagaagcagttctatggaagagactggaataattatggccgtgtaacgtgtacccgctttaatgggaaatattcttgatcttcaacattgttctttggttcttttttccttttttaggaaaaacaaaacaacagacttcatccttagggtttctcaagatttaagcgaacacatttacacatatcaatttcttaaagaacacagaatgtttcctccctagcttaactatttaagagccag

SEQ ID NO: 13198 - DNA, 181 bp, Homo sapiens
  misc_feature 6, 7, 8, 10, 11: n = A,T,C or G
accccnnncnnctgcctcacctctctgggccagtttccccatagtacagtggtgctgcacaccctggccctggccccgaggtggctgggaggtggctcctcaaaccgccgctgtctcatcgaggcccggtgatgcatcagggatcgactgaggctctgagctaactgggaaacacagtggc

SEQ ID NO: 13199 - DNA, 152 bp, Homo sapiens
  misc_feature 10, 12, 111: n = A,T,C or G
attgcgctgngnaacacaaattctcctctgcgctatgtggacattgccatcccatgcaacaacaaggtaatgattttaggatctagagtttgtgaatgcgtgctctagaanaaacattcctgtgcacattgatagagcttggagttgaggct

SEQ ID NO: 13200 - DNA, 189 bp, Homo sapiens
aggccaggcgtgcgacgctttatcggtcacgaaatggatacccggcctgccatggccatctttgaactcctggactatattgtgaacgagccacctcctaagctgtccaacggtgtgttcaccctccacttccaagagttagacaataaaagcctcatcaagaacccatcggagcgagctgacctgaag

SEQ ID NO: 13201 - DNA, 392 bp, Homo sapiens
ggcacgaggcttgtggtcaaacatcgggacatgaatgataaggaactggaagctcacgaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaagg

SEQ ID NO: 13202 - DNA, 170 bp, Homo sapiens
  misc_feature 7, 8, 11, 13, 14, 31: n = A,T,C or G
gaatttnnccncnncacctgccactactacnccaacaagtacagcttctggctgaccaccattcccgagcagagcttccagggctcgccctccgccgacacgctcaaggccggcctcatcccgcacacatcaaccgctgccaggtgtgcatgaagaacctgtgagccgga

SEQ ID NO: 13203 - DNA, 158 bp, Homo sapiens
  misc_feature 4, 8, 10: n = A,T,C or G
cctnacananaacttaactggcagcaagagacggctacaaactcctaaggaaaaggcccaggctctagaagacctggctggctttaaagagctcttccagacacgaggtcacactgaggatcaatgactaacgataatactgccaaagtagcctgcaa

SEQ ID NO: 13204 - DNA, 153 bp, Homo sapiens
  misc_feature 5: n = A,T,C or G
ccaanaacagattgctgaattcaaggaagccttctccctatttgataaagatggcgatggcaccatcacaacaaaggaacttggaactgtcatgaggtcactgggtcagaacctcacagaagctgaattgcaggatatgatcaatgaagtgga

SEQ ID NO: 13205 - DNA, 350 bp, Homo sapiens
acctagccagccaacataacatgccttaccttcctagaacgaaccaccgctataacgcagaccgaaagacgctttattcgcgcacctggtgaagctattgctccatttggagcccctataagccgcgacaatccagggagcaacacctatagccttcattacatcgttcaacttcactttgaggtatgctacgtagaaatagatcatggagccaagtgaagtgcactttgtcaaatgtaagggtctgctttgttcttgttgcttttctgttttttaaccttttgttccgccatttaaaaaaagaaaaaaaaaaagttatgtttcttgtcaaatgcagaaatgttccttcc

SEQ ID NO: 13206 - DNA, 162 bp, Homo sapiens
agctcggcttttatcttcttccgtaccacttgacaaccatggggccctggtcttctgtactcaggggctggtctcccagagatgggcaaaagccagcttgcccgttttctttatgcttcaagagaaacccctccttctgggtccagactctgggtggagtgt

SEQ ID NO: 13207 - DNA, 184 bp, Homo sapiens
  misc_feature 178, 184: n = A,T,C or G
cacacatgcctcatataagtgaatgcttgatgaaaagaagtttaaaacccaccgacctgagagacatgactattgggcagctacaagtgatagtcaatgatctccattcccagatagaagcttgaatgaagagttggtccagctgcttctcatccgagatgagctgcacacagagcangatgcn

SEQ ID NO: 13208 - DNA, 188 bp, Homo sapiens
cgcactaagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgtt

SEQ ID NO: 13209 - DNA, 383 bp, Homo sapiens
cgttgctgtcgcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaaaaaaggggggaactcaaattttcttttttaaggtaatccccaaaattttctccaaaaaaaaaatggtggtttggtattttgaaacttaaaagcagctatgggtaaatttctgaaatatagcaggagaccaaaacatgtttggaaagagaataaatatttgaagagagacgggtggttttattttcaatgtatggaatatattaaactactatttattttctgaggggagg

SEQ ID NO: 13210 - DNA, 158 bp, Homo sapiens
ctttcaagacagcctccctttattgaattggcattagggaataaacaagcctttaaacgtgataaaagatcaaaaacctggttagacatgccagcctttgcaaggcaggttatgtaccaaagactaacctccaagtggctttatggacgctgcatatg

SEQ ID NO: 13211 - DNA, 378 bp, Homo sapiens
ggcacgaggcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactga

SEQ ID NO: 13212 - DNA, 342 bp, Homo sapiens
  misc_feature 342: n = A,T,C or G
tacggctgcgagaagacgacagaaggggaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagactggagtacctgcaaggcgcatgatgaaaaaccaggtgatgaggaaaaaactcattttattttttaaaagaagaaatcatgcatgaaaacaaagggaacaaaaaatctgccagcgttatgatcagctcatggaggcatgggagaaaaaagtggacagaatagn

SEQ ID NO: 13213 - DNA, 396 bp, Homo sapiens
ggcggtcaggcgccgcttctggggagaggcctttcttttcccctccctcccggttcggtggcggcggctcctcccactggggggggggagggacggatatcttaaacatcaaccgccatagagaaaaatactgccaaacccaaaatgacataacaagtaccatcaatgggtccagccattgcctttggaaactatagacctggaattcaaagtggaggaaccattgaacaaaaggctattaagcggctaccaggcctgaattttgatgataatggaaaaaggaacaacaaatttttgaggagggaagaagatcagatttcaaacgaaaaggcacatacttgcctatgctaattataaacacaagctctaccgataaatacagacatgccaccaaat

SEQ ID NO: 13214 - DNA, 187 bp, Homo sapiens
cattctcgagggagcgcgaggaatgcctccgcatgagatcaagtttgctgtccatgtctaatcggtgctcaaccgcgtgccgcagcccgaataccggcagctgctggaggaagccatcatggagctgacgctgctctcggacacggagatgaccagcatcgggggcatcatccacgtggaccagatc

SEQ ID NO: 13215 - DNA, 163 bp, Homo sapiens
  misc_feature 21: n = A,T,C or G
aaccttcaacctgcgcatcancttcccgccggagtatccgttcaagcctcccatgatcaaattcacaaccaagatctaccaccccaacgtggacgagaacggacagatttgctgcccatcatcagcagtgagaactggaagccttgcaccaagacttgccaag

SEQ ID NO: 13216 - DNA, 156 bp, Homo sapiens
cattgccatccaccgtgggatgccccaagaggagaggctttctcggtatcagcagtttaaagattttcaacgacgaattcttgtggctaccaacctatttggccgaggcatggacatcgagcgggtgaacattgcttttaattatgacatgcctga

SEQ ID NO: 13217 - DNA, 345 bp, Homo sapiens
tactgctgctagaagacgacagaaggggatagtgacgacctcaagcggcagagtgctcttctggagcagcaagaccgtgcactggagaaggcgaggtcaagtgcccaactgcagaccaactacccctcctcagacaacagcctctacaccaacgccaagggcagcaccatctctgccttcgatgggggaggtgtgggaggttttttatcctttctccgtatgacttcacaccagatgctatctgcctctggtagcgaatttctcatttcctgacaatccgaaaatactattagtttacccccgtcagctaatcctttcttcatcgagtgccatacccccactacg

SEQ ID NO: 13218 - DNA, 422 bp, Homo sapiens
ggcgcgaggtggctaccataacgtgccgactattgacatccacatgaaccacatcggctttgagcgggagtggcacaaattcctgctggagtacattgcgcccatgacagagaagctctaccccggctactacaccagggcccaggttgacctggcctttgtcgtccgctacaagcctgatgagcagcactttggccagtggtctgtgtgcagcaacaaggacaaccactgcccagcagcctctgggacctcgtggtcccagggaacccagtccagactcctggctgttgacttcccattgctcttggagccaccaatcaaagagattcaaagagattcctgcaggccagaggcggaacacacctttatggctggagctctccgtggtgatctggacccagcctctggagacaccattcact

SEQ ID NO: 13219 - DNA, 182 bp, Homo sapiens
actattacccctagaggtacaactgtgacccctacaaaggaaactgtatcccttggaaagcacacatgagctctaggagagaaaactgagatcactggggcaatgaccatgacttctgtggtcatcagtccatgacccctggagagaaagccctgacccctgtgggtatcaatctgtgacca

SEQ ID NO: 13220 - DNA, 391 bp, Homo sapiens
gatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatgg

SEQ ID NO: 13221 - DNA, 380 bp, Homo sapiens
ccattcactcgttcagcagacacgcatggtactgatgctttgagttttcttctgtggggatttcctttctctggactctgtgcagcccctgccctccctcgggtgctgctggcctcaaaggaggaactcgtggcgggaggtgtggaattattcacctaagcctgaccttttgtttagttgacagcattgctttctgtgttgccaatcttggctcatacgagatgcataggaatgagctcgagccttcctccttttgcttccggatatattcttcctcttgggaacatgagtccacttcgaactgcttcctgtagttttgtccagctgtattggcaacttctgcataaggatcatgagtctgtggaggcaccgacttctcc

SEQ ID NO: 13222 - DNA, 175 bp, Homo sapiens
ggcacgaggcttttgagaccagggttgctctgtctgtgctccgcctcgccatgacttcctacagctatcgccagtcgtcggccacgtcgtgcttcggaggcctgggcggcggctccgtgcgttttgggccgggggtcgcctttcgcgcgcccagcattcacgggggctccggcgg

SEQ ID NO: 13223 - DNA, 356 bp, Homo sapiens
tacggctgcgagaagacgacagaagggtaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttggggggggggggttttaaagctgtttttacctccgagactccacttttaagggacccagggaattaaggcatataaaatttacccccccaagattaaaagcccaggaagaggttcaacccatgtgagaactgccctcctaggaaagggtttaagg

SEQ ID NO: 13224 - DNA, 170 bp, Homo sapiens
atggataagaacaagatgggcttgaaaggccctttgaagaccccaatagcagccgggcacccatctatgaatttactgctgcgcagaacatttgacctttactcgaatgtccgaccctgtgtttctatcgaaggctatacaaccccttacaccgatgtaaatattgtgag

SEQ ID NO: 13225 - DNA, 413 bp, Homo sapiens
ggcacgagaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggt

SEQ ID NO: 13226 - DNA, 402 bp, Homo sapiens
ggcacgaggcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagt

SEQ ID NO: 13227 - DNA, 388 bp, Homo sapiens
cgttgctgtcggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttg

SEQ ID NO: 13228 - DNA, 387 bp, Homo sapiens
ggcacgagggccagcggtagcaactgtagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaa

SEQ ID NO: 13229 - DNA, 422 bp, Homo sapiens
  misc_feature 422: n = A,T,C or G
ggcacgagcgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaan

SEQ ID NO: 13230 - DNA, 441 bp, Homo sapiens
  misc_feature 13, 14, 15: n = A,T,C or G
aagctactggggnnntggcaggatcccatcgattcgctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatca

SEQ ID NO: 13231 - DNA, 382 bp, Homo sapiens
ggcacgagatacatttatgatggagaactgttatcaaagaatggattttttcagggatataaccgactgacctggatagtagttgttcttcagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtag

SEQ ID NO: 13232 - DNA, 385 bp, Homo sapiens
ggcacgagtgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacatt

SEQ ID NO: 13233 - DNA, 456 bp, Homo sapiens
  misc_feature 1, 14, 15, 18, 23, 24, 26, 28, 31, 32, 33, 35, 41, 82, 83,102, 118: n = A,T,C or G
ncaggtaaactagnnctntgcgnncngncannngncaaaangcaggagcccatttattctaattcggcacgaggggaggggnnggaattaggtttattgtgnccacgaaaacggggcnacagaagaggtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacg

SEQ ID NO: 13234 - DNA, 329 bp, Homo sapiens
tacggctgcgagaagacgacagaaggaagcgcccgaacccgctccatagcccgggcgctgggggttggaagcaaacgcacaagaagtttgttctgggaaggctccggtagcgaaaaccgaacttggggctggatatttagaaaataaagcattcgcataatacaatgaactcataatttggccggatgatttgtaggcagggacgttttagtgtcggttttacgagattccttgatatattacagaattagagtccagatttacaccaaaaaggaccccctttttcctctccggaccacgtgaccccgcccacgtgacgtcccctccgg

SEQ ID NO: 13235 - DNA, 414 bp, Homo sapiens
gaggtgtgcagcctgggacagcaggagcgggtccagcttcaggagtactggcggaggggctggacgttccacgccaaaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcacgtgtgctg

SEQ ID NO: 13236 - DNA, 380 bp, Homo sapiens
  misc_feature 380: n = A,T,C or G
ggcacgaggcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttn

SEQ ID NO: 13237 - DNA, 427 bp, Homo sapiens
taaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcacaatttttaaaaaaaaatggagcatgtgtattatgtggccaatgtcttcactctaacttggttatgagactaacaccattcctcactgctctaacatgctgaagaaatcatctgaggg

SEQ ID NO: 13238 - DNA, 408 bp, Homo sapiens
  misc_feature 396: n = A,T,C or G
ggcacgagggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcanatatttcttgct

SEQ ID NO: 13239 - DNA, 393 bp, Homo sapiens
ggcacgagaaggtgttacagcacatgaaggccgtgcaggcagatcatgagcggcagaggcagcggcggctggaagtataacgtgaggcagagaagaagcgtgaggctaagcagcgagctaaggaagctcatgagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagc

SEQ ID NO: 13240 - DNA, 423 bp, Homo sapiens
ggcacgagacgacttcttgaacagaaaacactagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcct

SEQ ID NO: 13241 - DNA, 397 bp, Homo sapiens
ggcacgaggttccacgccaaaggcctctgtttgtacctggcgttttcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgg

SEQ ID NO: 13242 - DNA, 398 bp, Homo sapiens
  misc_feature 398: n = A,T,C or G
cgttgctgtcggatccatcctacagatgcatcctagaatacgcttccacacgggtcttgcggatgcccacctctactgtttgaaaaaatacatcgaggatttgctaatggaaaacgggtcaataacttctatccggagtgaactgatttcatatttagtgagaaaacagctttcctcagcttcctcacaacagggacgcagaacaaaaagaggaggatctagagaaaaaggagctgaactccttatatatatacagttttataaaagaagccaatacactgaacctggctccctatgatgcctgctggaatgcctgtcgaggagacaggtgggaagacttgtccagatcacatgtgcgctgctatgtccacatcatgaaagaagggctctgctctcgn

SEQ ID NO: 13243 - DNA, 399 bp, Homo sapiens
ggcacgaggttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaagatttcaaaaccgacctgaggtttcagagcgcagccatcggtgcgct

SEQ ID NO: 13244 - DNA, 439 bp, Homo sapiens
  misc_feature 13, 23, 34: n = A,T,C or G
ccttttgataagnttcgacgacncccagcaggancccatggagtcgaattcggcacgaggttcttcagcagaatttgaccttcatcaccatgtcgcgggaggcagacctggactttgcaaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcactttttttccttggtatgttattgaggatattct

SEQ ID NO: 13245 - DNA, 429 bp, Homo sapiens
  misc_feature 327: n = A,T,C or G
ggcacgagctctactcaatagtccccccagctttgtgtgctggtctcggggcttcatggagatgaatgggcggggggagttggtggagtcactcaagagattctgtgcttccacgaggcttccccccactcctctgctgctattccctgaggaagaggccaccaatggccgggaggggctcctgcgcttcagttcctggccattttctatccaagatgtggtacaacctcttaccctgcaagttcagagacccctggtctctgtgacggtgtcagatgcctcctgggtctcagaactgctgtgggcacttttcgtccctttcacggngtaatcaagaaaggtggcttcgtccctgtcatcgcccactaagggaagccaatgaggaggttgcacttcgtgtaccacaacttgtggcccaagaattggccc

SEQ ID NO: 13246 - DNA, 449 bp, Homo sapiens
  misc_feature 404: n = A,T,C or G
tgtggatcccagcattcaattccgtgctgtcgaaacaagccctgaagtttgcatgagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagcgacttacattactatttcaattggataaaaactcagctgagttcacagaaactggcgtgtancggtgttgctgttgaaacaggaacagtctcttcaagtgatagttt

SEQ ID NO: 13247 - DNA, 398 bp, Homo sapiens
ggcacgaggctcctcaccctcagtcaggtcccaaccactgtaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcag

SEQ ID NO: 13248 - DNA, 426 bp, Homo sapiens
  misc_feature 368: n = A,T,C or G
ggcacgagctctactcaatagtccccccagctttgtgtgctggtctcggggcttcatggagatgaatgggcggcgggagttggtggagtcactcaagagattctgtgcttccacgaggcttccccccactcctctgctgctattccctgaggaagaggccaccaatggccgggaggggctcctgcgcttcagttcctggccattttctatccaagatgtgggacaacctcttaccctgcaagttcagagacccctggtctctgtgacggggtcagatgcctcctggggctcagaactgctgtggtcacttttcggccctttcacggtgtatcaagtaaggtggcttcgtcctggtcatcgcccacttngggaagcgaatgaggaggttgcactccgcgtaccacagctggtgggccagggatttgt

SEQ ID NO: 13249 - DNA, 399 bp, Homo sapiens
  misc_feature 399: n = A,T,C or G
gccgttgctgtcggccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatn

SEQ ID NO: 13250 - DNA, 402 bp, Homo sapiens
cgttgctgtcgagaaatcaactgtaagtgcttatagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccacc

SEQ ID NO: 13251 - DNA, 372 bp, Homo sapiens
tacggctgcgagaagacgacagaaggggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagagcaacttcgtataggaccgtactcctggaccg

SEQ ID NO: 13252 - DNA, 436 bp, Homo sapiens
  misc_feature 15, 17, 18, 19: n = A,T,C or G
gaacctttgaaagangnnncttgggatttccgcaggatcccatcgattccaagtcggcacgaggagaaactccggtcgggtcagctctcctacaaagaagatccagtgggatggcaaagattgttggctcagactgttgctaacaggaactctgaagcccgggctttcaagccagaaacaatctcagcattcacttctgatccagcacttttgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagatacagatggtgttagagtttttcagct

SEQ ID NO: 13253 - DNA, 377 bp, Homo sapiens
  misc_feature 377: n = A,T,C or G
tacggctgcgagaagacgacagaaggggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagagcaacttcgtataggaccgtactcctggacaccattn

SEQ ID NO: 13254 - DNA, 408 bp, Homo sapiens
ggcacgaggcttcttctccttggatttgtttaggattccaagtaactcttatttgctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagct

SEQ ID NO: 13255 - DNA, 421 bp, Homo sapiens
cttttgcaaaaggcggaaatctgaccctcggagggaacttgactgtggcggttgggcccttgggaaggaacttggaaggaaacgtggccctgagaagctccgctgccgtcttcacgtactgcaagtcaaggggactctttgcaggcgtgtctttagaagggagctgtttgattgaaaggaaagaaactaatagaaaattttattgtcaagatatccgagcttatgacattttatttggagatacaccgcggcctgctcaagccgaagatctttatgaaattcttgattcctttactgaaaagtatgaaaatgaaggacaacgaatcaatgcaagaaaagcagcaagggagcagaggaagtcttctgctaaagaattacctccaaagccattgtcaagaccacagcagtcatctgcaccagt

SEQ ID NO: 13256 - DNA, 455 bp, Homo sapiens
cgttgctgtcgcagagagtgttccctggaagagattgcggaagagactgcagaaacatttgatgctgttgtagcttctgaagttgtagaacatgtgattgatctagaaacatttttacagtgctgctgtcaagtgttaaaacccggaggttctttattcattactacaatcaacaaaacacaactttcctatgccttgggaattgttttttcagagcacattgcaggtattgtaccacaaggtactcatacatgggagaagtttgtttcacctgaaacactagagagcattctggaatcaaatgagctgtcaggttcaacagtgtgaggaatgctctataaccccttctcaggttactgtcattggagcgaaaataccagccttaactatgcagctcatgctgcgaaatccagggtccaggaacacccactctctgctgagtttgttttacaggg

SEQ ID NO: 13257 - DNA, 417 bp, Homo sapiens
ggcacgaggccaccaggccatggccattgcctacttccacccccagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattgtggt

SEQ ID NO: 13258 - DNA, 414 bp, Homo sapiens
ggcacgaggggaagcccgctccttgacaactggagagacaggttacattcccagcaattatgaggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagaaagctgatggtttgtgttttaacttaactgtgattgcatcgagttgtaccccacaaacttctggat

SEQ ID NO: 13259 - DNA, 387 bp, Homo sapiens
ggcacgagatcaagggtcatctcccatagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcctccagttggcagccaccatgcctttttctccgacgaccaggagccctaccctgtgactgatatttcggacctgatccgggattcctatg

SEQ ID NO: 13260 - DNA, 415 bp, Homo sapiens
ggcacgagctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacag

SEQ ID NO: 13261 - DNA, 398 bp, Homo sapiens
cgtgaccctggagcacctgccctagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatac

SEQ ID NO: 13262 - DNA, 374 bp, Homo sapiens
ggcacgagggactaccactgcttccactcccccaccgactggactgtgtcccaccggcgccacttcccaggctgcctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcat

SEQ ID NO: 13263 - DNA, 405 bp, Homo sapiens
  misc_feature 382: n = A,T,C or G
ggcacgagccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggngcgctgtggggcgtgcttcctgg

SEQ ID NO: 13264 - DNA, 425 bp, Homo sapiens
ggcacgagcttacacctgatggcaccaggtaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccat

SEQ ID NO: 13265 - DNA, 410 bp, Homo sapiens
ggcacgagctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagaggggacaactccagtga

SEQ ID NO: 13266 - DNA, 408 bp, Homo sapiens
cgccatcttcatcatgacctccaatgtggccagcgacgagatcgcacagcacgcgctgcagctgaggcaggaagctttggagatgagccgtaaccgtattgccgaaaacctgggggatgtccagataagtgacaagatcaccatctcaaagaacttcaaggagaatgtgattcgccctatcctgaaagctcacttccggagggatgagtttctgggacggatcaatgagatcgtctacttcctccccttctgccactcggagctcatccaactcgtcaacaaggaactaaacttctgggccaagagagccaagcaaaggcacaacatcacgctgctctgggaccgcgaggtggcagatgtgctggtcgacggctacaatgtgcactatggcgcccgctccatcaaacg

SEQ ID NO: 13267 - DNA, 417 bp, Homo sapiens
cgttgctgtcggcctaatacacttcagactacacaactatacagaagctttggagtcactgcaaaagaaaaccgagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctag

SEQ ID NO: 13268 - DNA, 426 bp, Homo sapiens
cgttgctgtcggtagtgcagtacccagatctcagtgaccacgagttcattgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctgg

SEQ ID NO: 13269 - DNA, 461 bp, Homo sapiens
  misc_feature 17, 18, 19, 461: n = A,T,C or G
ttgttcttttcgaggannncagggatgtcaattccgttgctgtcggcctaaaacacttcagactacacaactatacagaagcttttgagtcactggggaagaaaaccaagattgcactggaacatcccatgttaacagatattcatgacaagctggtgttgaagggtgattttgatgcttgcgaagagttgattgaaaaggctgtaaatgatggcttgttcaatcagtatatcagtcaacaggaatataagccacgatggagtcaaatcattcccaaaagtaccaaaggtgatggggaagataaccgtccaggaatgagaggaggccatcagatggttattgatgttcaaacagagactgtttatttgtttggtggctgggatggaacacaagatcttgctgacttctgggcgtacagtgtgaaggagaaccagtggacatgtatctctagagacactgan

SEQ ID NO: 13270 - DNA, 419 bp, Homo sapiens
ggcacgaggggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcatgagactaaggaccttagcatgtcaacacgctccctgaaatttggcaggcagactggaggtgaagagg

SEQ ID NO: 13271 - DNA, 362 bp, Homo sapiens
  misc_feature 321, 362: n = A,T,C or G
atggggacggaggaggaaagaaagacagccactgggttccccgtgttcacacacttggtctctttctctctttctgctgactggtctgagggttagcatttgtatccgcaaaatggcttttgagtcctcacagacagtggctttgagaaacctgctcttggtgtccccacatgacctcattggtcaaccttagtgctgctaacagcaagacaagcagatactgtgtgcattccgacatgaggcagtacaaagtacatagtatcacctaggaactagtcttgccaaaagcagaggggggcagggggagacagagagacacanagagagaaacagagaccgtgacagtgagaaatttaacctan

SEQ ID NO: 13272 - DNA, 273 bp, Homo sapiens
agtaatatgacacatttcaattaaaatagtcacatgtcttcccattactcatctctcctaagccaatgtaaaagcttggtttatattgttagatacaataataataaataggtctttttagtaaatttatgcttaactatccagcaacatggtaatggttatgtggcccttaggtttttacagattgattttgttgttaagtttcattttctcttttttaagtgctttttttggataactgttaatagctacttagttgggtattaaagaaag

SEQ ID NO: 13273 - DNA, 380 bp, Homo sapiens
tacggttgcgagatgacgacagacgggcctggctgatcacctgcggccgcttgattgagaccagcctgacccttattttgaaacccgggctatactattgctacatatttaactgttcttggtggcacatgcctgtaataccatctactatgcagtgggaggctggataatcacttgaacctgggaggcgaaggttgtggtgagccgagatcgcaccattgcactccagcctgggcaacaagagcgaaactacgtctcataaaaaaaaaaaaaaaaacaatgggggcccgttttttgggtattcccaccatgaaaaaaatcattgcaggggtgggccaaccccactctaaggtggcgggtaaaaaaacttttttttggtc

SEQ ID NO: 13274 - DNA, 344 bp, Homo sapiens
aaacactacatcactgcctactccaagccctagctccagtacgggaagtgaaccatgacaggaaatttaacatctacaggaaaagtagaaacacaattcttctaaggttttatataactccaactaaggtcatctcttccttgccattaacttcctgaacgcctgtaatcccagcactttgggaggccgaggcgggcggatcacgaggtcaggagatcgagaccatcccggctaaaacggtgaaaccctgtctctactaaaaatacaaaaaactagccgggcgtagtggcgggcgcctgtagtcccagctacttgggaggctgaggcaggagaatggcgtgaat

SEQ ID NO: 13275 - DNA, 317 bp, Homo sapiens
tacgacagaacggcaccatgttggccacgctggtcttgaaagcctgaactcaggtgatttgcccgcctcggcctcccaaaacgctgggattaccgccgtgagccaccatgcctggccttgtccattttagagccagcaagccaatcacatttcaaggcctctggtccccttttgtgaaataaatctctatacagggcacggtttccaccctctctccagctcctagcagttccatagcacgcttctaacctgctgtaacagagtgaggatttccatgtccttatgcagtggatgaatgatagggtgagtgagaacct

SEQ ID NO: 13276 - DNA, 345 bp, Homo sapiens
agtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatgtggggcgtgt

SEQ ID NO: 13277 - DNA, 359 bp, Homo sapiens
cactgcaacctccgcctcccaggttcatgccattctcctgcctcagcctcccgagcagctgggattcccggcacccaccaccatgcccagcgacttttttgtatttttagtagagacagggtttcactgtgttagccaggatgttcttgatctcctgacctcgtgatccacccgcctcagcctcccaaagtgttgggattacaggcgtgagccaccgcgcccggccgagcagataggttatcaaagagctgagcaaagattgtagcagtctcacagtactagggagataaaggtaggaattcaggactttccagggtgcacaggctttggtaaatgcctcacattatcagctgaaaacc

SEQ ID NO: 13278 - DNA, 398 bp, Homo sapiens
  misc_feature 119, 122: n = A,T,C or G
tgagtctcaaactcctgggctcaagtgattctcccacctcagcctcccaagtagctgggactagaggcatgtaccaccacgcctgcctaatttttttgtatttttagtagagatggggnttnaccatattggccaggctgatcttgaactcctgtcctcgggtgaactatctggcatggtctagttatgtgacgtgcacacatacttctttttgtatgaattcttcagcagaaatgggggtacttgggctgtgcgccccccgctcctctttataatgtcttgtatttagaaggaaggggctgcgttggcctcttcgaaatgtcgcgggtataaattcgctgaggagtgcttgtgaccacccttctaacgattcttctacgtgtgtagctctccagctc

SEQ ID NO: 13279 - DNA, 382 bp, Homo sapiens
agaggaggagaatcgggagcacaagaaggaggaggagatgaagaggtgaaggagaggaggaggaaaggagaagagaaggaggaggagaaaagaaaggagtggagaaagaggagaggaggagaaaaaataggaaacgaagaggagaagaataggaggaggaaaaggatgggagaaaagaaaaaggaaaagtaggaggagtagaaaaagaggagaaggaggaagaagaaagagaaggaggagacgaaaagaatgagaaaaagaggagaggagaatgaggagaaggcgtataagataagaacgaggagaggattaagaaggagaagtagaggaggaggagagaagaggaaaggaggaggaaaggagaatacaaggaggaagagaa

SEQ ID NO: 13280 - DNA, 326 bp, Homo sapiens
ccaaccagatgttgactgtcatcactgggactcaactgggaaaccctctttttcctccaaatttgctgctctaggtgctaagggtctgtaggacagagctttgggactgttagaattctatcagaaaaaaacgagacagaaggctataagcatgagtgtgggcagggtgctgtggttcacttctgtaatcccagcactttgggaggccaaggtaggagaatcccttgaagccaggaattcaagaccaccctgggcaatatagcaaaaccatgattctacaaaaaattaaaaagttatctgagtgtggtggcacacacctgtagtcc

SEQ ID NO: 13281 - DNA, 286 bp, Homo sapiens
  misc_feature 147: n = A,T,C or G
gaagaaggtggggaggaagaggaggaggaagaagaaggtgatggtgaggaagatgatggacatgactatgcggaatctggatcagctatgtgtaatcgggctgctgaatattattaggatgacgagtgtgatacctacaagcttatnacttgggaggcttgctcttgtagtatcgcttgtatcttttggaggttgtagactatatgttctctgttttccttttttctctttctttttttaatgaaaaaaaaggacctctcggtttattttgtgtggttatttatcg

SEQ ID NO: 13282 - DNA, 325 bp, Homo sapiens
gcggtctgggctcactgcaagctgcacctgctgatgtcaagcaactctacagcctcatgctcccaagtagctgggattacagcagcgcaccattatacctggctaattgttgaataattagaacgggaggagatttgctataggaaagtcctaaaataaaggaaaagtgatgagccctaataaacaagtagtgtttttgactcagcattgaaaaaaatgaatgagctatgaccaggagatctaagtttcttttggtggctaacatgcacaaaagttatctgttcaataagggtagtattgatggtccatatctcatattaactag

SEQ ID NO: 13283 - DNA, 320 bp, Homo sapiens
agcctcctgagtagctgggactataggcgcccgccaccacacccggctaatttttttgtatttttagtagagacggcgtttcaccgtgttagccaggatggccttgatctcctgacctcgtgattcggctgccttggcctcccaaagtgctgtgattaccagcgtgagccgccgtgcccggccactagcggcatttaattaaagagatcttggcgccgtctctcgtatactattgcctctaaccttgcgcgtgaccctgcctgatccttagtctgcttattggaataacggggatgtccttgctttcacaaggtttgatc

SEQ ID NO: 13284 - DNA, 353 bp, Homo sapiens
cgggcctggcggatcacctgcggcagttagtttgagaccagcctgaccctttttttgaaacccgggctatactatagatacaaaagtagctggtcgtggcggcacatgcctgtattaccatctactatggagggagaggctggataatcacttgaacctggtaggcgaaggttgtggtgagccgagatcgcaccattgcactccagcctgggcaacaagagcgaaactacgtctcacaaaaaaaaaaaaaaaaatctttggggccggtttttaaatgaactcgacatggaagcacacacttgtaggcttgggcacaccccaaagcttgagcggcgggaaaaaattgttttttg

SEQ ID NO: 13285 - DNA, 349 bp, Homo sapiens
gaatccagatggcaagaattgtctttgctacccctacatctacggtttactttgatgagcaattggcttcattatttgggccaccacttttatatacatactgggtttgagggcagcaaccagcattcttggctaagataaatgaggctgggcacagtagcttatgcctgtaatcccaggactttgggaggcctaggtgggaggatcacttgagcttaggagttctagactagcctaggcaacatagcaagaccctaactctaaaacaattttttttttttttttttggagaagagtttcacttttttggcccaagctgagagggacgctgccacccggaggattcctg

SEQ ID NO: 13286 - DNA, 405 bp, Homo sapiens
  misc_feature 301: n = A,T,C or G
cgttgctgtcggtcaaaactgtctttaaaaatcctacccatccctttaagttcagttgaaaattacctcttatataaagcttctgctaatccctccatttcccagccccagaggggactgttttttccaaaggggacttttttctgaacccccataatgttttatgcttcttatatggagtttatataattttgcattgtattggaatcatttaggtaattgtcttatcttcattgctagagtgtaagctctttaaggtaaagacagtgttattcagttaattatctccccaaatacctantatagcatcttaggcctatctagtagatactcaaaaaatatatatcctaataaatgtgattaagctatcacatttagtgcctatggtaggcactaaatcaaggt

SEQ ID NO: 13287 - DNA, 307 bp, Homo sapiens
gcagtggcatgatctcagctcactgcaacctccgcctcccaggttcatgccattctcctgcctcagccttccgagtagctgggactacaggctcccgacaccatgcccagctaattctctggattgatagtatagacgggtttttattgtttttttccacatttttctttttagtattgcctatatttcctcggcatcttgtacctaatagtgtgcgtttaaaaaattgcctggcaacatatatacgcttttttatttttatgacttgaataaaaaaaggtgggactcccaatttgttctcgcacct

SEQ ID NO: 13288 - DNA, 138 bp, Homo sapiens
acagttttaaacaacaggaagtcttcattcccttcctgggtgtctttggtcatctgggccctgatggtggagccatgccagatagagggattatgatgcttaaatctagtaggattactggtggagccgcttgaatcg

SEQ ID NO: 13289 - DNA, 324 bp, Homo sapiens
atgtgtatacatcctggtaaattttatggatgtgaaataacactgttgagtttgttcagtcagtatttctacattttaaatgaaaaaaaatgctgatcctattcattggagaaaacaacccacgaaacaaccccccaatatggtagaataaatgcctatttctaaggtgctatagtcttccaatgcacaccttcaggttcagacttagacaagaccaaaatatactttagttctaatcaccctcctaaagacaccacggcagagtgcactcccaacctctaccatacatagcggaaaggcacacactactactgtgagctgaaa

SEQ ID NO: 13290 - DNA, 280 bp, Homo sapiens
  misc_feature 220: n = A,T,C or G
atgtgtatacatcctggtaaattttatggatgtgaaataacactgttgagtttgatcagccaatatttctacattttaaatgaaaaaaaatgctgatcctattcattggagaaaacaacccacgaaacaaccccccaatatggtataataaatgcctatttctaaggtgctataaggcttccaatgcacacccttcaggttcagacttagacaagaccanaatatactttagttctaatcaccctcctaaagacaccacggcagagtgcactcccaacct

SEQ ID NO: 13291 - DNA, 317 bp, Homo sapiens
agagaatcactctaaagcagtggttctcaacctggctgcacattaaaatcacctgggatgttttaagtctcagctcccaggcttcaccccaggttattatatgaaaatctggggttgaaactcaggcatcagtgtatttcaaagctcaccatgtgattccaaggtatgtgcatatttgagagcctttgccttaaaagaaggagcaggtgactcatactagcaagatagtgaacagatcaccaggccagccttgtgggtagaaataatcgtgacactctgacactgttctctactaagttaatcaacatgtttacccc

SEQ ID NO: 13292 - DNA, 231 bp, Homo sapiens
  misc_feature 179: n = A,T,C or G
agggagctggccactctaccactctggtctcattcttcatatctgcagaatgcgggtgaaaatggcaccccctcacaggtgtgtgctgggattactgagataatgtgtaaaacttagctgagggccctggccctacaaaggggtcagttggtattagtcaatttcaaaggcctacattntccttgtctataaaattaggggctcagacagatgattttgaggtttctcttg

SEQ ID NO: 13293 - DNA, 384 bp, Homo sapiens
cgttgctgtcgaaactgccacggccactaggagtctaaggacacatccaatttccattcgcatccaaaatggaatccgagacagaaagaggaccttagccttcatatctgtttttttcttatgaagcttcttctggttggaaacttgtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgtt

SEQ ID NO: 13294 - DNA, 350 bp, Homo sapiens
gtagatgggagtacaggcacacaccaccacgcctgactaatttttgtagagacagggttttgccatgttgtccaggctgatcttgaactcctgatctcaggtgatctgcccgcctcggcttccgaaagtgctgggattacaggcatgagccaccatgcccggccgatgtctgcattttcataggtgaccactgaggctaaaaagcatcactattccaaatcactattccaaaggcattaactcctgatggtgacatctcaggcacttagacacttgtaatttattcatcaaacatgcctgagacagataacattttgctaggtgctcagtctgcaacgatgtattggact

SEQ ID NO: 13295 - DNA, 149 bp, Homo sapiens
tggttcgcgttgtgaaaatacgatatacgtgtacctgcttctgatatagtctacccactcggtgctgcctgtgtttaactctgctcctatcgatacacgcttcatctccataccttttactattgtctctcccttgcacttattcgctg

SEQ ID NO: 13296 - DNA, 379 bp, Homo sapiens
ttaacacagcgaaaccccgtctctactaagaatacaaaaaattatccaggtgtggtggtgggcgcctgtagtcccagctacttgggaggctgaggcaggagaatggcgtgaacctgggaggcggagcttgcagtgagccgagattgcgccactgcactccagcctgggtgacagagcaagagtccgtctcaaaacgaagcagcgcataaaagaaggacgaaaccaccgccaaccaaccaaacaaaacccaaaaaacccaaagtaacggaggtggccgagggagctggggataggggaggagtccaaacacctgggagctagaagtttctgaaaactgtaagtcttttggtgtcactaaaagatacaggatgaatgatcg

SEQ ID NO: 13297 - DNA, 388 bp, Homo sapiens
cgttgctgtcggattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaatt

SEQ ID NO: 13298 - DNA, 237 bp, Homo sapiens
gattgccccactgcactccagcctgggtgatagagcaagagcctgtctcaaaaaaaaaaaaaaaaaaaaaaatttggggggggtttttttgggtattcccaacgtggaaaaaacctttggggggttgggccaaccccccttttaatgggcgggaaaaaaagggtttttttggaaaattgggggaggtttgggtttttttggaccccttttaaggggggaaaaaccagttcaccaccg

SEQ ID NO: 13299 - DNA, 211 bp, Homo sapiens
  misc_feature 52: n = A,T,C or G
agatcgtgccactgcactccagcctgggcgacagagcaagactctgtctaanaaaaaaaaaaaaaaaaaaaaaaaaaggggggcctttttttccgaaatcccacactggaaaaaatctttggggggtttggaccaccccccccttaaagggcggggaaaaaagggtttttttgggaaaattggggagctttttgttttattgcacccctta

SEQ ID NO: 13300 - DNA, 282 bp, Homo sapiens
tagcaagacactgtctctacaggggaaaaaaaaaaaaaaaacctggcccttaaggagataaattattttagccggtaaacccgggaggcaaaaccctcccaattccggggcatgggctttaatggaagggggccaaaaaaacctgttttaattcccaccctttgtttagggggccctttttttgtttttgccctgattaaagtttaaccccaacggccaaatcctcttatacctagacatttaatttcataaagggggggggggggtagccaaagggaaaaa

SEQ ID NO: 13301 - DNA, 363 bp, Homo sapiens
  misc_feature 42: n = A,T,C or G
ggagcggaggcgtcgggaaaacgcgccagggaaatgagccangggcaagaatcgaggcgcttctcggccgtcgaaggcagcttaggactgctgagagactgggtaaggcagcgtccttaccttggaatgccgcagaaccgggcttcattagagcactggtgcatactcttaaaaattatctcggtaccggttcgtattttatttagtggatttaatcgtctgggaaggaggttctagccgcagccaatcttacagacgcgcagaatattaatctattttgtgccgacttaaggcacgcatattttaggatttgtgggttcccaagacctatcccaacgaactcaagagaagggggaaggccag

SEQ ID NO: 13302 - DNA, 331 bp, Homo sapiens
ccatcctggtcaacatggtgaaactctatctctacaaagaagacaaaaatcagccaggcttggtggtgagtgcctggagtcccagttactcaagagactgaggtggaaagattgcttgagcccagatgttgaagttgcagtgagccaagatggtgccactgcactccagcctggttgacagagtgagaccctgtctcaaaaaaacaaaccaaaagaaaagagagagagagagagaagttaagaacctgaatattctaagaaagaggttctgagagtagaaattcagctgaacccatattttcacaggaagtgagccaagaaggggaaaaaa

SEQ ID NO: 13303 - DNA, 377 bp, Homo sapiens
ggcacgagggaaaacaggccctgggcccgctgatgtgcataattccacgtttgccccccatgtaaccaggatggtaaattacaggtgtcagataatcacgctctggagtggctacttgaggatgcgatcgaccaatttaagctccgtctgacacatgatcaatagcccgtgatgctgcatggaattgcaggcacagcgtccaaacctgcagagcagtggctcccagctgtggcaactttgccccccagaggacatttggcaatgtctggatatgtttgcaattgtcacaactaggagagggggatgctattggcatctggcgagtgaggccaaggatgctgctaaacctcccatgatgcacaggagaagtccccacc

SEQ ID NO: 13304 - DNA, 358 bp, Homo sapiens
ggaaaataactcggattgcaggaagaatccaggtccctgtggctacaggactgaggccctgtttccttcctggcaggggaccactcttagcccctagagtccttgcatctaggggccagcaaatccttctcactcttgggacctctctaacatcctccttcaccacatagctctcatttcttgccagagaatgctctctgcttttcaggactcagataatttagccttcccaggtaatccaggataatcaatctactttgagatccataccctttaatcacatctgcaaagacccttttgccatgtaacatgacatgatcacaggtgttagggattagagtgtggctatctggggaaa

SEQ ID NO: 13305 - DNA, 275 bp, Homo sapiens
gtccattctcctcccttccccaataacagaaccccagttttgctgcagaaggcaatgtgcccagctaaagggcaacatttccagcctccctggcatatatggtatgactgtgtggctgaattctaggatattagatataaacagaaggtgctggaaggtatctccaagaatgccccttgaatagaagcagtattgatgaaggccatttttgtcctctctgcttcagcctgcattcagccttggatgcatatgtgatagctggaacgccagcagcc

SEQ ID NO: 13306 - DNA, 362 bp, Homo sapiens
atgccagtagtatttttgtttttttcactgagtctattgtgtctagaaaagtgcttatcacattgtagattctcaatgaactacttattgaatgaacagtcctatgaaccaggtatctcccttggccagattttacctaatgaagattctgcagcagtgagaacttgcctagagtcacatcgtcaaaggtggagctagaatctgtaagcaacctggctctctactctttaccactgctgcatggtactgcatggtgcctctcatttatgtggtgaaatttcaaagtactattttttatggttcccttactagacaggtccctcgcagcaggggatactaactttatctctggtccctgactg

SEQ ID NO: 13307 - DNA, 410 bp, Homo sapiens
  misc_feature 306: n = A,T,C or G
ggcacgagccacacctggccttctccatgctcggaataacttcctgcagcgaccaacaggctaaagagggggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggngaatctgggattcagggcttcagaggacagggagtttccagcaacatgagggaaataagcaaagagggcaatcgcctccttggaggctctggagacaattatcg

SEQ ID NO: 13308 - DNA, 325 bp, Homo sapiens
  misc_feature 166: n = A,T,C or G
ggaatgtggacacacatatcagaactttcatgcttactttctcaggatgcttgtgatctcaaagttaggacaggagtgaatttcaaaggccaaatggaaaattagcaacaatcccatcttaagggcttataaagagtatcagaatcattcttggggttgggccggncatgatggctcatgcctgtaatcctggcacttcggaaggccaaggagggtgggtcacctgatggcaggagtttgagaccagtctgggcaacatggttataccctgtgtctacttgccaaccctaaatttacttagcgataaagggggggtcccttttag

SEQ ID NO: 13309 - DNA, 398 bp, Homo sapiens
cgttgctgtcggaaccaatggatgtcagtaggagtttctgttaaatgtctccttgatggggactcagtactgtgtagagacgctgtgtttctcttctgggggtgtgcatcagaaccactggggccttttaaaatctacagatgccggccgggcgccgtggctcacgcctggaatcccagcacttggggaggctgaggcgggcggatcacaagcgcaggaaattgagaccatccttgccaatatggtgaaaccccatctctacaaaaaatacaaaaattaccggggtgtggtggcgtgcacacctcccagctacttgggaggctgaggcaggagaatcgcttgaacccgggaggcaaagattgcagtgagccgagatcacgccactgcactccagcctg

SEQ ID NO: 13310 - DNA, 339 bp, Homo sapiens
  misc_feature 339: n = A,T,C or G
agacagtgttccaccatgttggccaggctggtctggaactcctgacctcaagtgatctgcccacctcaacctcccaaagtgctgggattacaggcatgagctgtgacacccatcgtgtctaatttttgacagataaaatgatttcatgatccaacatttccttaccagtgagggattcaataaaataccaattctcagagggcctttacacttcttttttttttttttctaaagaagattgtttattacccacgagataattttgaaaagccatcattttttttctgcttgtgacccgaaaaaacgtccagtgttctcgcgatttctttcatctctttn

SEQ ID NO: 13311 - DNA, 350 bp, Homo sapiens
cgctaggaaatgctgccctcacactcgagtcagctcatctgctccgggctgtgtctgctcggcaaactagacaagggcaagcgatcccacacctctcacacagaacttctagaaaagatgggcctctccaggtgcggtggctcacactggtaatcccagcatttcagggggccgaggcaggtggatcatgtgaggtcaggacttcaagaccagcctgaccaacatggtgaaatcccatctctactaaaaatacaaaaataaataaataaaataaaaataagccgggcgcagtggctcacgcctgtaatcccagcactttgggaggctgaggcaggtggatcacaaggtca

SEQ ID NO: 13312 - DNA, 360 bp, Homo sapiens
ttgggaggccgaggcgggtggattatttgaggtcagtcgttcgagaccagcctggccaacatggtgaaaccccgtctctactaaaaatacaaagattagctgggtgtggtgacgtgcctgtaatcccagctactcgggaggctgaggctggagaatcgcttgaacccatgagctgagatcacaccactgcgcttcagcctgggccacagagcgagactccgtctcatcaaaaaaaattatatgacccctgtctataaatgataagagtgagagagaaagcacccagggtttcaaatgccttatgcctgctgggactaactttgcccatacattgtgctaaatactttccattaagtctcc

SEQ ID NO: 13313 - DNA, 353 bp, Homo sapiens
  misc_feature 183, 184, 185, 186, 187, 188, 189, 191, 192, 193, 194, 195,196, 197, 198, 199, 200, 201, 202, 203, 204: n = A,T,C or G
gattacaggcgtgcaccaccatgcccagctagtttttgtatttttaatagagatgaggtttcaccttgttggccaggctggtctcgactcctgacctcaggtgatccactcaccttggcctcccaaagtgctgggattacaggtgtgagccactgcgcccggcctactacatacatttctaannnnnnnannnnnnnnnnnnnnaaaaaggggggccgttttttccttaaacccaaacttgaaaaaaccctttgggggggtggccccccccccccttaaatggcggggaaaaaagggtttttttgggaaaattggggcggctatgcgttttttgggcccccttagagccggca

SEQ ID NO: 13314 - DNA, 331 bp, Homo sapiens
gagaatcgcttgaacccgggaggtggaggttgcaatgagccaagatcgcactactgcactccagcctcggtgacacagctacactccgtctcccctactcgccaaaaacaaaaacaaaaaaaaagagtgcagagaactggaggtggcgggaaaagcgcttggattctcctttgacatgctcttccctggcaagatgggatcccttggaaaattttaagtggaaaagtgacacgatttatggctgagtgcagcagctcacgcccgtaattccagcactttgggaagctgaggcaggcactttgggaggctttaggtcaggagttcaagacca

SEQ ID NO: 13315 - DNA, 348 bp, Homo sapiens
  misc_feature 315: n = A,T,C or G
attactgatatggggggtatggtctagtcgctgtgctgagcatttcatataactgggctttttctatcctcacagcatagcctttgagataggtatgtggaactattcccattttacagataaggatcctgaggcttagagagttcaagtgacctacccaagggcacatcactgataaagggcagaggtgggattcaaacccacatctgtcaggtgcaagtgcaaggctccttctcctcatgctcactgcctgctggggaatagggtactggggacataccccagggagcccttccccatgttctgagtcccagntcatcccatgctgctattttgctctcccaggag

SEQ ID NO: 13316 - DNA, 357 bp, Homo sapiens
  misc_feature 357: n = A,T,C or G
gattacaggtgtgagccatcgcgcctggcccctgcaacttatctttctatatttctcatttttcacatgaaaaggttggtctattgtatctgattttatggaagctgtgctctgtatttgtgggttctgaaattgtgcttatgatatgactcattactgattgtttcacatcttagagatgaggttagactgaaatgtggaccggaagcctatttttgtgtttcaatttaaaaaataaagccaggcgcagtggctcacgcctgtaatcccagcactttgggaggccaaggcaggcggatcatgaggtcaggagattgagaccatcctggctaacatggtgaaaccccggctatactn

SEQ ID NO: 13317 - DNA, 353 bp, Homo sapiens
tcctgcctcagcctcctgagtagctgggactgtaggcgcccaccacctcgccccgctaattttttgtatttttagtagagacagggtttcaccgtgttagccaggatggtctcgatctcctgacctcgtgatccgcccgcctccacctcccaaagtgctgggattacaggcgtgagctgccgcgcccagccataaaacttctacgaacttctagcagaagtaagggaatagtttctaattcctgagaaagtattatgatgacagatcctatattctttattcactagtatatacttagtgtacacataataagtaggtgttcaagaatttttttttttccttgagatggagcg

SEQ ID NO: 13318 - DNA, 356 bp, Homo sapiens
gtagagatggggtctcgctatgtcgcccaggctggtcttgagctcctggcctcaagcgatcctcctgccttggcctcccaaagtgctgggattacaggcatgagccacaagcgccggcctctctcttcttattgggataccagtcctctgagactcgaaactgtgccccaggccttggccatactgataaatatctaggccctacaggagttcgtgtccatgaacccagtacacgcaattcctcagccttaaaatctagtcactgactcatttcaggccccagcacagacgaaaacaagccattctgtttgcccagattacattgcgggtctccaagaagtggaatgttcaccaat

SEQ ID NO: 13319 - DNA, 342 bp, Homo sapiens
gaggggagctaaaagggaatggaggggagaccagcaggagctctgtctgcccgattctggtttgggctgtgagacagtcattgcatttttttgcacagttctggccacacagtatttaagaggctttgcctacagacctgagtgactgtgtgaatggtggcactggtgcatacggggacgcctgaggaggaacagatttgagacttgtccacctaggactccctgtgggattgccagtatcacccctcttcgtcattaattcccagcttgcctgggggaggccagggggtagcatggggttcgggttcccctatggttcaaacaccaacccatctgctctgg

SEQ ID NO: 13320 - DNA, 305 bp, Homo sapiens
  misc_feature 305: n = A,T,C or G
gcaattgggcatagaaccttccaactgagcagcgaaggtatcaggatgcagtgtataatttaagacatcaaataaagctgacaagcaaagacaataatggagacttggggttaaattagctgactggagtcagaaacactgggatctgcatacaaagtaaacattaaacattgggatgcagtccaggcatggtggctcgaccctgtaatcccagcactttggaaggccgaggtgggtggatcatttgacgtcaggagttcaagaccagcctggccaacacggtgaaaccccatctctactaaaan

SEQ ID NO: 13321 - DNA, 124 bp, Homo sapiens
gttataggccttttgcttttcttagcatatggggggaggtggaattactatcgtagtcacaaatgaccaaaacaggacttcccaatatctatttattttagcccgggtgccgcggctcttgccg

SEQ ID NO: 13322 - DNA, 218 bp, Homo sapiens
  misc_feature 146: n = A,T,C or G
gcaccaatgtgaagaaccacaaacattgggtctgggagaaggcttctgaggtggcttccacagtccatgcaagggacacagagaagaacaaggctcacagcaagtaggatggcatggtaaaaaacaaaaagaagaaaataaaaaangggggccccgaaaaaaaaaaaaaaggggtccggttggaaaaaaaaaacaaaggggtccggttgcaaaaaaaa

SEQ ID NO: 13323 - DNA, 373 bp, Homo sapiens
agtgcaggggaatggaatggaatggaatgaaatggaatggaatcttccggaatggaatggaatggaatggaatggaatggaatggaatggaatgcaatggattcaactcgattgcaatggaatggaatagaatggaatggaatggaatggaatggaattaaccagaatagaatggaatgtaatggaatggaacggaacggaacggagcggaacggaatgtaatggaatggaatggaaaggaatgcaatccacgtctattgcatttcttttgtatgggaatggccactaacccctgttcggaatggatatggtaatggattcggaaccggagggggaacacccaccccgtattgattatatgatagttaatttg

SEQ ID NO: 13324 - DNA, 395 bp, Homo sapiens
  misc_feature 105: n = A,T,C or G
cgttgctgtcggggagattgagaccacggtgaaaccccgtctctactaaaaatacaaaaaattagccaggcatggtggcgggcgcctgtagtcccagctactcanagaggctgaggcaggagaatggcatgaacctgggaggtggagcttgcagtgagccgagatcgcgccactgcattccagcctgggcgacagggagactctgtctcaaaaaaaaaaaaaaggttaaaataaataaaacccgggggtttaaagggaacctttaacctttgggtttttcgggaaacccatcagggggagggggggttggctttgtgggaggatgggccccaggtttcctaaaggcctggaaataattttttagggataaaggcttccatcaagagacttttggg

SEQ ID NO: 13325 - DNA, 303 bp, Homo sapiens
cccaggttcaagtgattctcctgcctcagccttccaagtagctgggattacaggtgtgcaccaccacgcctggctaattccatgcctggctctcttactgtaaatgagaataagaaagaatatactctgctcaaagtcttagtataatagcatgtctcaaaatagaaaattgggcagagtgttcatagggtttcagagactcagctggatgttaaaatcacccagggtctaggctgggtgcaatggctcatgcctgtaatcccagcactttgggaggccgaggcgggtggatcacaagggcag

SEQ ID NO: 13326 - DNA, 236 bp, Homo sapiens
cgggatgctagatgactccatcagccaatatgttagcattatctagaggccttatgtgaagtcctagtggtcctttccagttctatgactttaaacatacaggtgaatcagagcttcaggaaggcctagaccaacagctattactgaagctcccatttgtgcttaggactatgcatagagaaactctcctttgggacttggttagggtccaaagccctaaggtcaaaacactaatt

SEQ ID NO: 13327 - DNA, 317 bp, Homo sapiens
gggtatgcatcccattcccctctccccagactggacgctcttaaagggcaacacttatacctcatttagccttgtattccctgcacagggtaagcattaggtaactgcttgctgaattacttactttggattagagaagagcgaagatatagcacataaaagttactgaacagtacagtgtcaaactcagatcttagataaaatggttgtgtaacactgctgtgctaatgagtccattctgacccaaagtcaagaacaggagaatatgcttgtccataggtatgctcaggaacttctcagggagtaaaccaatcagc

SEQ ID NO: 13328 - DNA, 315 bp, Homo sapiens
gattacaggcgtgcaccaccatgcccagctagtttttgtatttttaatagagatgaggtttcaccttgttggccaggctggtctcgactcctgaccttaggtgatccactcaccttggcctcccaaagtgctgggattacaggggtgagccactgcgcccggcctactacatacatttctaatgaaaagaaaaaaaaaattaattaagagggggggctttttttctggagacccgcatgggaaaaaagcttttgggggggttggcccacccccatttaaatcggggggaaaaaatggcttttttgggaaatttgg

SEQ ID NO: 13329 - DNA, 416 bp, Homo sapiens
  misc_feature 416: n = A,T,C or G
ggcacgaggggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcan

SEQ ID NO: 13330 - DNA, 264 bp, Homo sapiens
atccacccgcctcagcctcccaaagtgctgggattacaggcttgagccactgcgcctggccgccacaggcccactcttaaaaagataatgcataatataagattttgcttttcttttcttttgtttctttctgctctgacaggtaactttgattgtcattgacagttttaagaattcagtaccaaccactgaaagggtatgaatatccttgcttaaagaaagttaaaaagaccaggtgtagtggctcacgcctgtaatctcagt

SEQ ID NO: 13331 - DNA, 407 bp, Homo sapiens
gttgctgtcgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgctttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagag

SEQ ID NO: 13332 - DNA, 157 bp, Homo sapiens
ggtgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcct

SEQ ID NO: 13333 - DNA, 409 bp, Homo sapiens
cgttgctgtcggcagtttgcagctgcggcggggtcgggtccacccgcggtccccggaatgccggacggctgatcccgggtgctggtcactcgccgattcggggctgggaaggtttgccagaagcgggaaagatgggagatctgagcgctctcttggcatcgccacacccaggacttgctcgtgccgcaattccccacggaaacaaccgagttgaaacgagaagcttgctctctgggtgcagtagctagaaggcttcaggtaactccaaagccaacactgggtgaggcaacacacgccgcctcaggactcagcatttctttcaggctgcgttttcgtggcagacctacccagattgatggagaaagtttggctggcggataagaagtaacgcggaagatgtattattgtg

SEQ ID NO: 13334 - DNA, 320 bp, Homo sapiens
  misc_feature 268, 269: n = A,T,C or G
cggtctttaccttgttgcacaataacccataaaggtgggaagtggagcttgtatcagtgtgactacgtcaggcccaggtatcaggggggccaaggtgggctgctccccacagagggcatatttctctaattgcaaataggtatgctacaggccagtaggaaaccattcatctctggtttcccagtctagccctggcacgctgttgaccctcagttaatgatacctcgtgtgtgtgtgtgtgtgtgtgtgtgtgtgtgtgtgtgtgtgnntatttattttttttgggtttttttgatttgatgagggagtgggttttggag

SEQ ID NO: 13335 - DNA, 288 bp, Homo sapiens
gacggggcttcaccatgttggtcagtctggtctcgaactcctgacctcgtgatccacccgcctcggcctaagaaagtgctgggattacaggcgtgagccaccggccgctgatggtattctttcctgagggcagattttcacgccagaagccccgacaattatacctgagctggttccacctaagctcaatcctccttccctgccccaagggggtgaaaaaatctgggcccaggaggtcttccttgtgctctggggggaggcatttaagggtccaaggaagacgtgacg

SEQ ID NO: 13336 - DNA, 221 bp, Homo sapiens
caatgtttcccatgaaggaatcgaggtcccaagagtagttcaggtaaggaattaataagcatcacaggaggcatgtccaggctggcttgtccccaggccctctgccttcagccaccattctcagaagatccaaaaatgccaaggggaaagaagccggatgctttttcaccttaagtgaaaagtcagaattggaattaccctttctgaaggcctgctttgca

SEQ ID NO: 13337 - DNA, 202 bp, Homo sapiens
ttggatcgggctgcgataagacgacaggaggggattgtgggtgagattctctcccaggccacaagacatttcctgctcggaaccttgtttactaatttccactgcttttaaggccctgcactgaaaatgcaagctcaggcgccggtggtcgttgtgacccatcctggagtcggtcccggtccggccccccagaactccatct

SEQ ID NO: 13338 - DNA, 324 bp, Homo sapiens
cggagggtcggtattgattgatatatggaaatgtaggcacaggtttccaggaacccacatctttatatcccctaagagcatgcgattcacaattcacagatacagtgcttgaggcgagtttatagaacataactattggatataccatgacctaaaggcattcctttctaaatggaaatcgaaacacagagcctgacaatttaaggcacactaaattcccctttcttgtactttataagtaacgacggatgaggaaattatatacagtgtaaaacggggtttggcattgggctaccactgctaatgggtacatgacttgtgtgg

SEQ ID NO: 13339 - DNA, 270 bp, Homo sapiens
aattcaatctatctgcttgatttgggacatccagtgctcttgctctgcgacattggagctccttgttcttaagcctttaaactcaggcagggattttcactatcagatctcctacttcctgtttttggaccttggtactcagactggagcttataccattggctttctggctcccaggccttcaggcttgaactagaactatactgcttgcttccctgggcctccagtttgcagatggcaatttatagaacttctcagccttcataatca

SEQ ID NO: 13340 - DNA, 314 bp, Homo sapiens
gtcgtacgggttatacttcaccggacgactcctctcccccactcctttgtgagtctggtctcttgccagtttcttaccctgagtggagctaagcagataactcgtggttattccaagatagcatctgagtggagccacttcaggactagagggatgcgtcctggatctttggtctgtctcatgccttgcaccaagcttgagggtgacgtatcatgaccttgctggagtgattgaacttgatctattgagacgccattcaggatccctagaaacaagcacggtagactgctactgtgaggcaggtgtttcaacgt

SEQ ID NO: 13341 - DNA, 291 bp, Homo sapiens
cctgtaatctcagctacttgggaggctgaggcaggagaatcgcttgaatccaggaggcagaggttgcagtgagccatgattgcgccactgcactccagcctgggtgacagcgagactctatctcaaaaaaaaaacagatttctctcctatgagagtttctggtctttgatgctgcactttcctcttctgaaacatcaagtgcttttaaagagggatggtgctgactgcctggttctgaggcatgaacgacactggtaggtgagagcaagatggtacagaggagttcaaatt

SEQ ID NO: 13342 - DNA, 312 bp, Homo sapiens
  misc_feature 168: n = A,T,C or G
ggattacaagcgtgagccaccatgcctggccaatttttgtatttttagtagagacggggtttcatcatgttggccaggatggtctcaatctcttgacctcgtgattcacccaccttggcctcccaaagtgctggaattacaggtgtgagccactgcacccggcctttnttttttttttttttttttttgggaaaaggggggcctcattggggtccccacgatatcccaaaacccggggggaaaagaacaccctttatttgggccccaaagggggggaaattgtggaggggggccccacgcccttctcggtag

SEQ ID NO: 13343 - DNA, 391 bp, Homo sapiens
ggcaccagcaaagaggaaacagacagtttgattgcatgtcctcagtgcaatgctgaatacctaatagtttttccaaaattgggtccagtggtttacgtcttggatcttgcagatagactgatctcaaaagcctgtccatttgctgcagcaggaataatgatcggctctatctattggacagctgtgacttatggagcagcgacagtgatgcaagctgtacgtcataaagaacgactggatgttatggacagagctgatcctttattccttttaattggacttcctactattcctgtcatgctgatattaggcaagatgattcgctgggaggactatgtgcttatactgtggcgcaaatactcgaataaactaccaattttaaatagtatat

SEQ ID NO: 13344 - DNA, 275 bp, Homo sapiens
ggcccgcctccatggcgcaggtttacctatgtgactaacctgtgcgttctgctcatgcccgccatctttttgaaagaaaaaaacataagggaggtgggggggccttttttctggaattgtcccagcgaacatacctctgggggggttttgtcacaccccccttttttttgttttttccaccgttttttttttgaaaataggggaacaagttttgggggggggctcccttttgggcccgccttgcggggttcccttttctcctgggtgtccgctcg

SEQ ID NO: 13345 - DNA, 322 bp, Homo sapiens
atgttggccaggctgacctcgtgatccacccacctcggcctcccgaattgctgggattacaggtgtgagccaccgcgcccagactaagtcccatctttatgtccgcttggctgttccacggccacctggaggggaggtaggtccagcgatgtgggaccctaggatttcagggtagaaaatttgccgcactacagttacaaaattattccaaggtttatgttcctcgggggattgctatactcacctgttatgcactggtggcaagttttgtttttttctaataattaaggggtgataatttttttcttaagcatagggggcg

SEQ ID NO: 13346 - DNA, 319 bp, Homo sapiens
gagagagaggagaatgaggaaggacaggccagaaggtgctcatggatcccacagtgtagggcctggaggcctctgtaaagccatgaagggtgggtgaccacaacagtgcatgctctcaaaagaccactctgctggttagatggtagtcaagagacaggtcaccatgaccgtgagagaatggagaagtccagatgtatttgaagaaagctcagatctgcaaatgaaccgaggccgtgcacggaggctcacgcctataatcttaacactttgggaggccgaagcaggaggatcacttgaggtcacgaatttgagaccagcc

SEQ ID NO: 13347 - DNA, 376 bp, Homo sapiens
caatggcatgatgtcggctcaccacaacctctacctcccgggttcaagtgattctcttgcctcagcctcccgaacaactgggattacaggcatgcgtcaccacacccggctaattttgtatttttagtagaaatggagtttctccatgttggtcaggctggtctcaaactcccgaactcaggtgatccccctgcctcaacctcccaaagtgctgggattacaggtgtgagccatggcgcccagccccttcggattctttctataagcaaattgtgccttggacatatgctttgaatgctttgagagaacctctcttcataagtggaaataaaatcatgatttaattgtatcacacgcattatggataatctatggg

SEQ ID NO: 13348 - DNA, 376 bp, Homo sapiens
tacggctgccagaagacaacagaaggggtatcttcatcataggcacaagcccacagatgtggaacagtaaagttcacattctctttatatagtacaaatactcttcattaatatagcaggcccataaagatagtggcaattgggcaatatatgctttacttgtaggccattgatagatctctttaaatgaatagtattttctaccaaacaccaaagacagaaacaaaactcgtcaggctgagttgagctcataccttgaattgctcctctgtgttcttccttatcaatggagatcctcgtaagttgagagattctgtcaggaggtatttcatgtgggaatcccctgggctactgggtcacagcagtaactcagcga

SEQ ID NO: 13349 - DNA, 339 bp, Homo sapiens
cccagctactcaggaggctgaggcaggagagtggcgtgaacgcgggaggcagagcttgcagtgagccaagattgcgccactgcactccagcctgggcgacagagcaagactccatctcaaaaaaaaaaaaaaaaaaaaccccctttaaaaaatttcaaaaacccatgggaggcttttataagggcgggcccctgaaaaaaaaaaatttggggcgctgaaggtggggcttttgaaacaccccaagccaaaaaaattttaaaaaggggtttttttaaaaaagaaaaaggcccggccccggggtttttggcttgtatccccccctttggaggggccgggggg

SEQ ID NO: 13350 - DNA, 366 bp, Homo sapiens
gaaatctcgcagagcctgatggtatttggatagcatatacccaccagaggaacaggcttttatctagcataccacaggtctcccctttagcacatctgtgctcattttgaaactgtatagggaaggacattagatggctgggagaactctgaaggacagacctggatctcctgccatcttccaaaggtgaaacaacaaaaatccgccaggctttcagtcagaagcccggaagggccactcccaaggaacagaggcaagagcagaagtagatggagtcttactgaaactgaaacccagctcaattcctaatagggtgaagatatgagtacctcaatgcagtctgcttatcagaaaggcatatcatat

SEQ ID NO: 13351 - DNA, 347 bp, Homo sapiens
aatgattagcacagagaatacgtttggtctcaaatattcccaccaaaatatacctccatggcaatcggggaaagggagagggtggtaaatgtcaacccatgagaaaggaagggtctggaggcacaaatcaaaggggacctaagtaggcaggaagtatcactgaaaaccttcaaaatcttgcattatacgacagcattaatttggccatttaaaatgtaaaaatgggccaggcgcagtgactcacgcctgtaatcccagcactttgggagggtgaggtgggcagatcacttgaggtcaggagttcgagaccagcctggccgacatggtgaaactccatctctactaat

SEQ ID NO: 13352 - DNA, 167 bp, Homo sapiens
  misc_feature 13: n = A,T,C or G
ggagaattatttnaaaataaaaaaaaaataggggggggcggttttttcggaaaccccaacctggaaaaaacccttgggggggtggggccaccccccccttgaagggcggggaaaaaagggctttttttggaaaattggggggcttttggttttttttgaacccttag

SEQ ID NO: 13353 - DNA, 303 bp, Homo sapiens
cctgtaatctcagctacttgggaggctgaggcaggagaatcgcttgaatccaggaggcagaggttgcagtgagccatgattgcgccactgcactccagcctgggtgacagcgagactctatctcaaaaaaaaaacagatttctctcctatgagagtttctggactttgatgctgcactttcctcttctgaaacatcaagggcttttaaagagggatggtgctgactgcctggttctgaggcatgaacgacactggtaggtgagagcaagatggtacagaggagttcaaatttgggtccaccat

SEQ ID NO: 13354 - DNA, 178 bp, Homo sapiens
  misc_feature 9, 178: n = A,T,C or G
tgatatcancctgcgactgcaagattcttactgcagtacagaactctttttctcccttgcacttttttttgacctggcatctttttatagggaaaaacggcctttgtcggcagtggcaaacttgcaaggaaagctgccgactctttggcaggctgatacagagcctgcactctggcan

SEQ ID NO: 13355 - DNA, 381 bp, Homo sapiens
  misc_feature 316: n = A,T,C or G
actgcgcgcggcctagctggaaactttcctgcccagtatatcagtcatatttctcagcctcactagcagcaggatgtggccatgtttctggctaatgggatgtaaacggatatgttcagtgggacttcctagaagcttccttaaagggaagcagacaggccagaggaggtgcctcatgactagaatcccagcactttgggaggctgagctgggaggatcacttgaggccaggagtttgagaccagcctgggcaacatagtaagacaccatctttacaaaatataaattttttctttttttttttttgaaaaaaagnttggttttgccccccagcttgaaaggcaggggcccaatttaacctaattgggagccccccttccg

SEQ ID NO: 13356 - DNA, 390 bp, Homo sapiens
  misc_feature 35: n = A,T,C or G
cgttgctgtcggaagaattcgcgccgcaggaaacnacctttttttttttttcttttttgttttttttttttttttttttttttttttttttttttttttccttccccccccccgggggttctctctttgggaaaaaaacaacgggagggggggggggaaaaacccccccccccgggctatcaaaaagggtgaacctttctccggccgccgggggggggaaaaaaccccccggggcccccaagaaaccccccccccaccttttttgcgccggggttttcaaaaaaaaaaaaaaaaaaccgggggccgcccccccccttacataaaaacgggggggggtgctcttcacaacaggccccccacgcgccgaggtgcccacaaaaactccccccc

SEQ ID NO: 13357 - DNA, 361 bp, Homo sapiens
  misc_feature 198, 206: n = A,T,C or G
ccttcatccgaggaatgtccccaaggcaggaggggagacatgcctgccatcaatggcattctctgcggggcatggactctgggggctctaaggggcttctgtagggggggcatgcccctggagaagttagggcagcttatggaagccccggagctccagcctcacctggccaaggggaccccacctcttacagagcanggcccagnctccctcattctccaaactacagagggggaggagcagggaatgagagcactgaaccaatgaggacagggctggggggctgggggaacctgccttccaactgggggacataaggcaagcttcgcaccatcttctgagtcaatcctgaatggaaccc

SEQ ID NO: 13358 - DNA, 303 bp, Homo sapiens
gggctcagaatggcatgaacctgggaggcagagcttccagtgatctgagatcgtgccactgcactccatcctgggtgacagagcgagactccccatattaaaagggtgggaaaaaaaggcgggtgttgttgaacccgggggccccactttttttaaccccccggatgaggggggcaatacccttttttaacccgccaggaactttttttttttgtccaatcttgggggggttgttgttttttttaccgcaatcaagctcggaaccaggggcttccacaccctggtgccctttttatgagggcg

SEQ ID NO: 13359 - DNA, 356 bp, Homo sapiens
gtagatgggagtacaggcacacaccaccacgcctgactaatttttgtagagacagggttttgccatgttgtccaggctgatcttgaactcctgatctcaggtgatctgcccgcctcggcttccgaaagtgctgggattacaggcatgagccaccatgcccggccgatgtctgcattttcataggtgaccactgaggctaaaaagcatcactattccaaatcactattccaaaggcattaactcctgatggtgacatctcaggcacttagacacttgtaatttattcatcaaacatgcctgagacagataacattttgctaggtgctcagtctgcaacgatgtattgaacttagtcc

SEQ ID NO: 13360 - DNA, 335 bp, Homo sapiens
gtgccaaaggggagagactggattttgacgacagtaggagcaccttatgtagtacagagaagaaggcagagtatgtggatacagatgctgtgtggtggttggatgtggtggcggcaatttgcccatgttttattatcagggtttacattttttcactcccgcatgaagcttgagtggtaggacaggggaggaaatgttgaggatttgtggggagatttttgaaacaaccatcatatatgatggtatgaaagagattgccacggacctagttgagaggtgggataaaagcgcttttgttggggacccgcagggggggtggatattatggtggaagg

SEQ ID NO: 13361 - DNA, 388 bp, Homo sapiens
  misc_feature 388: n = A,T,C or G
attcatggttctccatggcatctctggtcttcaacattattttgcatagggtctcagaagcttagtgtgagcggatgatatgggcacgaagcaaggcacccagaagtgggggcaactactctgctttctaaaatgcaagggaaccggaaaatccaggagccgtgccaaagtgagtgagtattttcttgggccaccaaaggggtctgaactggtgtggcttgagctcagtttttgtggttcagatagatttgaaaactcacttctccccattaagcactggaaggaattagtcacccttctttgtggaagtggagagattctccgagagctactcaacaggctcctttgaaaggttctcaggaccagcactgtgctgagtgtgtgtggn

SEQ ID NO: 13362 - DNA, 348 bp, Homo sapiens
aggtttagccccaccaggcatctggttggggggccgaggtgaggactattgcatgcttctgtggtctgagttccctcagagtactaaaatggatttgtgtgtatgcaaggggaagagagttaggtgggtgcggacagaagcagtcttaactagaaatacacttactagggttttcctctttttttttttaaaactgtcatgccgggcacgggggctcgtgcctgtaatcccagcactttgggaggccgagggggggggatcacttgaaggttagaagttcaaaaccagcctggcctccttgataaaacaccattttttctaaaaaaaccgaaaattatgtgggcgcct

SEQ ID NO: 13363 - DNA, 343 bp, Homo sapiens
agcctggccaacgtagtgaaaccccatctctactaaaaacacagaattagccaggcttggtggtgcgcacctgtaatcccagctactggggaggctgaggcaagagaatcacttgaacctaggaggcagaggttgcagtgagcctagatcgtgccactgcactccagcctgggctggacagagcaagactccatctctgaaaaataaaataaaataaaataaaacagaaaaacagaatagaagaagatagctaagaaccacagtggtcaagccagcctggcttcaacagagatgaatggagagaccacggtcagccccattaacagaagaactggggccagga

SEQ ID NO: 13364 - DNA, 355 bp, Homo sapiens
gcagacacctgatagccaggcaggcaacgcctgctagagtttctggaccagtggtcccacttctgtgtgaactcagctggtgggttcagccacctgttgtcctgggaagcacctggacagtagggcatgcatctctacccaaacctgccactggtagccatgaaagccatgcctgcttagagctgcaagcccagcagtcctgcttctgcctgaactctgaaggcaggcacaaccccatgtttccctgggaagtacatggacagcagattacggccaacccagcaaggataaggcttgtctgacaactgcaacccccgcccaacttcatgagagaggtcaacatttaaattcagaa

SEQ ID NO: 13365 - DNA, 402 bp, Homo sapiens
ggcacgagccgacacccggaagcctagttgcctggaggttctgagcgttctgttcggacctcctaccgttactctttcattcactcaagaaatgatttcttgagttcccggcctttgtcagagagatgaacgaggcacggtccgtgtccagctaaaggacagtatgactggaagagcgttgttttccaaggtacaggatgccgcgcctcctatgagccgaagggacgggaggccgcgtataggaggggaccgtccccgagcctcgccgagcctgcggtgtagacacctctggtggttagcgcgtgacgatctggtgaccgcgcatgtcgcgttccaaggaccgttcttaccagaaaatatctggctgtcgcgaatacatcttgctgggcccgccccgtaccg

SEQ ID NO: 13366 - DNA, 392 bp, Homo sapiens
cgttgctgtcgcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggagtctgaagagagaaagaacag

SEQ ID NO: 13367 - DNA, 378 bp, Homo sapiens
cgttgctgtcgctggtctcaggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtct

SEQ ID NO: 13368 - DNA, 400 bp, Homo sapiens
ggcacgagggagacagatggttttgaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggggaaacaaagagaatctctgggggccaagaagcatgactttgccatcatccgagtagaggaactctgccccttcccgttggattctttacagcaagagatgagcaaatacaaacattgttaaagatcatatttggagtcaggaggaacctcagaacatggggtccgtggtcgtttgtttctccaaggattg

SEQ ID NO: 13369 - DNA, 403 bp, Homo sapiens
cgttgctgtcggataaattcgcgtgctaaggaggtgacactgttattgtttgtcctggccattatgtggtacatggcactttatccattgctgactccattgagttggaaggatatggcctaccagatgacattgtgatagaaaagaggggcaaaggcgacacttttgtggactgcactggtgctgatattaaaatctcaggcataaaatttgatcagcatgatgctgtagagggaatcttaattgatcaccgtggtaagactacgctggaaaactgtgtgctgcagcgtgagacgaccggagacacagcgcggacatcagcagagtttctaatgaagaactcggatttatatggagcgcagggtgctggtatttaaaaataacttgggagtcaatgcgcgcg

SEQ ID NO: 13370 - DNA, 390 bp, Homo sapiens
tcaattccgctgctgtcgccactggcctttttttctgagcaacaaaggagtgcttcatctggggagtgggaacctgagccgcggctctatcgttcaaagagtttaaaaagcattaatgttcatggcgatctactacgaaaaagccatcctccaaaagtcagggagcgccatttttctgaaagcacttctattgacaatgccctgaggcgactgacccttgggaatgaattctctgtcaacaatgggtacatgcgaagattcaaatctttttctgaactcccctcctgcgatggaaatgaaagttgggcttatcgcaacgggaacaaaacaggacccaggtccgcgataactatattcagacctaacgactattgggaatcttggaaaaac

SEQ ID NO: 13371 - DNA, 260 bp, Homo sapiens
agtgggatttgatggaaatgtgaaccatttttcctcttttctggctccaggttctacctcttcctgcaggaagtccacacaagctgggatgagggggaggcaagacaaaagggcagggcaagtttgacacaattaacacctcgatcatgcctccaaatgcagagggtctttcagggaaggagaatcaaaatgtacgggagaaaaatgacaggagacgacaggcacggtggctcacgcctgtaatcccagcactttgggag

SEQ ID NO: 13372 - DNA, 333 bp, Homo sapiens
  misc_feature 333: n = A,T,C or G
ttttacgaatttcatctaaagtgtgtctggtatatctatgcatatgattcattttccatgttaccatgcacgctgactcttattgaaatagaccgctgggaggcagcatgatggagtgaaaatagcatgcacgttcaaatctgaaagatatgggtgcagacacctactattctgtgccatttggagaaagtcatccacctcctgtataggacttttcttggctttaaaatgaatagatgtcttgaggatattactggtctcaattaaatcaaaatttttgcaaaaaggtctgacactggccgggcgcggaggctcacgcctgtaatcccagcn

SEQ ID NO: 13373 - DNA, 459 bp, Homo sapiens
  misc_feature 11, 450: n = A,T,C or G
tgacggccttntgcagatcccctcgactcgaagtccggtgctgtcgggccaattctgctcaactgcttggtgaggctcgagttcagcctaatccatcagaacatgagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctatagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactanagactgtcc

SEQ ID NO: 13374 - DNA, 435 bp, Homo sapiens
tctcaatagacacttttatatagcagatgcctttatgagcatgcctgctctttcgggcgaagcggtctacgcttgcgagaaaacttatgaaggagaccctgctgtgtttttctgttgctcctcagtaactaaattttgcttcagatttctgcttttctaccatggggagcaagacaaggctttgctttgactgaatcccaacctggaaaaagccattatctccagcctcaacactgccacaagggggcataactgaatcagaggatatactctatctgagacaaggtatcaaagggatgccttccggtactactaactcaattcagttcattcatcatcagcatacatgtaattcatatatagcacaactgctcaggtacggaaaataatgctgacaagttggggttttttttttttttttttgaagagaaaacg

SEQ ID NO: 13375 - DNA, 434 bp, Homo sapiens
  misc_feature 133: n = A,T,C or G
ttttgcaggatcccactcgattcaattccgtggctgtcggcctgattaactgccacggtcacgaggagtctaaggacacatccaatttccattggcatgcaaaatggaatccgagacagaaagaggaccttanccttcatatctggttttttcttatgaagcttcttctggttggaaacttggcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgttaaaaatgcaaattct

SEQ ID NO: 13376 - DNA, 214 bp, Homo sapiens
  misc_feature 103: n = A,T,C or G
aaactctgttttaggataagtcactaatatagagatagctagttcaattgtgtctggcttcctatcacatcactagcacttagtacagaattggggtcctaanaatatttggcaatgatgacctgtgttgctttcaagaaagtattccaagtgatagggtccaccataatccatattgctttaactcttgtacaagtggacaaatttttctatt

SEQ ID NO: 13377 - DNA, 243 bp, Homo sapiens
  misc_feature 110: n = A,T,C or G
gctttcccgggcgctgattcctgagtgctgagcgcgaacccgaggagatgaaccctttaactaaggtgaagctgatcaacgagctgaatgaacgagaggtccagcttggngtagcgcgataaaggtgtctggcactccgagtacaaagacagcgcctggatctttctgggagggcttgcttatgaactgactgaaggggacatcatctgtgtgttctcacaatatggggagattggtaacatt

SEQ ID NO: 13378 - DNA, 426 bp, Homo sapiens
  misc_feature 22: n = A,T,C or G
atattctaattccgaagctggngggggggcaaaacaggtcattccatgtttgaaaggaagttgatgaaggagcctgggaaagcggggaattattcacagagagaaacgacagcagcgtaaacgtgataaggtgctgactgattctggttcattggattcaactatccctgggatagaaaataccatcacagttaccaccgagcaacttacaaccgcatcatttcctgttggttccaagaaaaatagaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagaggactccgttcac

SEQ ID NO: 13379 - DNA, 124 bp, Homo sapiens
atctgcctcccctgtctgtaaggagcagcgggaacggagcttcggagcctcctcattgaaggtggtggggctgccggatctgggctgtggggcccttgtgccacgctcttgaggaagcccatgc

SEQ ID NO: 13380 - DNA, 364 bp, Homo sapiens
gagcagactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttgtcttatttatgtttaattttaaaaaattcccactgggtgcagaggctcacgcctgtaatcccatcactttgggaggctgatgcaggcagatcacgaggtcaggagatcgagaccatcctggctaacacggtgaaaccccgtctgtactaa

SEQ ID NO: 13381 - DNA, 421 bp, Homo sapiens
  misc_feature 421: n = A,T,C or G
cgttgctgtcggcctgataaactgccacggccacgaggagtctaaggacacatccaatttccatgcgcatccaaaatggaatccgagacagaaagaggaccttagccttcatatctgtttttttcttatgaagcttcttctggttggaaacttgtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaacaccatgaaggaagttgttaaaaatgcaaattctcaggctctcccctgn

SEQ ID NO: 13382 - DNA, 424 bp, Homo sapiens
tttttgcgtatcccactcgattcaattccgttggggtcggtggtgccaaaagccaaggtcatttgcacatattccatcaacctgtcaagaatggggcctgagtttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttt

SEQ ID NO: 13383 - DNA, 414 bp, Homo sapiens
cgttgctgtcgaaaaatacaaaaattagctgggcgtggtggcacatgcctgtaattccagctacttgggaggcgaagcagaagaattgttcgagcccaggaggtggaggttgcaatgagccaagatcgtgctactgcactccagcctgggtgacagagccagactgtttcaaaaaaaaaaaaaaaaggtaaaaaaccttttttttttatttttttaaggggaaaagaaaccttttttttacctttcattttcctttcggaaaaattcatttaacaaaaagggggcccaaaatggccccaaccttttaaaccctttcaatttgggcaaggtttttaaaaaccaaaaaaaaagggaattggccctccaaaaaaaaaataaaataccccaaaaaggggggcatggtttaaaatattc

SEQ ID NO: 13384 - DNA, 415 bp, Homo sapiens
cgttgctgtcggaagaattcgcggccgcgcgacagcaacggtttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagt

SEQ ID NO: 13385 - DNA, 361 bp, Homo sapiens
  misc_feature 361: n = A,T,C or G
gagcagactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttgtcttatttatgtttaattttaaaaaattcccactgggtgcagtggctcacgcctgtaatcccagcactttgggaggctgaggcaggcagatcacgaggtcaggagatcgagaccatcctggctaacacggtgaaaccccgtctgtan

SEQ ID NO: 13386 - DNA, 386 bp, Homo sapiens
  misc_feature 314, 349: n = A,T,C or G
gggtaacctggagacattcagaaaatatctgtggaactcctgcattttgtgaggcactgcccacggcattggagagagagatgcctttgtggtggtcctaaaagagttcacagtctggccaggagacattgtacaaacagactataaatggctgtgcttcttttttttctaaagaatgttcagcgggagcacttgggacctacctgtgagagctgaggaaggcttcacagaagaggtcttgcttaagaggaaacatttggggccaggtgcagaggctaattttttgtattttcttcttagcagagatgcggtcnctcgcttttttcggaccattttcaacccttcactnaaagggtgctcctggagagggatctttttgtgccgtg

SEQ ID NO: 13387 - DNA, 386 bp, Homo sapiens
  misc_feature 215: n = A,T,C or G
agtgcagtgatacaatcatgattcactgcagcctcaacctcctaggttcaaactatcctctaacctcagcctcctgaggagctgagactacaggtatgtaccactatgcctggctgtttttttaattttttgtagagatggggtctcactatgttgcctaagctgttcttgaacacctgggctcaagtgatcctcctaccttggcctcctaaagngctggaattacaggcatgagcccttgtgcccagggtctggaattctttagagaaatccttcatctgtcttaatagaaaaccatgccttattaggttactcacctttatatcaaaatttttcctgggtgggtgcagacgctatatctttgggaacaagaagtcctttataaa

SEQ ID NO: 13388 - DNA, 385 bp, Homo sapiens
gggactcttgctaaaggccagccatggacttacacttacaaagcatcaccttatcaaaggtggaggaagatcaacttgatatcaagggtgaccagatttcagggaatagggattctcactaaactgactcccagaggtctcttttagcaaggcactcatgccaagcgcagtggctcatgcctgtaatcccaacactttgggaggctaaggcaggtggatcgtctgaggtctggagttcgagaccggcctggacaacatagtgaaacccagtctctactaataaaaaaaaaaaatgggccgtcacattggctcaggcctataatcccaacactttgggaggccgaggtgggtggatcacctgagggcaaaagtttgagacccgccc

SEQ ID NO: 13389 - DNA, 386 bp, Homo sapiens
tattaataatgctaaacacttaccagctttgtaactttagctatctatcaccattgagttgtttcctaatctataaaatggtggtaatccctcatacgactgtggaactgatgaaataatatggcatatgtaaacatttggttcaagacctgctacattggatgaggaatgtcaacagtaaagtaaaattttgatctttgagtgtgtagtgagcttgttatgtcactttctgtggattctatttgacactcataaagaaaaactctaggtttaaaaatggaactaggccaggcgcagtggctcacacctataaccccagcactttgggaggctgaggcaggcagatggcttgagcccaggagttcaagaccaacctgggaaacatg

SEQ ID NO: 13390 - DNA, 383 bp, Homo sapiens
tatttactacctggtcatttataaagaacagaaattgatttttcacagttctgcaggctggaaatccaagatgaagtcacctgtagttcagtgtctgcgtctaagagagtactttgttgctgcacccgccagagggaagaaatactgtatcttctcatgaaggaaggaaccgaaggtgggaatagggaccaaactccctctttcaagcctttttgtagtgacattaattcatttatgaggatgccaccatcatgacataatcatttcccaaaggatttcacctcctcccactgttgcattggggattaattttccaacacatgaattttgagggacacattcacaccatatgcactggtatatagtaactaggtggcccgatg

SEQ ID NO: 13391 - DNA, 410 bp, Homo sapiens
ctgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactggtagctcaggtattggag

SEQ ID NO: 13392 - DNA, 410 bp, Homo sapiens
  misc_feature 395: n = A,T,C or G
cgttgctgtcgaaaggacaaaaccctgactcccagtgagtctgaggccaaagctgaaaacagaacccaagaagcttaattcctgacctcagttccaatcaaacagcacgaattgtggtggacctccagctgtgctcagatggggggacacaatattggcagtaccctcttccttgccctccaggctgagtgccagtgtgggagcgtgctcatgagagccctgcacaagcgggttttgagcacatgctacgctctagccccgtggaagcctggactagttagaggcagagaacagctcaggacagacacctccctgcagagccaaacagagtgcagcgcctgcctcgctgggccatcctgagagctggggccttcccaggaaagagggagctcggngggcaccaccccatc

SEQ ID NO: 13393 - DNA, 416 bp, Homo sapiens
  misc_feature 416: n = A,T,C or G
tacggctgcgtgaattatacagaagggtgcaatgttttggagggggagaagtatttcacacacataagtatgattttccccaaccagaccacaagctcttcaaggttaacaacaccctagcccaaccccctccccctcagacaattcttctgctctcctagagcagactttgatctagattggatctaaattgactcgaaatgtcaggaagaagagattaatgcacatggtccctttctctgagagaaggagtgatagagcaaagcttaagcctgggagggagatgaagctgcccagcactctcttcaccccgtctggggcttcgaagggggacaggtggaacactagagacagctggctgcctggtcccgagctccatgtgaacagcctcctcccaaatcttcctttggatctgn

SEQ ID NO: 13394 - DNA, 382 bp, Homo sapiens
cgtctgtccatctgtcgtccctgccagcacagggggatggtcctggctctaggggctgcagaacacagcaaggcccagaggccagaggctgcaggcgggcctgagggtgaacttccccccgagaaagagtctctggaagagaatgaatggcccagcaggtagtgagaactctgtcactagggtatataagccgggatggacacagggaaggacatttctgcatcagtggtgggtccccatcagttaagagagcctgtgactctgtcgagggaccatggggggtggcaccagagcccagggcacctgagggcctgtctggatgcagctgctagtggtcataggacagcaaacactattcattggattctgacttaggcaggta

SEQ ID NO: 13395 - DNA, 382 bp, Homo sapiens
tgatccacccgcctcagcctcccaaagtgctgggactatagacatgagccaccaaacttggctagaaattttctcttttttcccttagacggagtcttgctctgtcacccaggctggagtgcagtggcggaatctcgactcactggaatctatgactcccaagatcaagagagtttcctacctaagactcacgagcaactgggattacagacgcctgacagcatcgcctggctaaagattatattaatggtcgagatgcgggaatatactgaaggttacgccggcgacaagactacttaatggggcggaggggagaatacgacttaaacggtcccgcttggacaagacgaggaaaagcctctatttgcgagaacaaaagaat

SEQ ID NO: 13396 - DNA, 411 bp, Homo sapiens
caataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgt

SEQ ID NO: 13397 - DNA, 412 bp, Homo sapiens
cgttgctgtcggaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctc

SEQ ID NO: 13398 - DNA, 373 bp, Homo sapiens
aaagcatcaaaaccttttctttaatcccaaagttactaaagtgatttaatacatttgataataccataatactgccattatctttaatctctctccaacttcctgccataaatcattttctcagagtggacctcaatttagggtagaattgctagttacatagatgatgtcaattgggaaatacaaaaaaattagccgggcgtggtggcaggtacctctagtcccagctactcgggaggctgaagcaggagaatggcgtgaacctgggaggccgagcttgcagtgagctgagatcgcgccattgcactccagcctgggcaacagagcgagactcccgtctcaaaatagatacctgatttctttttgacttcaa

SEQ ID NO: 13399 - DNA, 401 bp, Homo sapiens
cgttgctgtcgccagcaccctggcatgttaatagttgttgaaagatctctgaataagggagtgtggttggctctctcaattgcaataccaatgggaccaccacggttttatctggttaacagcttcacagatccagaattttatgtaatttgtctgtgtatccagaattgatcatattccggagtctgactcatggtaacccagctgtcagtagactgatgcgtaagccaggtgcaaatttgtttactttactattgaagtagatacccttccaatgactgaaatcccatatttaggataccccattcctgctatggaaatacttaggagactaaattgtgaatcaaagtttgtgactgtgaggccgagtgcagtggctcacacctgtaatcccagcactt

SEQ ID NO: 13400 - DNA, 374 bp, Homo sapiens
  misc_feature 294, 305, 306, 365: n = A,T,C or G
gcactccagcctgggcaacaagagcgaaactccatctcaaaaaaaaagaaaaatgaacaataaaataatggtgggctgttcgggtgagggtagtgggtactctggggctctgccagagagtaaggactgagaccctctttcaacatctgagttcctcttcatgaattgccctcagaagggtggccagggccgggcgcggtggctcacacctgtaatcccaacactaggaggccgaggtgggcggatcacaatgtcaggagatcgagaccatcctggctaacatggtgaaactcntgtttcactannaatacaaaaaataggccaggcgcagtggctcacgcctgtaatccagcacttttggaggnccgagcggg

SEQ ID NO: 13401 - DNA, 239 bp, Homo sapiens
  misc_feature 239: n = A,T,C or G
ctttataaaatgtctccatctttataacccaagacatctctctataatccaaagtttcattctcctttgaaatctcaacatatatattttcagaaggaaactacttgtaggtggtctgtcactattatctgtcataatttaacttctagacttgttgataagttcagattccaagttttagtacgatttactaaaaaaaaacctagcatgcagaaacaaaaatattttctctacagctn

SEQ ID NO: 13402 - DNA, 372 bp, Homo sapiens
  misc_feature 372: n = A,T,C or G
gttggacaagattttatgtagtctatgcagccacttggtaataaagaaagcagcaaaagtggtagtcagcaatttgggccaactatcttacttttctgctctcttccaacagctctgctagatgcaagtgacagaaaattaatgaactcttgcaggaattctatcccaacctctggaattcaagaatgtcctctattttggctagttagaattgttagagtcattctccatggaaaatgacttgattcatagttattctattattaagaaaacaatggctggctgggtgcggtggctcacgcctgtaatcccagcactttgggaggcagaggtgggcggatcacgaggtcaggagatcgagaccatcctggn

SEQ ID NO: 13403 - DNA, 399 bp, Homo sapiens
gccttctgttactttgtgtcccattagtacctgcctctatgccttaccattttgagcagatccttgagtgggatgatacgtgcaaaactgtgctttaggcagtttgttgttataggcacctgctctctactctgtttgctctcaacttagtaggtggagcagcaattttccttttttggtatatggaatattctggtaacttttttgcaactttaagaaatttcaagccaggtgcagtggctcacatctgtaatcccagcactttgggaggccgaggcaggtggatcacctgaggtcaggagttcaagaccagcctggccaacatggtgaaaccccatccctactaaatacaaaaaaaattagctgggcgtggtggcacattcctgtaatcccagctac

SEQ ID NO: 13404 - DNA, 208 bp, Homo sapiens
tccctgaagtcatggactgtgccagtcttgtccactcctgtgtccccaggtcctgtcacaaggcctggcatgtggtagatttaaagtggattcgttattgcgcacacagctgttcactcctgattttccagtacctcttctgtgtcaggagctcttttatgtaaagcttgagatcacaggaacccgctggttaacagggttgtatccc

SEQ ID NO: 13405 - DNA, 372 bp, Homo sapiens
actgtacaccagtggttctcttcaccaactataatgcctaattttcccgttaatttcctacttctggttactgtaaacaaagtaaatccctcattccctacagctgggccacaaaacccaggatagacccttgtaatctctgtgatccctggatgttcacatgagctcttgactgatgcccacttcctgcatgttggtcaacattttacctggatcctttggaaggaagggaaacaaaaaggatcagcaatatgaacctcttaatttgagtaaatgctaatcaaacccaataacaggccgggcatggtggttcacgcctgtaatcccaacactttgtgaggctgaggtgggtggatcacccgaggtcaggag

SEQ ID NO: 13406 - DNA, 371 bp, Homo sapiens
ggattgtgcctgcactgaataaaaacaagcagctccaacttctcagggctgctctctggccactagagccaggcagtcacctagctgctgttatgctgcatacctgtctctgagtactcgcttcatccatcggccagggtctgtgggacagaccaggcaggtggtgccccatgtgaggaacgctgcaatggattgcaagggaacccctgaaaacaaatgtgaagcgactgagcattgttatccttataacaccaggacctaatgagctatagcgcctcggatggtattctttcgtcctcacactttgaatgctttttgtcccctccccccatcaaaaaccagggggtggggtctctcaccagctcgccccg

SEQ ID NO: 13407 - DNA, 402 bp, Homo sapiens
ggcacgagaaaaagagagataatctctaaaattttgtgagttttctgatacttaactgtcaaaatacagcagatatctcaagtttcctcagttgtaaaatggacttattgaaacttgcagagtttttctacaaatttaaaatatcttatgtgtacagaaagggaaaaatagtaacattaccagggagaaacccagtaaacatcactttaggcaagtgatcaaagttgacatcacctgtaataaaacctatcaatatcatgtgcccccaaatatggtttgaggaggtagccatgtcacatctgtgacagtcttcccctaaatccataacctcagtctaatcatgtgaaaaatatcagagaaacccacatttagggtcattctacaaaaacctgacgagtactt

SEQ ID NO: 13408 - DNA, 405 bp, Homo sapiens
cgttgctgtcgcaaactttgggtttatttataacgaaacacaggagaaggtttcagcagttgccccgagctgttttgtgcgtaatgaagtggctctttgattaaggagctctatttcttatttaactgatatcccactgccccactccacagaataggaaaatgaacaaatctttctctctgacttgtttacatcatttcacggaaacacatctttgtttgcaatgcagtattctttctctgtgctcgacagagatggggaggggcacacgaacttaagaggctctagaacaaacgctatgctgattatgacttggttccacttctcgcacagtgctagtcttaagtgtctaccacacctaaaggtaaaacccccctccttttagcctaaggggagggggggacg

SEQ ID NO: 13409 - DNA, 398 bp, Homo sapiens
  misc_feature 398: n = A,T,C or G
ggcacgaggaaccttgctacaggtagaagggatgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccan

SEQ ID NO: 13410 - DNA, 402 bp, Homo sapiens
ggcacgaggttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgag

SEQ ID NO: 13411 - DNA, 399 bp, Homo sapiens
  misc_feature 399: n = A,T,C or G
cgttgctgtcggtaagctaacaaacaatcgaggcacatacacacacacacatatatatattttttccttcaatgcaatgaatattttattgagcatcttatgtgggcaaggcactctatttgtgaaaaattcaaaagatcacctgcccttaggaatcctctggtcaactgtacgagaagaaggaagggggcaaggtgagacaagtaagcaaataattatggacttgacttctgggcagaagctatcacagctacatttgttaattgctcagttaagtgacctttgaaatgttctatagccatgtctccattaagaatatgaaatacggccgggcgcggtggctcacgcctgtaatcccagcactttgggaccccgagggaggtggatcatttgaggtcn

SEQ ID NO: 13412 - DNA, 317 bp, Homo sapiens
cagagtttgcagtgagctgagatcgcaccactgcactccagcctgggcaacagagcgagacgtcgccaaattaaaaaaaccaaaaaaaaaagggggggggcctttttcttttttttccccaacttggaaaaatctttttttgtgtggggcccccccccccctggagggggggggaaaaaaccccttttttggaaaattttgggccccttttttttttgggggacccattaaatcccccaaaaaaaaagtaaaacacccccttggtttttttttttatttccgggccggggggggggggggggggttgttttccaccc

SEQ ID NO: 13413 - DNA, 406 bp, Homo sapiens
gccgttgctgtcggcctgtaatcccatttacttgggaggctgaggcaggagaatcgcttgagcccgggaggcggaggttgcagtgagctgacatcgtgccactgcactctagtctgggtgacagagcaagactccatctcaaaaaaaaaaaaaaaaaaattttggaaacctaggggtttaaaaaaaaacaaaaacatttttcattttggggggtggaacccccaaaaaaaacccccatttaaagccaccctttttttaagggggaaggtcccaaaaaaaaggtgggcccccgcccttgtaccggataaaactcccaaaagcccccccaaaaaacatccccttggggggggggacttaacccggggggttttgggggagaatggttaagccccaaaagggggcctaa

SEQ ID NO: 13414 - DNA, 398 bp, Homo sapiens
cgttgctgtcgggccccaggtggggagatgactccaggaggggacctgccaaggacctgggcagccagccacgtgttctgtgccctgccactgccagctccaaactcacagtgtcatggtggtgggttgttgggaaaacgtcctctgctcatacttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagc

SEQ ID NO: 13415 - DNA, 402 bp, Homo sapiens
ggcacgagcacagtatgaactactgctgatgtctctgttggggatcagagggctggcgggaacgcgagaagggcaccagcagcattccacacccagctcttcctcaccttcctgtctagtttgaatttcttttttttctttttcttttttttttttttaaattaaaaaggaaaaagggggggtggggaaaaaacctaaaccaaaaaaggggcataagggctaaaaccacccccagaaaggggcccttgtttgggggaacaagggctttgttaaccccccttgttttggttttgcacaaggtgggccctgcttaattttcaggggcctatgccccatttttggccctggggggctcggggctaaggctccacagggctgaaagtcccctgccaggttttaggg

SEQ ID NO: 13416 - DNA, 406 bp, Homo sapiens
ggcacgagccccaccctgctgccttatttgtacccagggctttgacacaaacccagtgctttgcttatgggtgctcgctggggtccggtggagactgaccaccctgcttgagccaaagacaaggtgatgagagatggggagaggccattggctcccagagggaacagcgctggctgtggctagagaacagcaggtctgtgcagtgtctgagggcaggttgggaagggtagcagagagagagagacagaaagagagagagagagagagagagagagagagagagagagagagactctcagagtggaatgggggggacgcatctagacacattggctagtcacgcatgaaggagggagaagtacaggggatattataatggttttccccgggggagccttaggaatcg

SEQ ID NO: 13417 - DNA, 372 bp, Homo sapiens
  misc_feature 341: n = A,T,C or G
gccggctctgccttttaactgcttttcactggtctgaggtgtatctgtataaatgggagtcatagggttgttgagattaaaaacaaaaatactcgcttgtaaaaacacagtgctgggcctacactaaatgtcccagaaatgtccttcctttgcttccttccactgggggggtctatatcatgagcccagtggtatggtatacccagggccaccctcctgtcttcctgcttgtccacccagagccggcttcttccatggcaggacctgcaaatgctggactcacagaaggctctgagaagtaaataacaggtgaggctgggggtgccttcttatttcttggngttgtccccagtctgttaagagacagtctaa

SEQ ID NO: 13418 - DNA, 401 bp, Homo sapiens
acccatcgattcgaattccgctgctgtcgaggaaatggtaaatgtatatactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttggtggagaaacacaaagcaggactttcccagtataatcacagcaactctctagaggagcagatcttgcaagaccatgagtaaaaccctcaaggacggttccctttcg

SEQ ID NO: 13419 - DNA, 398 bp, Homo sapiens
ggcacgaggagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcaaagaag

SEQ ID NO: 13420 - DNA, 368 bp, Homo sapiens
ccaggctggtcttgaactcctgacctcaggttatctgcccaccttggcctcccaaagtgctgggattacaggtgtgagccactgcacccagcctcctttactgttctttaatttttaaaatgtactggagttttctcttccatgtaaatgttagaatcagcttaagttgtattaaaaatacctcattgggattttgtttgggattacattttaattgtagatttaaactttcctatgtaaccaacgtaatgtgggccctgttttggtgttttttataccttgaagcgattatagcttaatctttccggcccgtcactgtgggttactctctgtattggcaattatatttttttttctaatgaaaaaag

SEQ ID NO: 13421 - DNA, 369 bp, Homo sapiens
atactgaaggtaatagggcaggctggttccatcagggctgagaggcctgctgaagatccttccacaagagctgttccttgagtctgtgtagacagttggaaattaaagtgagagaggagaaggaataatgaaggaggctgccatttaaaaatgtcttgcctgaaaactaggccgggagcggtggctcacgcctgtaatcccaacattttgggaggccgaggcgggcggatcacttgaggtcaggagtcgagaccagcctggccaacatggcgaaaccccgtctttactaaaaatacaaaaattagcaggacgtggcacacatctgtaatcccagctactcaggaagctgaggcatgagagtccgttgaa

SEQ ID NO: 13422 - DNA, 364 bp, Homo sapiens
agagaggtgaggacagagacagctttattcagcagggaccgcagaggccccggagggcttcgtccagggagctggggagagaggaggagtcagagacaggagagacagacagagatggagagaaatggggggagagacagagacagaaatgggggtagagacagagacagagagaaatggtgggagagaggcagagagaagtgggggacagtcagagatagaaatggggaagagacagagatagaagtgggggagaggcagagacagagagaagtataggagagacagagatagaagtggagacagagacagagaagtgggggagagagagatagaaatgggggacagacagaagtttttatag

SEQ ID NO: 13423 - DNA, 363 bp, Homo sapiens
  misc_feature 363: n = A,T,C or G
attagtgttatgaaacgaagcatcacactgctgcacacataggaggcatcttgtcgttcttatgctattgaccaaagaaggttctcttctcttgtataggccattctatttggccacggcaagatgtctattaattatatgagcaaggataggaaaccctcccagcccaccgtggcagacaatttagccctgcggatcaatgggataacagatgtctcagcctgaactctttcacagcagagcatttttccattcttgttgtggacttcagtgtgagcactgtgagagcaggaactgagtcttattcgtctttgggtcactagcacagaggctagcatttggatggaggtcactgctcttatn

SEQ ID NO: 13424 - DNA, 343 bp, Homo sapiens
tctactgaaaatacaaaaatttgccaggtgtggtagtgcacgcatgtagtcctagctactcgggaggctgaggcaagagagtcacttgaacccgggaggcagaggttgcagtgaactgagattgtgccactgcactccagcctggccaggtgacagagcatgacttcttctcaaaaaaaaaaaagaaaggaactataaaattggggggggggggggaggtgaccccgcggggggccacttagggggtttaagaggtttcctttgggggaagggaacttaatttaatttttgaggggaaaatgagaagcccagggggtccgcccagaacgggtaaaaattgggt

SEQ ID NO: 13425 - DNA, 147 bp, Homo sapiens
  misc_feature 97, 147: n = A,T,C or G
cctaattgacgtttatacttaaaattcagagtacattacaaggacttctggttgttgagcttttaagaattatacagcagaatctttttcatctggntttatgagttgctgcaataggataaagctattgtaaattaatgggaactn

SEQ ID NO: 13426 - DNA, 285 bp, Homo sapiens
  misc_feature 285: n = A,T,C or G
gaccatacatcattttccattctgggacagaggaagaagacgggtgggggagttgatctggctagcccagagctggacagtgccattctattcttccctcccacttgtctacacggtggttattactacttgctctgctgcccaggctggagtgcagtggtgcgatctcggctcactgcaacctctgcttcccagcttcaagcaattcttctgcctcaggctcccaagtagcaggcattacaggcgcctgccaccacgcccagctaattttctgtatttgtggtn

SEQ ID NO: 13427 - DNA, 389 bp, Homo sapiens
  misc_feature 311: n = A,T,C or G
tacggctgctagaagactacagaaaggttctagagcacgcaacctagatccctcacatgtgcagttcacaatagggttcacactcctatgacaacctaatgctgccgctgatctcacaggaggcggaactcaggtgggtaatgctcgctggcccaccgttcgcatcctgttgcacagtccagttcctaacaggccacggaccagctgaggacccctgctctagagaatcgccaaatgtgagggtggtcatgaaagtttcaaacaggtgttaaaggcaaagcgatatactagaatcatcactgcatttttanagagcactattaggaagagctctcatctttctctcttgatcaaagtgcctttgaaacaaagagacttgcatctagaag

SEQ ID NO: 13428 - DNA, 391 bp, Homo sapiens
ggcacgaggtcacccaggctgttttgttttggcgtgatctgcaacctctgccccccggggtcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggtctcacaaagtgctgggattacaggcgtgagccaccttgcccagcccacatcatacagtttgaaatgaaactttgccacaaccagcctttgctgtagcacacacatatatcactgaacctgtttgaaataaaggattttttgtttttcatgactcggctttgagtacctccacgccg

SEQ ID NO: 13429 - DNA, 361 bp, Homo sapiens
gtgctctgtgacccgagctagaaggcagtggcatgacctgactataggtcactgcagcctctaactcccgggctcaaacaaatctctcgcctcagcctcccaagtagctgggaatacaggtgtgagccactgtgtccagcccttaacttctcctttttatcagagtgtaaccaaaggtgtcctgaacactgagccctccagggtctcctctcatttcctcctgggctcgcttgcataccacggttgcaagcataccatgtctgatgggagggcccagaggtgaccatgctggaagggacaccagggctctgcagggtcttagtgtcagaggtcactgactttcttaagcacctggcatctg

SEQ ID NO: 13430 - DNA, 394 bp, Homo sapiens
cgttgctgtcgggcacgggaaaataaatagtctttcgcgtgtggcagggtaaccttgtgctcagggaggtccgggaacctggacgatttcagtctgtcctgctcccctccccatgacacatacagcggcactcgtgcgctcaccatagaccggcggtcatatccgcacacagccacggccctcgaggtgcagtgcgaggcctcaggtggcagagggcacacccctggcagctctatttatttattgagacggagtttcactcttgtcgcccaggctgtagtgtagtggtgcgatctcggctcactgcagcctctgcctcccaggttcaagcgattcttccgccttagcctcctgaatagctgggactacaggcatgcaccaccacacccggctg

SEQ ID NO: 13431 - DNA, 391 bp, Homo sapiens
ggcacgagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggaaagtgaggcccacaaattacctgcagagacgtggaggcgtgagggagaacatg

SEQ ID NO: 13432 - DNA, 366 bp, Homo sapiens
taagtgaccatttcttcactcctggttttccaattgttttgacactgacattcaattaggaggactaaatacacagtggtgatgatggtggtgattatatcattttatgatcaacaccttcttcactgtttgcttctcccaatattacttatgagacaggaacttactttttcttatggccctcaacaccccccagttgctcctagaaccctatctcttttctgatcccattacacaattttgaggttttcgttcccccccttatactttgttttcctgcgatttttgagggacctggggttttttctacctctcctttttctcttaaattttttctttctaacttagacctcccttccctttttg

SEQ ID NO: 13433 - DNA, 394 bp, Homo sapiens
cgttgctgtcgggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacaca

SEQ ID NO: 13434 - DNA, 368 bp, Homo sapiens
cgtctgtccatctgtcgtccctgccagcacagggggatggtcctggctctaggggctgcagaacacagcaaggcccagaggccagaggctgcaggcgggcctgagggtgaacttccccccgagaaagagtctctggaagagaatgaatggcccagcaggtagtgagaactctgtcactagggtatataagccgggatggacacagggaaggacatttctgcatcagtggtgggtccccatcagttaagagagcctgtgactctgtcgagggaccatggggggtggcaccagagcccagggcacctgagggcctgtctggatgcagctgctagtggtcataggacagcaaacactattcattggattct

SEQ ID NO: 13435 - DNA, 397 bp, Homo sapiens
cgttgctgtcgcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggagaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttaaagctatggcgaatcttccctgttggggatccttgaacctggtttgagttttccc

SEQ ID NO: 13436 - DNA, 314 bp, Homo sapiens
tccagtttaaaggaacatgggccgggcgcggtggctcatgcctgtaatctcagcactttgggaggccgaggagggaggaccacctgactttagaagatgaagaacaacctgtgcatcatgttgctgaacctgatctagaaaatggtggtaccacagcctccggcttagaacatgaaaagaagtgtgcagacttaccccttacggactctttatgagtttgttcccccctttggagacttcccctcgctgccttttctgcgtattataccccccaacatcttgggtgggtcccctcgctgaccttaaaaattaaa

SEQ ID NO: 13437 - DNA, 396 bp, Homo sapiens
cggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatg

SEQ ID NO: 13438 - DNA, 397 bp, Homo sapiens
cgttgctgtcgggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagtt

SEQ ID NO: 13439 - DNA, 183 bp, Homo sapiens
ctggtacgggtcggataatcttcgtaatggtgccggtgtgcctcgcttattaagttgatcgcttgtggaactatttccttgggagcgtgtgcgaatcccctgcgttttttttttgaatgacgtccattttttttcgtgaatgaagtgtcgttcttctttttcgttgtgctgtttctcatggcg

SEQ ID NO: 13440 - DNA, 389 bp, Homo sapiens
cgttgctgtcggcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtgtcactgggtgccagcaactcggtatctcccacctcccactaaaacctgggccttaatttctctcccgtccccacccctaaattcctgatggatgaacctagagctgtcctgtccactccaggccggactgacgtagcctatgggcccagcagg

SEQ ID NO: 13441 - DNA, 396 bp, Homo sapiens
cgttgctgtcggcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgctgatacacatgcacacacacatacacacactggcccctgtttttctgtggtgtcactgggtgccagcaactcggtatctcccacctcccactaaaacctgggccttaatttctctcccgtccccacccctaaattgctgatggatgaacctagagctgtcctgtgcactccaggccggactgacgtagcctatgggcccagcaggtccaggt

SEQ ID NO: 13442 - DNA, 328 bp, Homo sapiens
  misc_feature 187, 188, 189, 190, 191, 193: n = A,T,C or G
aaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcnnnnnanaaaaaaaaaaaaaaaaaaaggggggggggttttttccggaaaccccaactggaaaaaaaccttggggggggtgggcaaacccccctttaaagggggggaaaaaaagggttttttttggaaaatttggggccccta

SEQ ID NO: 13443 - DNA, 358 bp, Homo sapiens
gcaggttgtacagaaagccaactaaggatgatcaaaaactttcagatgatcttgactgttcagttgaggtttgaaattaaaaatctatatgagcacctgactgtataattatgtaattttttttccagtaatataaagagccaaggaaagcaggtgggtaggtggatccaagattgagaatttgttggtgggctgtgcctgcaagtcaaagaactgtccttcaagccaagagttctggaggtcattcaatgggaaggctgaaggtcagatgctttgttaagactgaagcttggtcgggcacagtggctcacacttgtaatcccagcactttgggaggctgaggcaggtggatcacttg

SEQ ID NO: 13444 - DNA, 300 bp, Homo sapiens
acaagggaactgggcaatgccttggtgaaattcaaacactagaattgatccctgaagagacagaaaccctaagcacaccatgaaaccaccggagaaagggaaaacgggttgagagatctactattttgaaaagtcaggcctggcgcggtggctcacgcctgtaatcccagcactttgggaggcgaagggagaatggcgtgaacccaggaggtggagcttacagtgagccgagatcaccccactgcactccagcctgggcagcagagtgagactccatcttaaaaaaaaaaaggaaaagaa

SEQ ID NO: 13445 - DNA, 302 bp, Homo sapiens
tagtagagacggggtttcactatgttggccaggctgctctccaactcctgacttcatgtgatctgcctgccttggcctcccaaagtgcagggattacaggcgtgagccactgtgcctggtcttctcatttgcttttatttgtacatcaattttagcatgtattgctattagccttagatcataagtaattacaattatgtgtgtctatatcattgcatagttgcatttgcctgtttctcttacagattgtggcacactaggcatttttatttcccataaatcctagcacagagacttgtacg

SEQ ID NO: 13446 - DNA, 325 bp, Homo sapiens
ctctccttgactgtaaaggcaatatcttagagtactttgtatctccagcacatagcaaattgctttgctagagtaggttttaacatatgtttttgggtaatggtggcgatgatgcaataaaggacagccgttattcaatttactctgtggcactaaggcaacttgaaaactctctgttgtaacctgacatagagctttgcatatagtaggaactcagcacatgtttggtagattttaagcaattattttttttctgtttggattagtctgttctcacaccgctgtgaagaaatacccaagactgggtaatttataaagaaaagaa

SEQ ID NO: 13447 - DNA, 353 bp, Homo sapiens
atatcaaatggatgtgccggaaggcagggtgcggcagaggcaagtcagatcagcttctgccactactgattgtgtgactttgaacaaataagcctgtttccttaatgttaaagaagaaataccaatagtgtccaggtcatggtggcggcatgataattaaataatatgtgtaaggctccaggcagtcctttaccttacttttcctgaccagtaggaaatgttcaataataattaacggcaatttttctcactttgtcacaatgattcttatgaattatctagatgagaaggtagagctgaggtcatctttcccagtgtgacattcaaactcttttcacaatacttagagacac

SEQ ID NO: 13448 - DNA, 329 bp, Homo sapiens
  misc_feature 317, 329: n = A,T,C or G
attgtgttctgaaaggaaccaaggttccccagtaggctcaattccaagtagctttccccccaccactctgtggctctttattatttaggactgtgctttttaagctcccgttttcttaggggcattatcacaccagagtttcactgctgtccagagtttacctctgcatgaatgtctctaggctgattgctctctgctgagtactaacgaaggaaatccaacattcatgttctactttgggctttctgatgacacaggagcctggcttgtattcagtacacatatattgatgttatgtgacttgactaggccataanaacgataaatan

SEQ ID NO: 13449 - DNA, 353 bp, Homo sapiens
ccgggttactcatcccatcctatgtcttctgaagtacccctgcaatccctaatgcctaatctctgtttgtctggctgcctacggaatgaggacaagctgaaagtctggcctctcagttttgtctcccactgcctgactacttttctattctcaacccagtccaccttcacatacccccagttgtgagtcggtcaggaggatgtttctggtcaatgagatgtacaaccggggacagtattagcggagccatggaagaaatggaatttcacgcgtgaatattttgacaaacatggccatgatttaagaactggcgggatttttctgggcccccaggtgatattatttggcccgaa

SEQ ID NO: 13450 - DNA, 356 bp, Homo sapiens
gaggaaaatacttttctctagcatcgtaggaggaagaaaacaaacacatcagatattttcagcactaaaagagatggttttccccacatatatgtaaaagaaatttgcaagactactggattttgatctcatggttgcagtgggtgaataggtggccttttgtgatctccttcatcaccctggaagtgagacttcttcggtttcttctagagtcagtttggtatcagaatggcaaagcaacttaaccttccagaaaatacagatgattggacaaaagaggatgtaaatcagtggttagaaagtcataagattgaccaaaaacacagggaaattttgactgaacaagacgtgaatgg

SEQ ID NO: 13451 - DNA, 352 bp, Homo sapiens
aattagttggtgaggaactaattataaagactattccaggtgctttagggttcagccacaacctatgataaggaatacctattataagtgggtgcttgtaatagatattaccatattatctatgcactcactttaatactcattgttctgggctccacctgatattatgatatgaatctttttagctatactctgatccagaagatcacatgattagcatcaatttctaaggacagtaataaacttgatagttctgagcaaatacatacactacagaatagtcattcaacaaatatttattgcctgcctactatgtagtctatatatacctatatgtaacacacatgcaaag

SEQ ID NO: 13452 - DNA, 384 bp, Homo sapiens
  misc_feature 384: n = A,T,C or G
cgttgctgtcgggggagtggatgctgctgaattgtgattaattgggggagccatataggtacatttggcatgatctgggcctatgcggtcttacaatccctgtataaaactagacaatgaaaaacagaaaacaaaacaaacaaacaaaaaaacaagaacgaagcacctaccacatgccagctactgaggctatgaaggtattctccggccttagaaagcccaggattaatgcaggattgcgatatttaaacagaacatttccatacagcatgagtataaatgactttcccaagtttacactgagagtaactgacacagcaaccccagcaaagtctgagctgagtcctgaataattgtataaaaaggggagagaaacagagtgan

SEQ ID NO: 13453 - DNA, 328 bp, Homo sapiens
gaagcctccccaggcccaaagactgggttagagcttctccctcctggtgcaatgcttcattaattacataaccaagtctattatacacaaagtgtaacctcccactagagtgggagttcctcaagggacttaaggtactcatcttcgttagcctagcacggtgctcagaaaacggtaagaataaaataggtatttactactcaggacatagtacagagttattgtatatttattgaactgaattgagctgtctagtttgccctttaaaaccaggtgttttagtatttggaaatatggacaatgatacctttggtgttccttaaattca

SEQ ID NO: 13454 - DNA, 356 bp, Homo sapiens
  misc_feature 146, 153, 154, 161, 162, 164: n = A,T,C or G
gtatatgatgttatgttatgttatgttatgttatgttattgttacagaattctaaatggtgacatagaaattatttcccttgagtatagtacatattgctgctaaataatagaacttgcctgattggtatggggggtggggtttgngaattanngataagnnanaattatgggacattgtagaatttttattgttttcaaattaatgcaaaataatgactagccctgtattgttgagacacagtcccttaggaggtttgctttaatgaacagataagaatcactggtgggcgggcgcagcggcttacgtttgtaatcccagctctttgggaggccgagtggggcagaacaccttga

SEQ ID NO: 13455 - DNA, 352 bp, Homo sapiens
gatcgcgccactgcactccagcctgggcgacagagtgagactctgtctcaacaccaccaccaccaccaacaaattacttgtcgtttgaagccacccagtttgttgtggcagccctaggaaacggaaacccacaggtgtgtttcctaggagactgtgagtttcacgagctccatcctccctcccctatgccagatggccaagttttctgcttggcgcatctcctgagcctagcactgaggtgtccctcaggaactgtgcccatagactagtctacagattgtgaagtagaaacaggtcccccatgccaggcgcggtggctcacgcctgtaatcccagcactttgggaggccga

SEQ ID NO: 13456 - DNA, 356 bp, Homo sapiens
taatgaaaaaagtgtttttaaattagcattttcaatggttttcagtctctgttaagcactgaccaagataagatgaggtgaggttgcagcaaattaacttgtattgcaggcataacacagaaaatctaggcctaaagaaaattagacactgagaaaagtagcggaaactgggaaatactcgtctttggaaaacactcctggtggggtagaatttctggaatacttttggatgtttcctttctggttccaaggactagattaagtggcctctgagtgagcaggttgggggcagagcctaaaccggggctgggtctatgttatctgtgtacaagcagagcagtggggtgaggagaata

SEQ ID NO: 13457 - DNA, 355 bp, Homo sapiens
  misc_feature 219: n = A,T,C or G
ctggggttaagcggaaaattaaaaattcagaacaaccatagtctgttatctgtcacctgtaatttaggctaatatctcaattctcttgttatggacatttctcttacagtgtgtctttacataatgggtattggatgtaatgtgatcaattaattagagcatatgatttacattagtcaaacctgtattgattacaaaatgactatgatctgaaagtanccttgcgtgtgtgtgtgtgtgtgtgtgtgtgcgtgtgtgtgtgatataagaggagatcctgctttgtatgtggccaacttggggagggggatggaattttcactatattactgcgacgtgagcacacacctacggt

SEQ ID NO: 13458 - DNA, 358 bp, Homo sapiens
ttctcctgactcagcctcccgagtagctgggactataggcacccaccatcacgcctggctaatttttttttttttgaatttttaagaaaaaagggggtttcaccgggttacccaggagggtctaaatcccctgacctcatgatccaccctctttagcctcccaaactgcggggattacaggggggagccaccgggcctggcccaccaggagctatttcatagggctctgggggccggggggttttttggaaaggggggttctttgatttacttggaaaatctcacccttcaaagcggggtttaaaaaccaccccactggaattggaaaaaattttttgaagggccttttcgaaccctc

SEQ ID NO: 13459 - DNA, 301 bp, Homo sapiens
acaagggaactgggcaatgccttggtgaaattcaaacactagaattgatccctgaagagacagaaaccctaagcacaccatgaaaccaccggagaaagggaaaacgggttgagagatctactattttgaaaagtcaggcctggcgcggtggctcacgcctgtaatcccagcactttgggaggcgaaaggagaatggcgtgaacccatgaggtggagcttacagggagccgagatcaccccactgcactccaacctgggcagcagagtgagactccatctcacaaaaaaaaagaaaagaaag

SEQ ID NO: 13460 - DNA, 386 bp, Homo sapiens
cgttgctgtcgctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttaatagcctgcttttttttttttttttttaaaagctatggggattctcccctgtggggaacccttgacccggattggggtttcccctcctttgggaaaattataatccaaaagccttttttttttgtttaaattacggaggggcatcccctaaaggagtcgcctggccctcggggggaataacaaaggaa

SEQ ID NO: 13461 - DNA, 386 bp, Homo sapiens
  misc_feature 174: n = A,T,C or G
cgttgctgtcgaaattgtatggagaatggtatttaaaaagtgtttggagactttgcagctgtcctataaaatgttgaagtgtgtatgtgatctacgtagaaagaatattaaagagtaggtggagctctttataggcgagtacagccttaaatatgcttgtatagcatccactgncagaagtaatagttgtgcctcagacttgggggttgcatgtcgccctgggggagttactacccttggtatgcatgagcgggtcctattagcatcagggggaactcaatactgtgtacgtatccacaaaagggatcttgacacccacaggtattcttaatttctgatattaacaaccgtacatactgctggaacttaaactaagaacatttagg

SEQ ID NO: 13462 - DNA, 356 bp, Homo sapiens
  misc_feature 356: n = A,T,C or G
aaaggtcaagctgtgctatcactgttaccctagttttgggcttattggatgtgtccatagtgaagccaactccaggcctgacacccaggtttgactcgagggtcttcatgatccctggtctgtgcactcctgccacaggagagcggatttataacaaaagctggcagggtgcagtgactcacacctgtaatcccagcactttgggaggctgaggcgggtgatcacctgaggtcaggagtttcagaccagcctgaccaacatggtgaaaccctgtctctactaaaaatacaaaaattagctgggcatgttggtgggtgccagtaatcccagctactcgggagggaggctgaggcaan

SEQ ID NO: 13463 - DNA, 357 bp, Homo sapiens
tgtcacccaagctggagtgcaatggtgcgatctcagctcactgcaacgtctgcctcccaggttcaagcgattctggggaggggaggaggagggaagcaaggagagaggaacgcagggagcagagcctgacctggtcacgggggtctgggaaagacagaggcttttgttagagccggcagctgagggccgaggccgagcaggggttaggccagcacaggacgaaaaggaagaaagttccaggtggagtctggtggagaaagaccgacctggaaggcaccagcatgtgcacgtggcaactgaggtcgaggacgtgcctgagaaagaggaggaaggtgccctgcggaccgggtagggtgc

SEQ ID NO: 13464 - DNA, 357 bp, Homo sapiens
ttgaacctgggaggtggaggttgcggtgagccaaaatcacaccactgcactccagcctgggtgacagagcaagacttcgtacaaaaaaaaaaaacctagaaggttaaaatttttgttattttgacccaaagggaaaaaactagtttttagggtgggcgctgcctgtgaaaactgcttttcttaaaaggccaagttttccacactgttgaactttgacttgccaaacatgtcagcaggtctttcagctttcaggaaaaaaggaaggggagttccttggccagttgcctttttgtctgtttaccaaaggctcgggtattaacccagttttttgcaggccacaggagacagccggttgtg

SEQ ID NO: 13465 - DNA, 357 bp, Homo sapiens
aggtgcccgtgtgtgtctacagagaggccaagcctggaacaggcgcctgtgtgtgtacagaggcagctggaaaccaagttacgtgaaagcctccaccagttaccctggggctcctggccagacgaggtttctgcagggaggacagactgaagctcaaatgggcagtagtgaaggcggtctccattgcggccaggctcaggccaccgcccagcaggagggaaggtgctggaagcttacgtgcccgtggacactggaggcttatgcacctggaccccagtgccatccaggtcttctctgtgggccaagggtgaaagaggcttcttgaaggctgagggagtcccagtgacggcctgagac

SEQ ID NO: 13466 - DNA, 357 bp, Homo sapiens
atactactcttgaaattatcttctaaacaagttgatacattaggctatctgggaataatatgaagatacttgatttaattccaaaaaaagcacaattggttgactcacaattctggtactttagttaaacggttttgttcttatcttggcctgatgagataccataatttacacgaatattatctaaactaaactttttaatccagtatattagtgcgaactattcttttttttttttttgggatgggggcttgcttttgacctccagctgggtgggcaggggcgtattttggcctattgtgcgcccccccctccggggtaaaagaaattttccgcccctaacccccgaagaaacgg

SEQ ID NO: 13467 - DNA, 352 bp, Homo sapiens
  misc_feature 352: n = A,T,C or G
aaaatgaaatctctcagaacctgatggtatttggatagcatatacccaccagaggaacaggcttttatctagcataccacaggtctcccctttagcacatctgtgctcattttgaaactgtatagggaaggacattagatggctgggagaactctgaaggacagacctggatctcctgccatcttccaaaggtgaaacaacaaaaatccgccaggctttcagtcagaagcccggaagggccactcccaaggaacagaggcaagagcagaagtagatggagtcttactgaaactgaaacccagctcaattcctaataggttgaagatatgattacctcaatgcagtctgcttn

SEQ ID NO: 13468 - DNA, 353 bp, Homo sapiens
gaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccggggggctatggatgatgatgacttcagaaggggtcacccccaacaagattatttaataatagatgaccatgctaaaggccatggcagtaaaatggaaaagggccttcaaaaaaagaagataacaccagggaact

SEQ ID NO: 13469 - DNA, 353 bp, Homo sapiens
  misc_feature 312: n = A,T,C or G
atagaagaaactaattaagagatggaaattcttgatttcttgttgaaatattataccaatttcctttttttccttgatatatgcaaaaccaagcctcatctcgagtatggctaatttaatcaatagtgggtatttctttatccaacatgttcttaaaaataatatacttgcatgaccacatgcacagaatatttgggatcaaatttcaattcaatacagtctcagagtaagtataacagaaaacctgttccttgacctataaggtattgaatagggattagtatctaaacttttgtagtttgaaagactcanacataagttcgccaattcaacaaagatatatgattccatac

SEQ ID NO: 13470 - DNA, 329 bp, Homo sapiens
atcacttgaaacaagaaaacggagggctcagtgtgccaaaagaacaccgttgcactccagcctgggcaacaagaacgaagctccatcgcttagaaaaatccaaaaagaaaaaaaaccggggggggttttctccccccctcccggaggatgcgaagaacaaggttggtttttgtaaagcacaaaaaaaacgcgggggaaaaaatggaccttttttaaaaaccgtggaacgtttttgtctttttcgaggcctttttttctgggttaaaagatggggaaaagccgggggggttttttttattttttcggtccgggggggggggccagactat

SEQ ID NO: 13471 - DNA, 385 bp, Homo sapiens
cgctgctgtcggttattatggataaactattattgttaattccgggcaagccacttgcctttctaggcctgcttctttgttcattaagcggggagcacggttcttgtgaggattacatgggagtgatgagtataaaggagactgcaaaccctatccagagccatcaccttgggagtgtcaccgtggtaatcagagtccgttattcctacaggagctccatccacaactgctctgcaggggacaatgggtgccctcattccccacagggctccctaccctctccatcgatacacactaacatatgggaaatgaaggcccaccctgccgggctttcatactctagaatgcgtgaatttttgctcttggcagcccattaaaagggcta

SEQ ID NO: 13472 - DNA, 355 bp, Homo sapiens
  misc_feature 355: n = A,T,C or G
ttggtcagcgatgctggtgagatgtaacctcagaaaagcaagattaagttatagctatcccacagggcaccttcatgcaattagaagaaagtgtccctccagaagatgcagccccctccaagggccatgtcttggcaaattcatcagcccttgtataaattagaaaaagtcaacttccctggatagatgcagccccagaggtatatggctttgtgaagagccagatttcagcaccaactggcctacagaactatatgcggtggccctggttgtttttttgttaccagatacatagcaacttatcttgtgtactttgtcggctctctgtagtgaaacatgggatttattcctaatn

SEQ ID NO: 13473 - DNA, 353 bp, Homo sapiens
acacggaggggtcacctgccccagcgccccacggtttccagccttggcctgtcctctttcacctggcccacgggtgatgcgtgctgtgctggcctttctgcagggtacagtgcggtcaggggactgctgggggctgtcagagccccagccctttgctccataccagggcagccgtttccagtcctgagggtttttgcgactgatcctggctgggacttgcttcttactaggagaagcaagagatccaagtccttcagtcagacgctgctctcagacatcagaggggcaggacactgaatgcacatgtgggttctgagggctcctttctctttgaaatcctgcaacaattaacg

SEQ ID NO: 13474 - DNA, 385 bp, Homo sapiens
cgttgctgtcggtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtg

SEQ ID NO: 13475 - DNA, 387 bp, Homo sapiens
cgttgctgtcggtgtatttcattggaaattgatgacttgaaaaaaattaccaattcactgactgtgctttgcagtgaaaaacagaagcacgaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtggcatctttatgttgcccacaatcccttgaacatgtagcacaacttcctttcctttcagttctgccacatgctacaatcagaagtgcagaatcttttgtgctggttatttaaccccttgacacttaggtgctaatgtgca

SEQ ID NO: 13476 - DNA, 380 bp, Homo sapiens
cgttgctgtcgctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgtt

SEQ ID NO: 13477 - DNA, 344 bp, Homo sapiens
  misc_feature 308: n = A,T,C or G
gatagtgaaaatattctcttactcaagagcttaaaaattagctattttataaaaattgtgtacatgtggattacaaaacctgtttcctttgtaaacagcagagcggtcttgattttcttaatgtctaaggtcattactctagaaatacaccctatggtgtccttgaggaaaccatggctatggcttttgtaactgggttacaaaatcagctcacgccgagtgcgatataaaagtcaacaggctctgagtgaggaataagagctctactctaggtaaaatgcttgaattttctgttctggatggctcangagactttttgagggggatctcagtgacattttgga

SEQ ID NO: 13478 - DNA, 349 bp, Homo sapiens
tttgtgatctgtcatggtcatggtatttcagagttggaggatggtctgagttctgacctggtgtaggaatcccttctcccaaaactctaacagtacattctcaggcttcgtgagctcaggcttaagacacattattttctgatgctggacagcttctttaaaaaaatgtagtttcttacattaagctaaaatttattttatgaaagttcaagaattctggtccaaattgggatgaggcctatggtgcaggacttccgtgaaattttatgagattacaaatgcaaaacacttagaacagtttctggcctattgccagaattcaataattgaataaaggcaggcagaaata

SEQ ID NO: 13479 - DNA, 346 bp, Homo sapiens
  misc_feature 346: n = A,T,C or G
cctggtctcaaagtctcagcctcaatcaatcctcccacctcagccttctgagtttctggaattacaggcatgagccaccacgcccagctaaatgactgcttttgaaccatacttttcttctgctttttccttatcaactgactttgtttaataaatccttgtctttaaggtcacagactttattgtaatttgtgggttagcatggaggtggggcaagaggtcccgtttctccaccaggtaaccaggccatgctgagaatacttccctcagacatttccttaagcatgttttgggaaggttatacttccacactggaattatataagtggaattgaataaaacccan

SEQ ID NO: 13480 - DNA, 345 bp, Homo sapiens
ctaattacggctaatcacagtagaaaataaaacttgattccctttcctgcatggcttgagcatgaaataggagaagggacaagacaacctccgggtattgtttctaattctttaaaaagttgtacttgcagccaggcacggcggctcactcctgtaatcctagcactttgggaggctgaggcaggcggattgcctgagctcaggagttcgagaccagcctgcgcaacatggtgaaacgccgtctctactaaaaacacaaaaaattagccaggaatggcagtgtgcacctgtagtcccagctactcgggagactgaagcaggagaattgcttgaacccaggaggca

SEQ ID NO: 13481 - DNA, 347 bp, Homo sapiens
ggcgacagagcgagactccaacttaaaaaaataaataaagaaaaacaggatgcatccagcttgtctcacacactctaccctgggtttatatttattatccacgaggaaacatccaaaatcaggggtcagagtcatggttccccaccttgtccatgacgagatgggccagtccacatcacaggcacaggtaggagaccccaacacagtgtccactgttcacattctaaaggtgactgtcggccaggcacggtggttcacgtctgtcatcccagcaatttgggaggccgaggcgagcagatcatccaaggtcaggagttcgagaccagcctggccaacacggtgaaacc

SEQ ID NO: 13482 - DNA, 351 bp, Homo sapiens
atgtgtacacaatcttccagcatataccaatagctgaatttgtaagatattatatagtatttgcatgtgtatagctctttcttcatcttctgtgtacaactgaaatatttttttcatgtcctagtaaaaccctaaattgagaattacggactcactaaatgttagaccagctagtcatttagaaaacagtgcatgtgatttgtttaaggggcaggaagtattaggtgtcaacaattcaaatcactttgtgtcttttttttttgaaacggatgcctacttcttaaccccgcttggggggccagcacccaaatagcactttttgtacggggaaataagtacttagcgaggcac

SEQ ID NO: 13483 - DNA, 348 bp, Homo sapiens
ttgtatattttagatgcctctttaaaaataaatttacatgatgagaccctgtctctaaaaaataaaaataaataaaataaaaataagctattttaaaagttagttatttaaattgaagaatgtggacaagatatactaacagtttctctaggactgatcacccattattccatgaataatagaaatttctgataaggatgttgcttaatggagattttcctatgttatctctgcggttctagtgggtggcaaaggcagctatccgggtagggcactgtaaaggtgtggccttagtcatttacactaggacaataagagaccctccacaagtgtgtaactggataaagg

SEQ ID NO: 13484 - DNA, 129 bp, Homo sapiens
cggggacgggttcgggcataccgcatttagggagctttgcaaaaatagcataatatgggaattgtgagatgctactgcataaattgtcgcctatctaaattgaacataacgtgccacactcgactatac

SEQ ID NO: 13485 - DNA, 373 bp, Homo sapiens
tacggcctgttatattacgacagaagggcacagctccacggacttagagcagataaggtaattgctgctccaacagcccagcctcgtccccagctcagagtctagtatgttagaaactggactgcctcctccccccacatcctcccctagtagcttcaggagggggacagcttcactgctgtccccatgcagatggtgcagtgcacataaaaggtgggctgcaggccaagcgtggtggctcacgtctgtaatcccagcactttgggaggccaaggcaggaggatcacttgaggtcaggagttcaagaccagcctggccagcatggtgaaatcccatctctactaaaaatgcaaataaaggccgggcgcggtgg

SEQ ID NO: 13486 - DNA, 372 bp, Homo sapiens
cgttgctgtcgaaaaaatctttctaaacaacaaatacctaacattattactgattgttttcctaatttatcctcctaagttgaatggtaacaaagcttttccagctgaatgaatgcacttagctgataaaccagaatttgttcttttttttccttcttttttttttgaaacaggttctcactctgtcaccgaggttggagggcaggggaatgataatagctgactgcagcctcaaccttctgggctcaaaggatcctttcacctcagcctcctgagtagctgggaccacaggggggggccaccacaccgggctaattttaagggattttttttcctttttttttttacccatggtgcccagggtggacttgg

SEQ ID NO: 13487 - DNA, 347 bp, Homo sapiens
agtgactagtacaagaagcgaatgctcctttcctctagtggacatgagaaaactatccaaaactgcagtcacctggtgttccagctggttgcgctatctgccgcttgccagatgcataaagctaccaggagattagttggtgggactggtaggaaataggggaaattatggtttaggtgttcatgatctctctgtgggaaaatgagggttatttttcccactgtcaaatgcccaaaggaattttaacaatctttttcttactcgcaccccattgtctttttgtttcaaaaggccaatttattttctcattattactacttattggctcggtgcgaggtagactttcc

SEQ ID NO: 13488 - DNA, 351 bp, Homo sapiens
tggggtgggtgacaaaagctttgggcaaggatgtggaacaaatcttattttaatttggcttaattgacttaactacaaagcccatcatttacttgaagcacaaactataactctgatgttttctccattttaaaattataaatgcattaattaaaaataattaaagagcaaatcattaatagcaaactaccataacttgatactttttaacattaatacttaataggtttaatatctagcagggcgggggaaggcacagggataatataattatgtctgctctgagcaagggagtgacaataggtgtaccactgacttgtaatacagcagctacaccagctcttgaatgta

SEQ ID NO: 13489 - DNA, 317 bp, Homo sapiens
gctggctgggcggccccacagacaggcagagccaagcactcccctctcaggcactctgccgcaggctggacagacagatcagctgggctagggcgtattgtcccctggcagacagacaaatctgcagctcctgagtggtttttgccccagccctgggacctcttgtttcctagcaacattcttaattcagagcgggcacggtggctcatgcctgtaatcccagcactttaggagggcaagacaggaggatggcttgagcccaggagttcaagaccagcctgggcaacatggtgagccctcatctctacaaataaatt

SEQ ID NO: 13490 - DNA, 324 bp, Homo sapiens
  misc_feature 314: n = A,T,C or G
tagggtgtaaatgcctggatgctatagattccaatttaactatgaaaagaactgactcattcatttacatttctgttacagacagcccaggaggttacagtgagctcttcactaagaatctggacgaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgngatgaatctt

SEQ ID NO: 13491 - DNA, 351 bp, Homo sapiens
gttcaccatgttggtcaggctggtcttgaactcctgacttcaggtgatccacccgtcttggcctcccaaagtgctgggattacaggcgtgagcccaccgcgcctggcttcggaattgcatcttaatctctgtggcggctgctattttgttttctaagttcatgagcacaggtggctgcctctatctttctcctccacttaagcaggaacaattcaggaggcagactccacccaatgctgcaaatcggccctattatcattgaccctgacagaatttcaggagtgtcaggccactccatactgcaaacagtacaggttgcttataatcgccaggaggaaagaaaatatccag

SEQ ID NO: 13492 - DNA, 378 bp, Homo sapiens
tacggctgcttaagacgacttaagggggaatgacgcagcggctcttagaggaacatatggaaaacacccaagccggagtctctcacaagcttgaatgtgtgttctggagctgaaggatgcacggttgttaagcccctgttcttttccgttgtttaatctaatgttctttggaataaaaacctccctgccaagtagtacttggttttatgctcaacatgctttgactgttgaaaagagacctttggcacacattgaagggatggtgatggagatgccaatccatggaatcaggtggcgcagctatgttggtagctatagcagaagtcttcttggcaaagattcctcccgggaaggaaggtaccattggagaaccatgcg

SEQ ID NO: 13493 - DNA, 347 bp, Homo sapiens
tgcgtttttttttacatgtgtgtattttgcttattttatgcatgtattttaaaatagcaagttgactttgttgcctctggagttccacagaaccagggtaatgcgtgggcatggaatactaacaaggagaaacagcttcctgtttaagaacaattcccatgttttttttttataggagaaaattgagagctgtttgggggctgccatactttacatttactttactctacatttaatgttttggtctccaagtaaagaagagtttcattagatgtagcaaaaacaaaacatatttttattcttcagagctttcaatgatgaaagaacgaaccttgaagatgaaaagg

SEQ ID NO: 13494 - DNA, 349 bp, Homo sapiens
  misc_feature 26: n = A,T,C or G
aggtacgggggcgagagagacaacanaaggggagcacactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttggcttatttatgtttaattttaaaaaattcccactgggtgcagtggctcacgcctgtaatcccagcactttgggaggctgaggcaggcagatcacgaggtcaggg

SEQ ID NO: 13495 - DNA, 344 bp, Homo sapiens
ggagatgcttttccttctgcatgttaactcacaactcattcctaatcatggaggctctaatccaactgactaaaatgcttttctccccacggaactaacgtagttacttgagagaagagagtaaaccagcttctcctgcgtggcacagggctatttttcattatagggaaacggacttctataagggcatttaccacatcccaagggctaatttctcatttaaaaaataggggcggtcgcggtggctcttgcttttaatcctaatacattgttttttttatgccggaggctcaggaactaaagtggaacaaaaacaatccccctttcaatatagaaatctttag

SEQ ID NO: 13496 - DNA, 346 bp, Homo sapiens
tacaggctgagagcagaggctgaagtaaggggagttctaatctttgggtcagttgccctctccctgtgtcatttcttatgaaatagaagttatgctattcccaaaatacatacagcactaggcaaagtgttaagaagcctagattttgccagaaaccatgtggagtttggagcaagtcatttctactaactagggcttcctccttagcttataaaatggaaggggtagaccagatgaacatgaggtcttttttctcccccctctaagagtaaattgtctcaacaattttacaaggtgtttacaaaacaatacacattcacataaaggtgatgtatttatatctata

SEQ ID NO: 13497 - DNA, 317 bp, Homo sapiens
gagcagactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttgtcttatttatgtttaattttaaaaaattcccactgggtgcagtggctcacgcctgtaatcccagcactttgggaggctgaggcaggcagatcacgaggtcagg

SEQ ID NO: 13498 - DNA, 351 bp, Homo sapiens
  misc_feature 245: n = A,T,C or G
aagggtttctttttctccctttttttctttctattgttattatttttttactgagggttttgttagcttttaatcttgtggaactcagaaactcccattaatacggtttcatagaaaatagtcgtacaaatttgtctttgcatcttctctgcagaagcccctttgccagatgaattcacagagtgttttcttttggaatccttaggctaggcttacttatttgtgatatttgagtatgagtttgntttcccactagtatattacaactttgagggccaggagctgttttatgaatctttgagggcccctatctcataactgcgcgggttctttattttgatggcacatttg

SEQ ID NO: 13499 - DNA, 346 bp, Homo sapiens
ttaacacagtgaaaccccgtctctactaaaaatacaaaaaattagccaggtgtggtggtgggcgcctgtagtcccagctacttgggaggctgaggcaggagaatggcgtgaacctgggaggcggagcttgcagtgagccgagattgcgccactgcactccagcctgggtgacagagcaagagtccgtctcaaaacaaaacaaaacaaaaaagaaaaaagaaaccaccaccaaccaaccaaacaaaacccaaaaaacccaaagtaacggaggtggccgagggagctggggatggggagggagtccaaacacctgggagctagaagtttctgaaaactgtaagtcttt

SEQ ID NO: 13500 - DNA, 347 bp, Homo sapiens
  misc_feature 347: n = A,T,C or G
tgtgtgtgtgtgtgtgtgtgtcccaaggggtgtgtgggtgtgtgtgtgtcccaaggtgtgtgtgtgtcccaatggcagcctcagggtaaactgagcaaagaatgaattttgacattgcttgggagagcagaaaaggttctatgatgaggatgcaggtctcagacattccagcataggacagatgagccaaccttaagtcccagacagagtggaggagagtctattcccgcccctaccctgaggctgattgtcccagttccagaagggactcccaggaaaatccagcctggagaggctgcgcccggagcaattaataacaggacaaggccagcgagtggttttgcttn

SEQ ID NO: 13501 - DNA, 238 bp, Homo sapiens
aacatcactggctcccatttctctgacatactaccaacatctgttcagttctaccacttacattacataaaaacccactagttcccaagttttgaatgtacatatgcatacaggcacacatgctcgcacacatatatacacatgcacacacacatatacacaatattatacaattgtttagggatttaaaaagcattccctggccaggcatggtggctcggcctgtaatcccagcact

SEQ ID NO: 13502 - DNA, 376 bp, Homo sapiens
tactacggttgcgacatgacaacagacagtggtattctcttacggacgacaggtgccctgccgcgccaacaacgctgtatcacctggagctgtgataccgccgatttatctgccgcccgcatagcctgccgtccacggggtgtcagcgagattggaatatattttttgcacctcgcggacggcttgggagagtgaagattatcagctttatctttccaaatggagacaagtatgtttttctcctctgtttagatggtgactgtacaagaacatcttctggaatctacgagagaaatggaataggtattcataccactcctaatgggattgtctacacaggaagcggaaagatgacaagatgaatggttttggaaga

SEQ ID NO: 13503 - DNA, 345 bp, Homo sapiens
gagtccccaagtggccatgttacatgtgatctgtgacatatacgatcagatgttacctgcatcctagggtcgcctggcatgcccatgagtgacgcttaggaccgtgcctggtgctggtgtgtggacaatgctgggccagtttgcccagggctatgcctgccacctctacttttatttcaccctctggaggcggacgcattggaaagcatgtggggcaggaggtgaggaaggaaattcagacaagctgagcagagcggccaggactggaatcttgggtgccaacccgcaaggtggggaaactgatttccatttcccagtaattacaggtcaataccacacctgaag

SEQ ID NO: 13504 - DNA, 291 bp, Homo sapiens
tacggctccgagacgaccacagaagggagcctgggtgacagcgagactctatctcaaaaaaaaaacagatttctctcctatgagagtttctggcctttgatgctgcactttcctcttctgaaacatcaagggcttttaaagagggatggagctgactgcctggttctgaggcatgaacgacactggtaggtgagagcaagatggtacagaggagttcaaatttgggtccaccatcctgggctccgctgcatagtgttaggcagtcactgagctggttccttcccaccacat

SEQ ID NO: 13505 - DNA, 351 bp, Homo sapiens
  misc_feature 332: n = A,T,C or G
tttctcttggcctaatatcctggctagattttggcagttccccactctaggggcaatgtcttttcagcctgcacctctgactcctagctggatggatgacttcaggatacacaatagaatcattcctgtgacttatctgcccacagtcccaaattcagttgcaaacttctcctgaaaggctgtttttgaataatgacagtgactggactcaccttgctcttctgcatactattaattcccctgccagtcaatctccctttttttggtcaaagtatagttgtatgtatatcgatctctggcttagtcccatctctttctttccctccaccagntctgtcattaaatgtagag

SEQ ID NO: 13506 - DNA, 371 bp, Homo sapiens
ctacgcttgcgatgagacaacacaacggactgtcacacacgcacacacacacacacacgcacacagtcccttaccctctgcttagagttccccctctcctgcctgtacagatgtctgtgttatttggccccatcaaataggtgaattgagttgttcattaagggaggggaagagctcagatttttaagtgattatatttttgttttggacacagacatttcctaggaaggaaagtgtttttggtaatggaccacggaatcaaaacagattactcactgtttctgtccattagcgcatatgatggggagcacctcaaagaagtttagtcagagggataggggctaaagcattacattcatcctgaaaatgcc

SEQ ID NO: 13507 - DNA, 350 bp, Homo sapiens
ggcggcgaatgtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaagaccttatttcgtgaagcgcactaaagaccgggggactatggatgatgacttcagaaggggtcacccccaacaagattatttaataatagatgaccatgctaaaggccatggcagtaaaatggaaaagggccttcaaaaaaagaagataacaccagggaactatgggaatacccccagag

SEQ ID NO: 13508 - DNA, 352 bp, Homo sapiens
aggtactggctctcagagagcatctctggatttgcccaggaccccaagtccatggcactttctgccatgagggaaggacataaagacttctgaatagcttttgctaccagctgatcatacagccctagggtcttcagcaaacacagctagtagccaaacggtggttacaacgggctttgggcgagactcagtgctttactgacctcaggtctgacccagcacagtcctagtggtggtggtcacaggggtaattttgtcaccccacacccagctccaggcaggttggcacacacagagagagtttccatttagggggagaaagtaaggaaatagaacaagagcctctgcctgg

SEQ ID NO: 13509 - DNA, 372 bp, Homo sapiens
ggctcagctgattctgggcgctggatgggcggccttggcattaggtccagatttgggtcctaagtactgtgcccaaccggcccgaggggaagggggaggagacaggaaccgcgcccattttccggatcaggttcttggaaccagcccggaaatcctgggactcaatctgggggccagatctggaggcgatggtttttctagagacgggctgatgcagccccagtatgccgtcgcactcatttcccacattccaggaacggtccaggtctgcccttcatcggtttgggaactccgagacgactccctctctccacaactgcagggtgggccgcgctctgaaaacctggcaaagcgaagggggtccctcagacg

SEQ ID NO: 13510 - DNA, 363 bp, Homo sapiens
cgtccgtatcatgatgtcaagatatcgagacccttctgtctaacacggcgaaccaccgtctctactaaaaatacaaaaagctatccgtgcgtggtgggggacgcctgtggtcccagctactccagaggctgctgcaggagaatcgcttgcaccaaggatgcggttctttgtatgagccaagatcacaccactgcactccagcgtgcatgacaatgtgagactctgtctcaaaacaaacaaacaaaacaaaacaaaaaaacgagacaagggcattcccccgggacaggcggtgagagtggggagtatccagaacacagccccttccttggccccaggccctggcgtcgggagtaactgacttca

SEQ ID NO: 13511 - DNA, 335 bp, Homo sapiens
aaagatgggtccttaccttttgtaatgaaatatagaaaatacttattgtgactttgcagtagttaaacatagaaataaaacatattttgtacatagatcagtggttggatagactatttatacatgatatgaaatattgatgacttataaaagagaacgtatcagtgctatatgtattgagacatggagtgagaagctttattaaatttaaaaatgtttgaagaatagtgtgtagagtgtacttataaaaccaaaacaaaacaggagacaaacagaaaaagcatacctatgtgttcatatatttgaaaattcttccatgactgtaaagaaaactg

SEQ ID NO: 13512 - DNA, 338 bp, Homo sapiens
actttacactaagctatggcaaccataaggaggcaagggctgtgatgtgagtgggtcttcagctaagctagagctgccgggcacatagcatgaggctgatgctaccgtgagactgtgtggaggcccacacagtccaagatatgcacaggagtctcataagattaatttacaaccaagaattacccaagcttggatacacacccaaaagaaggcagagatccaaacagatgtttgtacatcagtgttcctaacagcatttctcacaatagccaaaaggcagaaaccactgaagcgtcttatcgatggatgatggataaagaaaatgtggtatatacata

SEQ ID NO: 13513 - DNA, 337 bp, Homo sapiens
  misc_feature 337: n = A,T,C or G
gccccttcggattctttctataagcaaattgcgccttggacataggctttgaatgctttgagagaacctctcttcataagtggaaataaaatcatgatttaattgtatcaaacgcattatggataatctatgggatttaatgaatcaataggtgaggctgagttggtaagaagtgaacgttacttctgcatttaaaaaaatacatttaactcaataggaagtaacagatgagtaattggaaaacattttaaacttgatcataaagaaataaaaattggccatgtgcagtggctcatgtctgtaatcccagcactttgggaggtaaggcgggcagatn

SEQ ID NO: 13514 - DNA, 341 bp, Homo sapiens
tgcatatagtttttgtcttaatcagtgggatgagtcttaaggtaatttattgagaacagagaagggaggataggttgacaaacaaacattttcaagtgttgtattttggaaactttattaaatgcctactcaatatcagtatgtgaattttacccacacaaatgaacctattcaatagaaattttcttaattactcaacgtaatacacatgcacatgcgcacatgcacgcacacacacacacacgcacatacacacaaacataacccagcctccactacttaagatgagagtatagtctagttaaccaggaggttatgagagttcagataaagtttgtctt

SEQ ID NO: 13515 - DNA, 366 bp, Homo sapiens
tacggctgctagaagacacagaagggtccaaggaagtgacataatcaatctgagctacattttctcgctattaatctggcagtgctatatggaaaggaagaaatggggtgtgggagtatagttagaattatattattgtggcttaaggctaaggaaacaatttctgacactggtaagggacaaaaggtatggaaagaggttggaagggacattattgcagaacaatcaacaagattaggcattattgggaactgggccacaaggtagaggaagaaagaatgataagtgactctgaggctttgagcttgggtggctaaaaatgtatagcactggaacacagcttttactacgtgatcgcttgtcgag

SEQ ID NO: 13516 - DNA, 122 bp, Homo sapiens
  misc_feature 122: n = A,T,C or G
ggtccaatatggcggcgcccagtggcggtgtgaactgtgaggagttcgccgagttccaggaattactcaaggtgatgaggacaatcgatgacagaataatacatgaattaaacactacgggn

SEQ ID NO: 13517 - DNA, 337 bp, Homo sapiens
  misc_feature 337: n = A,T,C or G
tttctgtcttattcactgttcctcctcagattcctagaactatgcttagcacaaaagagctgctccataactatttgttgaatgaatgagtgaatgattaagtaaataagtgcggtccttctttcctctggggtcccatttgctagcattgcccaggtgttgttaactgcttgagattttccttgtgacagcacacagtgtgaagggaagagaagaggactgcagtcactgtgtccatttagttcttgttaaagacttggggctgggcgtggaggctcatgcctgtaatcccagcactttgggaagccgaggcaggcggatcaaaaggtcgggagtn

SEQ ID NO: 13518 - DNA, 340 bp, Homo sapiens
  misc_feature 340: n = A,T,C or G
ttctagtaacttgtactttccttaccaatgatctctttcctgcgctaagggttaacttaaacttatctcaaagttaatttataaaaaaaagtttgcctgattcaccttattaccaatattgttaccattaaaatcagtagtaacctggtactcaattactctgattagttttcttatatctagagttcacaaaaaacgtgagtgactgcctgtccttaacttttccctacatatgcctcttcattatggcttctgagtgaactgtagaattgctattttacaagtgatgtgaaaacttgtgcagtgtacaatatgtatgtcacacaattttacaacatan

SEQ ID NO: 13519 - DNA, 339 bp, Homo sapiens
  misc_feature 339: n = A,T,C or G
aacacacccacaccaaagcacatcaagaaattcaaggatgcctgagaagaaaataagatattacaagcttctagaaataaaagaatgttcccatacaaaagatggagggttgaaatcactttagacttttaaatagtaacaatggaaataagatacttgagcaatgccttccaaaattctgaaggaatattattttaaaattagaattttatagccagccaaactatcatcagctgtaacagtaaaatgaaaatactttaaggctgggtgccgtggctcacacctgtaatcccagcactttgggaggccaaggcagacagatcactagagctcaagaan

SEQ ID NO: 13520 - DNA, 337 bp, Homo sapiens
aaacctcgtctctactaaagatacaaaaaaactagctgggcgtggtggcatgcgcctgtaatcccagctatttgggaggctgaggcacagaatttcttaaacctgggaggcggaggcttcagtgagccaagattgcgccactgcgctccatcctgggggacagagcacgactccatcttaaatcaaagcaagaccaaagatggcatagaatccttcctggaaccttgcgcagagggaagagtaacattaacttcacacgggccactctgttcaccatctttgcttcaaaaagagcctaccctggaaggcccggccccggaaaccggattttggggtc

SEQ ID NO: 13521 - DNA, 341 bp, Homo sapiens
aggctggtctggaactcatggcctcaagcgatctgccccgctctgcctcccaaagtgctgggattacaagtgtgagccaccgtgtccaccggggaaggcttttggtcagaacaatggctggcaaaaccacaggcatcggaaggccagagctagggatataatataaatgtccctacagtgtaacagatgatgctacataaagaaaatcccgtaatacacacgatttctgaatgtcctgctgaacattcggtgagtgaaaactaattatctgagagttgaacctatctttgttaataaacacaaagcggccgggcgcagtggctcacgcctgtaatcccagc

SEQ ID NO: 13522 - DNA, 335 bp, Homo sapiens
gtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccagggacaaagtgaattgcttcagcag

SEQ ID NO: 13523 - DNA, 334 bp, Homo sapiens
cccaaagtgctgggattacaggtgtgagccaccgcgcccagcctctgaattacttttctgcttactcaaagattagcctgtattgcggtgctcacttaaatccagttgcaacattacaaaccagccttatatatttggacatgtttactgtttaatgtaccgtaaaaataggaaatttgggttgggtgcagtggctcacgcctgtaaccccagcactttgggaggcttaggcaggcggatcacctgaggtcaggagttcgagaccagcctggccaacatggtgaaataccctctccactaaaaatacaaaaattagccggtcactggggggcac

SEQ ID NO: 13524 - DNA, 180 bp, Homo sapiens
ataggtaaatattaatagcaccaagcttttgtttaagccaaaaacctgagaatcacccttacttcctgctgaaacctcacattctacatctagccactgaaaaagctgctttgcattattttcaaaatacattccctagggccgggcgctgtggctcaagcctgtaatcctagcactttg

SEQ ID NO: 13525 - DNA, 337 bp, Homo sapiens
acctcgatagaggtgagaaaataaggcgggaccctctaatattcattggacatctgtgcacagtactgtggtagcccctttcacatagtttacattcctggaatcttcaaaagaatttatagaattgctcttacgcctttttttattgatggaataaaacagataagaataccaaagaagaggctgggtgcggtggctcacgtctgtaatcccagcactttgggaggccgaggtgggcagatcatgaggtcaggagagcgagaccatcctggctaacacagtgaaaccccgtatctactaaaaataccaaaaaattagccaggcatgatggcgccac

SEQ ID NO: 13526 - DNA, 342 bp, Homo sapiens
agtacaccaaaagagagaaggaggaatgaaacttaatattcacctgttaaaaccattaactacaaaccttctttttttttttttagaagggggggtcggctttaatcccaaaggggggggggagggggcattaatgggggggcggaaaacccaatttgccgggtgaaaccctttctatcgggctaaaaattccaaaatgttggaaaaaggggggccccccactccacccggataatattttggatataaaagaaaaacggggtctacggggggaacccaggggggtgaggattctgggacctatgggaaccacccccctatatccccaaaagggggggtaag

SEQ ID NO: 13527 - DNA, 336 bp, Homo sapiens
tgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctcttatacttattcatcagtagatgcctagatgtggggctttacacttcagcagatactaagagggccatgtaccaagcgccaagtactgaggaatacaaacataaatactgcttgagggccaggcgcggtggctcat

SEQ ID NO: 13528 - DNA, 344 bp, Homo sapiens
cggggatgcggaagtacgcaccacagccatcatgcaaggctattgatgctctattagagaggaatgtgcagactgtgacacactttttgccattatgacctgctgcctgcaatgtgtccacgacgcctgcatacactttatcgttcagatgcacagcgagcagggggagagatctgggtctttgaccactatcttgagcagctgtgccagccccaggctgcatccacttcttggtattgggaaggacaaagccctatttacagacaagtctctattccatgcagcttaatgcaatcctgactcataaagtacctccaaaccaccgctccccagttgttccatgg

SEQ ID NO: 13529 - DNA, 260 bp, Homo sapiens
ggacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagactcagagtccaagtcccacccggactcctccaagatacccaggtcccggagacccagccgcctgacagtgaagtatgaccgggg

SEQ ID NO: 13530 - DNA, 333 bp, Homo sapiens
actactacttttcatgcaatacttcacatacaacttgagggttacagaatccagattaagcctctgttctggaaggattatcacagaaacccacatttacttatttcagagggggtcatctgcttcccctctgccctttctctaataaaacttcaaaaaaacagaatattgtcaggccggacgcggtggctcatgcctgtaatcccagcactttgggaggccgaggcaggcacatcacctgaggtcattactgacttctagaccagcctggccaatatggagaaaccctgactctactaaaaatacaaaaattagctgggcgcggtggcatgg

SEQ ID NO: 13531 - DNA, 339 bp, Homo sapiens
agaatgtctgggtcactcccagggtgtaaaattagcacagcccagcatcctcacttaggtgagggacagggacgtcgagtcacctggtaagactccctgcaaaagaacaaaagtggccacctgcttagggctggtgaagaagctgttaaagtggatgaggtgctgtatatagaattataaattgtgtcatcccaaggagaacacttaaacaaaaagaattttcagtccactgtaaaaatatgaggaggcaagttaaattggataactctggaatgggtagaaagatgtcataataacgcacacatgcacacggatactcccaccactgagtgttacccc

SEQ ID NO: 13532 - DNA, 337 bp, Homo sapiens
ggcagtcactgagctggttccttcccaccacattggggtgctcttgcctggcctgcctgtgttaggcagtcactgagctggttccttcccaccacattggggtgctcttgcctggcctgcctgtgttgcaggggggcggtgtcagaggagacaacatgaaagtgctgggaaagctggatacaaacacaagctgttgtttctaatcaaagttaaaactggctttatgctaaaggagtctttagtgcctcccaaaaaagtgagaacagtatttttccaggggcttctatgacctgctgacctttcttccaagacatccgtgagatttttcttattagag

SEQ ID NO: 13533 - DNA, 339 bp, Homo sapiens
gagaccaatacttccatgctgtcttcaagccctgcttcctgcacatctcccagcccagatggggagaacccatgtaagaaggtccactgggcttctgggaggagaaggacatcatccacaggctcagagtccaagtcccacccggactcctccaagatacccaggtcccggagacccagccgcctgacagtgaagtatgaccggggccagctccagcgctggctggagatggagcaatgggtggatgctcaagttcaggagctcttccaggatcaagcaaccccttctgagcctgagattgacctggaagctctcatggatctatccacagaggagcat

SEQ ID NO: 13534 - DNA, 338 bp, Homo sapiens
acattccgtctccagacctggcattcttactcacagctaagcaagaatagatggttactttgcaaaccatcaagtactatacaacataaggtaattatgaaagtcagagagagtatatgacttctatagttccacaactgattactcaaatacaagaacagaaccagttcaaccctatttccacagacttcttcgtcaatcaaatgaggatgatgtttcctattacaggccaccaaacattttagtaagtatgtaaataatgacaaaagtgtatggccaggccgggcacggtggctcatgcctgtaatcccaacactttgggaggccaaggcaggtgg

SEQ ID NO: 13535 - DNA, 369 bp, Homo sapiens
tacggctgttagatgacgacagaagggtgtgtgagagtgtgggttgtgtgagatacatgtgtatgtgagtgtatgagtgtgtgagtgaatatgtgtgtgtaggaatgtgtgtgtaagtgaccttgtgagtgtgtaatgagtgtgtgtgagggtgtgcgagtgtatgagtgagcatgtgagtgtgtagtgtgtgtaatgagtgtgtgcgtgcatgcatgggcatgtgagtgtgtgagtacaagtgagtgtgtgagtgattgtaagagtgtgtgatgagtgtgagcatgtgtgagtgtgggggattgtatgagtgggtgtgaacatctgtgtgagttttggggtttatgaatgtgggatgagaattgtggt

SEQ ID NO: 13536 - DNA, 365 bp, Homo sapiens
tacggctgctacaagacaacagaagggactacacggtctgtgccggaacaagagtcttgctcttgactggttaacctgccttgaatcagggcattcagggagacctcagacaggtctgcattgacctatctccacgcacaaggggcagcattagttagcccactgtcctcagggcttccagcaatgagacagctctgtcaagagaggcactgaagagtaaaagtggttgcttgttcaacggctttcaatgggattgctgctgaacatgagactcactgaaatgccgatgttaatatgtttgataactccaaatccatcaggcttgctaaggaataagagatgtccaaggtttgcggtggagaatt

SEQ ID NO: 13537 - DNA, 342 bp, Homo sapiens
tgtgtgtgtgtgtgtgtgtgtcccaaggggtgtgtgggtgtgtgtgtgtcccaaggtgtgtgtgtgtcccaatggcagcctcagggaaaactgagcaaagaatgaattttgacattgcttgggagagcagaaaaggttctatgaggaggatgcaggtctcagacattccagcataagacagatgagccaaccttaagtcccagacagagtggaggagattctattcccgcccctaccctgaggctgattgtcccagttccagaagggactcccaggaaaatccagcctggagaggctgcgcccggagcaattaagaacaggacaaggccagcaagtggtttt

SEQ ID NO: 13538 - DNA, 338 bp, Homo sapiens
gagggaggatcacttgagcccaggtattcgagaccagtcagaacaatatggtgagatccccttctctagttctttctttcttatttttttggcgagagggggactgagtctcgctctgtcgcccacactgacctttattcatacgtacaaaacttcacacagcacgttcctgagcctgccccacttcgtggcctaccttaacggaattataccaaaccatacctttggacaccggcagctctaactcaaaactggcagtcacccgttcaccccttttgaggaatgcatcccacttccacaggacctttaccgcgttccatccccctgccttcgttttg

SEQ ID NO: 13539 - DNA, 339 bp, Homo sapiens
ttgggagtcaacagagtgatggagcctgtcctgtccttgcacttgatctccacattcatagtgtagccctcggccttgacatttaatgtcacagggtggactttcttttccacattgcagatcaaattaaagttcgcatctccttgctgctttggagtgaagaaaatatcaattgggaacctggttggggaacaaaacagcagattacctgactaggccaacttgtcaaaaccttaaaaaatatgagcctactgaattagcagattcattacgaggaaaaggaaactccaaattatgatgacattttaagatttgtggctatagtaaccaaaacagcgt

SEQ ID NO: 13540 - DNA, 331 bp, Homo sapiens
atggccctacccactgctgctttggtccaggagcattgatgcttctcggctctcctctctcccctaggcctgcaggacaagctgaacaagagggactaagaggtgacagccttgacctcccagaccgagatgctcatggcccaagtaaggggtaaggctccctcccgtagggcagatgcggggggctttcactggggccgtgccattcagctgccaattaagcatggagtgggtcagggcctggcttagggtcccctccccgactctgctttgagaagaaaagggctggctggtcgcggtggctcgcgcctgtaatcccagcactttggga

SEQ ID NO: 13541 - DNA, 235 bp, Homo sapiens
cttctgttgtagccctaggcaatctcgagccacagagacgtccccgctgacgagaaggaagtcctacgaccgagggcagcccattaggtgagatcatgttctagaatctgctccagagtcaccaccagtctagttcttggttacatgagtggctatgatgttctgctctgttgatcatcttgtacacagtgtaacctgggccagcttgactgagccattcaggttcacccagtgg

SEQ ID NO: 13542 - DNA, 151 bp, Homo sapiens
gctgtcgacgtgttcttccggtggcggagcggcggattagccttcgcggggcaaaatggagctcgaggccatgagcagatataccagcccagtgaacccagctgtcttcccccatctgaacgtggtgcttttggccattggcatgttcttc

SEQ ID NO: 13543 - DNA, 325 bp, Homo sapiens
gctcataaaactgctgataggaaagagttataggtctcactgttcaagaggcttgggttttaaagtcatattagcctcaagagataaggtcttggggtccttaagagtccagtggttagaaatgagatgtctgcagttagacctcttaacatcatcacggatatatttgtgtttaatcccagcactttgggaggccgaggcgggtggatcacctgaggtcaggagttcaagaccagcctggccaacgtggtgaaaccccatctctactaaaaatacaaaattagctgtttgtggtggcgtgcacctgtaatcccagcaacttggg

SEQ ID NO: 13544 - DNA, 322 bp, Homo sapiens
gaaagtctacggagcattttctggggaatataattttaaaataagattaaatatcacataaaataaatacaaaactagatagtaaaattctgaaaaaaaaaaagaataagcctgaccagatactacactgaattgcaaaatcattgatatggttggaaacaggggcaaaaaaagcagacatgtcaattgagtaaaatagagcatactgaactagggtaaactcacatgagaatttaataaataataaagggggcttttaaatgagggggataaagaagaattatttaataaagggggtttgggtcaatgggctagccatggg

SEQ ID NO: 13545 - DNA, 135 bp, Homo sapiens
  misc_feature 135: n = A,T,C or G
aaactctgttttaggataagtcactaatatagagatagctagttcaattgtgtctggcttcctatcacatcactagcacttagtacagaattggggtcctaaaaatatttggcaatgatgacctgtgttgctttn

SEQ ID NO: 13546 - DNA, 327 bp, Homo sapiens
gaccaaaatacaagttcaatgaatgacgcagcagctctgagaggaacataaggaaaacacccaagccggagtctctcacaagcttgaatgtgtgttctggagctgaaggatgcacggttgttaagcccctgttcttttccgttgtttaatctaatgttctttggaataaaaacctccctgccaagtagtacttggttttatgctcaacatgctttgactgttgaaaagagacctttggcacacattgaagggatggtgatggagatgccaatccatggaatcaggtggcacagctatgttggtagctatagcagaagtcttcttggg

SEQ ID NO: 13547 - DNA, 328 bp, Homo sapiens
tattaataatgctaaacacttaccagctttgtaactttagctatctatcaccattgagttgtttcctaatctataaaatggtggtaatccctcatacgactgtggaactgatgaaataatatggcatatgtaaacatttggttcaagacctgctacattggatgaggaatgtcaacagtaaagtaaaattttgatctttgagtgtgtagtgagcttgttatgtcactttctgtggattctatttgacactcataaagaaaaactctaggtttaaaaatggaactaggccaggcgcagtggctcacacctataaccccagcactttggg

SEQ ID NO: 13548 - DNA, 329 bp, Homo sapiens
atttgtaactcacagggcagaataacagctctagagctcaatttatctggaggagattcagcacacctgcttctctttttccactggcatggctcttggtgcaaatttgtatttatgtaatagttagaaattaaacatcagcaccaacggaaaaatattcaacgccctttattaaacatcaaacaactttgtcaatgggaaaagctgccccaactggtttagatcttacctttcaacattgttgtcaaagtacctttccactctctggtaatgtctttgagagggtttgcttattggacctacaactatcttcccggatggagttgcct

SEQ ID NO: 13549 - DNA, 303 bp, Homo sapiens
cggggcgtgaacccgggaggtggagcttgcagtgagccgagatcgcgccactgcactccagcctgagtgacagagcgaaactctgtcccaaaaaaaaaaaaaaaaaaaaaaaaaaaaggggggggtttttttcgtaaaccccaacgtgaaaaaaacctttggggggttgggcacacccccccttaaaggggggggaaaaaaaggctttttttggaaaattgggggggcttttgtttttttttgaaccctttaaggcggcaaaaaacaggttaaccaccacctttggtttttttttagggtgga

SEQ ID NO: 13550 - DNA, 328 bp, Homo sapiens
gagccaccactcctggcccaaagtcaatacattttaaaaaaaaacctctccagtggctaagcccagcattgttatatgattaataaataaaatattgacatcgagggttgacaaacctagtactttttcctgaaatcttcagtgctgtctgtgagtatatttgcactgttatgtaccagcaactgtgcacataacaactggtatgatcaataagacatagtcctcgccagggccaggtgcagtaactcatgcctgtaatcccagcactttgggaggccgaggcaggcagatcacttgaagtcaggagttcgagaccggccttgccaag

SEQ ID NO: 13551 - DNA, 297 bp, Homo sapiens
gtagaagctatatgttgttattgtattgctatttatctacttaaataactcttactgtagtatgtattgctcaaggacagagattgtgttgctcatctttgtgttatcccacttagcatagtttctaagcaaatagtatagttctttcatatatgcttatcaagtaaatgaatttgactctacctcctaatgaactattcagaaattcatgtttacgattttagcaatgagaacaccaagacttagcaatagagtatcaaagataatacaactagggagtagatctaaaataagaaa

SEQ ID NO: 13552 - DNA, 277 bp, Homo sapiens
atccacgtgatactaagtgtaaacccctacgcttgtaactcttactcaaccattaacgaccgcaacaaagcaaattaaaagaacattacgattccagcaacattcaggtgaacatgaatgtgctcttcactgttttactgatatggaattgctacaacgtgaaggtcttgactgttagtggcccacccacttttgagtttaagcaaactagattcacttgctgtgggatgacctgatgctcttctgccacttttcaaataactacaaaggctttgtt

SEQ ID NO: 13553 - DNA, 298 bp, Homo sapiens
ggaaaggaggtagaaggatgagaccctaacacctggtttctccttccacttcaggcatttgtcagattcttggactgcattgagtaggggaataagaagttgggcagaaatcccctaacatatgtcctggtttctcagggctaaagaggaaaacactgaatttcaaggcccaaccaagtcaagggcccccttagtaaatacactacactttgggctgggtgacctcaaggtccacacctaaggtaacatcaaggcgatccagaagtagatcttaaatgtagctcaatcttggctgggc

SEQ ID NO: 13554 - DNA, 326 bp, Homo sapiens
agagacagggtttcaccatgttggccaggatggtctcaatctcttgaccttgtgatccaccctcctcagcctcccaaagtgctgggattacaggcatgagtcaccatgcctggcccacagtgaccctttaaaggaaaatgggagggacctacctcggaggttgtgcagaaaatgttggcttccccagcactagggtttggttccctcctaggtcctcccacagctgtgctttgacacataagcagcttctattaaagtgcctctttaatttgtctgtcattgccaccagaccacaagatactttggggcagggctgtatttcattg

SEQ ID NO: 13555 - DNA, 328 bp, Homo sapiens
gtatttattaagtatttaccctgaaataagtactgcacgaagcatattcattcagtattgtccagttgctcttagcatgaagtcactggtgtcaccttgatggcagtgatgagacaaattacttgtttcacctctttaaacatcagatagattgctggggacaaagagacagcatggcttccaaccattacacaagtcccccttctgcagccaggatcatgtctaggatgatgcagttatggaagacagcatgctgagtttctattaatttgatgaatcaccaaattgagaccagtggtggtggtgtccaaggacaaagtgaattgtg

SEQ ID NO: 13556 - DNA, 328 bp, Homo sapiens
  misc_feature 328: n = A,T,C or G
ggcagcatgaatcataattgtcaggaaaaacttcatagattccgctatagtatctccggtattgtatcaggacaatctataagacatttggagctacaccagttgaaaggtattggctcagtcagcccccttattcagttttgtaaattagggggccacttgaagaaaattctatggtttatgctaatacacatgtagctgaaaatataattacatttaaaatctgttgaatttaaatttactacagttttttttaaagatcatgctatccttcagtcagtcttgcagcaattttccaactcaatgtagaactaccaatgaaaagtgn

SEQ ID NO: 13557 - DNA, 331 bp, Homo sapiens
tgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcaaattaaccttgaaatatatttgaggattctctcttgttttaattaacacttgtgttggtaattaatagaaattcacctgtcttccgtatcagatttctgtataagcagttatgctctggagctctgccaagccaatgattagtacagattcagtc

SEQ ID NO: 13558 - DNA, 329 bp, Homo sapiens
agttttcatattccttagtgttatcacactggtgcacttactgttttaccattttcccttccgatttcatttttctgttagcatttactactatctaacatatattttactcatttgtctgtgttccccatcagaatataacttcatgaggggagggattttctattacacttagtgaaaagtaaatccctcaagtaggaacactacaagtatgcacagttttttttttacagtaagtttgcttaatggctagtaaactatctcagccagtacctgagtgactattctgacttgtatcatttaacaagaaaaaaggcctggcgcgctgg

SEQ ID NO: 13559 - DNA, 301 bp, Homo sapiens
  misc_feature 301: n = A,T,C or G
tcacaatgctttatatttttcagagaatatttgcattcattacatcaactgcaattcatagggattctgtgagctgatatgtcattacattacttctcaggtgaataatttagtggacttattaaaaattagaaaaaattagaaaccaggcatggtggctcatgcctgtaatcccagcactttgggaggctgaggcgggtggttcacctgaggtcaggagttcgagactagcctggccaacatgatgaaaccccatctatactaaaaatacaaaaattagctgggtgtgatggcatgcccn

SEQ ID NO: 13560 - DNA, 328 bp, Homo sapiens
gaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaa

SEQ ID NO: 13561 - DNA, 326 bp, Homo sapiens
  misc_feature 326: n = A,T,C or G
ggacgttgctgacggctagtgaggctttagcccgcttcgagcgcccgggggcggtaaggcgcgatcatagcagctctaggtgaccttggtccggctccttgcgcccccttgccccagcctccttcgttgagacactatttgttgagtctttcctcttttcctggccctgacctagcgtggggcgacataagagcaatagccgggtgggggctgtgagaacggctggggttgggagcgaatttcggaaacccggaggacgagtatagccttgcaagatggaaaatgccctcccgggctggcgcggtggcctgtaatcccacctactn

SEQ ID NO: 13562 - DNA, 324 bp, Homo sapiens
aaaaatcctaacggctcaaagaagtttgctaagggtcaggaagcaggggatacacgggcctctcctacccgtgtaggaggcaggaagggtcaaagcagaggccagctctcccagactgtgggggaagggctgggggggggaggcccacgaggactggccacagccaccatgcaggaacgtcctggtgtggcctggcctggctctcacagacccaaagcttccgtggagaatatgtctgtggttattaaacagacaggcctagtggaaacaaccctgccacctgcgtgttctctgagcctcagtttctttctttgggaaagagga

SEQ ID NO: 13563 - DNA, 319 bp, Homo sapiens
  misc_feature 319: n = A,T,C or G
ttatgcggctgattaaaacgtcctaaacttagattgtggtgatggttgcaaaaccttgtgactacattaaaaagcattgaattgcacactttgggtgggtgaactttatggtatgtaagttatatctcaataaaaaattttataaactggtttattccaatggtagactgaaacaaaatgaaagtgtaacatattttgaacttcaattgaattataaggtcttttttttacatgataaaataatgtgcattatagcccaaatgtaatacattattcaatgatatatttccaagaatgctccttagctcagtgaatgagn

SEQ ID NO: 13564 - DNA, 318 bp, Homo sapiens
ttttagtgtagtagtcaaagcattaatttctcacattgcaatttccttcaaagacataaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgacctcggttcactgcaacctccacctcccaggttcaagcgattctcctgtctcagccccccaagtagctaggactacaggtgcacaccaccatgcctggct

SEQ ID NO: 13565 - DNA, 322 bp, Homo sapiens
  misc_feature 322: n = A,T,C or G
gatgctttgtaccagtaccaaaatacaagttcaatgaatgacgcagcagctctgagaggaacataaggaaaacacccaagccggagtctctcacaagcttgaatgtgtgttctggagctgaaggatgcacggttgttaagcccctgttcttttccgttgtttaatctaatgttctttggaataaaaacctccctgccaagtagtacttggttttatgctcaacatgctttgactgttgaaaagagacctttggcacacattgaagggatggtgatggagatgccaatccatggaatcaggtggcacagctatgttggtagcn

SEQ ID NO: 13566 - DNA, 318 bp, Homo sapiens
cttgagcacgcacacaccacttcttcaatgggtgtgaactagtgcatggttaaccttgtaggtgacaaaaaggctttgtttgtctgcatgatcatctctgggaagcggccagcgctctaaatttgaatgaggatcttcactgaagctcatacttataatcaaggagatcactgctaagaacgggaatttgtcctgcgttctgggactaacatacagagagcatctgatttcagtcacggtttgccactaccctataatgagagcagtcttatgttataaaagaacgaagccaactatattctctgacggataaacatt

SEQ ID NO: 13567 - DNA, 317 bp, Homo sapiens
caaaaataaaataaaataaattagctgggcgtggtgacgcacacctgtagtcccagctacttcagaggccgaggtgggaggatcacttgatcctgggaggtggaggttgttgcgaactgatatggcgccactgcccttcatcctgggtgacttagtgatacccccagctctaaaagtcttcatgtataccttatctaggatgaatggattcttatgcatactgggcatacatgtagagctttgccgcattgacctattgtttacgaatctaatacacgatgtggatcctggggctgaacacttaattgattagggag

SEQ ID NO: 13568 - DNA, 323 bp, Homo sapiens
gctcataaaactgctgataggaaagagttataggtctcactgttcaagaggcttgggttttaaagtcatattagcctcaagagataaggtcttggggtccttaagagtccagtggttagaaatgagatgtctgcagttagacctcttaacatcatcacggatatatttgtgtttaatcccagcactttgggaggccgaggcgggtggatcacctgaggtcaggagttcaagaccagcctggccaacgtggtgaaaccccatctctactaaaaatacaaaattagctgtttgtggtggcgtgcacctgtaatcccagcaacttg

SEQ ID NO: 13569 - DNA, 320 bp, Homo sapiens
gttcaccatgttggtcaggctggtcttgaactcctgacttcaggtgatccacccgtcttggcctcccaaagtgctgggattacaggcgtgagcccaccgcgcctggcttcggaattgcatcttaatctctgtggcggctgctattttgttttctaagttcatgagcacaggtggctgcctctatctttctcctccacttaagcaggaacaattcatgaggcagactccacccaatgctgcaaatcggccctattatcattgaccctgacagaatttcaggagtgtcaggccactccatactggaaacagtacagggttgt

SEQ ID NO: 13570 - DNA, 318 bp, Homo sapiens
gatgctttgtaccagtaccaaaatacaagttcaatgaatgacgcagcagctctgagaggaacataaggaaaacacccaagccggagtctctcacaagcttgaatgtgtgttctggagctgaaggatgcacggttgttaagcccctgttcttttccgttgtttaatctaatgttctttggaataaaaacctccctgccaagtagtacttggttttatgctcaacatgctttgactgttgaaaagagacctttggcacacattgaagggatggtgatggagatgccaatccatggaatcaagtggcacagctatgttggt

SEQ ID NO: 13571 - DNA, 317 bp, Homo sapiens
  misc_feature 317: n = A,T,C or G
ccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggn

SEQ ID NO: 13572 - DNA, 346 bp, Homo sapiens
taccgctgcgagaatacgacagaacggccatctttctaccatatgctagtaatatatggctggaatgctggtatgggaattactcccctctttgctgaaatagttcatctcttgtgtccttttcccctttttattcttctattcttcttagcctaagtgatggctgcgattggattcacaaggttgatattcctactcggctcatgtccacccacaagcagagaggagcccatcatcatcatttgttctgaatctgaatcccaagcacgaaaaataactccaaggctcttacttaagcttgcgagtctgctctgtcatgcggagagtccaccaccctgactggatg

SEQ ID NO: 13573 - DNA, 322 bp, Homo sapiens
tagttgatgtgcccatctgccccacctctgcctggctgtacttgtagctagtacatgtatactatatatgtgcccgactgtttcattgtatgttccaggatggtcatgcctgagttttttttttttttttgggggggggtattctactttttttgcccgctttgaagtgcggacccataataacgttttaaagcctcaaaattttaaccttaaggggattaacctatttaatccttttggtttgtgggtgcttggtacctgccctaccaggcgggggaattttttaaaaattttttgaaaaaagggaattttaagttcttct

SEQ ID NO: 13574 - DNA, 316 bp, Homo sapiens
aagttgacctcatcacctcagaaaatcagggataaaatctgtctttatattgtttcagggacttgggtatcagagacattatttgtttatcaagacctaacaaaacactttcttattctttaaaatttctgtgtgtgtgtgtgtgtgtgtgtgtgtgtgtgtgagaatattattacctttcacagagctcttttttaaaccttgatgtggaacgcacacagtgtgacaccatgtgtgcgccccttcacactcgaaacgcttataggattcattcagactctttttaaagcacaacattggggcagagaaagccacc

SEQ ID NO: 13575 - DNA, 289 bp, Homo sapiens
tcacaatgctttatatttttcagagaatatttgcattcattacatcaactgcaattcatagggattctgtgagctgatatgtcattacattacttctcaggtgaataatttagtggacttattaaaaattagaaaaaattagaaaccaggcatggtggctcatgcctgtaatcccagcactttgggaggctgaggcgggtggttcacctgaggtcaggagttcgagactagcctggccaacatgatgaaaccccatctatactaaaaatacaaaaattagctgggtgtg

SEQ ID NO: 13576 - DNA, 315 bp, Homo sapiens
tagtcccttgttctgaacatggtactgaacgtaaactttgatgtattgatgccctccagggctgtaaaattgtgtggggtttaccttattctttcactgaattttaccaaccattttgccagagtgtttggcgctgacattgatattctcgggcctcttgaagtgtatagagccctttgcccccaggctaacatgccttacatggctgtactgctctgcatagtgcttttcctgtgccctcttgtgattgcctctgttctctatgggcactcctcattcttgttggtggctaccttttgtcccaacaacctgacg

SEQ ID NO: 13577 - DNA, 287 bp, Homo sapiens
tcttgggcgccttctcccaacgtccctgccatactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttc

SEQ ID NO: 13578 - DNA, 207 bp, Homo sapiens
cagggcagcctgcaaccacacaggttgcatcccatgaagctggccccggatatgtgtgacttgctgtcacttttggcttcaacaacagacaacttgactcaaaatggcttgaggggacttactacttcatgccaagagaagcctggaggtagggcaggtccagccacggttggttaaaattcagctgccaaaccatgccatgaaggg

SEQ ID NO: 13579 - DNA, 319 bp, Homo sapiens
gagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgtcttgcccccacccctccatcaaactgaagcttg

SEQ ID NO: 13580 - DNA, 315 bp, Homo sapiens
atttgcaaattttggggctgcatgtgaggctgggaaggttgacccagagcttctaaagtacaaaatgaaatctctcacaacctgatggtatttggatagcatatacccaccagaggaacaggcttttatctagcataccacaggtctcccctttagcacatctgtgctcattttgaaactgtatagggaaggacattaggtggctgggagaactctgaaggacagacctggatctcctgccaccttccaaaggtgaaacaacaaaaatccgccaggctttcagtcagaagcccggaagggccactcccaaggaac

SEQ ID NO: 13581 - DNA, 323 bp, Homo sapiens
aagttttggagaggggggggtctcactatgttgcccaggttggtcttgaactcctaggctgaagcgatcctcccaccttgacctcccaaagtgctgggattacagttgtgagccaccgcacccggcctagtctttaaatttagagcctcattgatataaagggcgaagaaaattaagtgttgtaaccaggtagcccggtgtccaggagaatgatggatctgtcagaaatccatgggtggtttcgagctttggtcccatcttggactcaatcgttcatggccagacgcctggcaaggagcccaaactacgccagaagtggacct

SEQ ID NO: 13582 - DNA, 219 bp, Homo sapiens
tgggtacggctcgcaaaaaccacacaaggggtccggttggaaaacaccacccaaggggtccggtgggaaaacaccacataagggtgccggtggtaaaacaccacataaggggacgggtgggataacaccacagatggggacggctgctataatacgacagatgggcacggctgccataaaaccacataaggagaccgcctgttattagaccacataagg

SEQ ID NO: 13583 - DNA, 160 bp, Homo sapiens
gttatctgaaattcaggcactgcatgcacaaatgaatggtaggaaaattactctgaatggagaacgagagagtgagaaaccaagccaagaactcttggaatataatatacagcagaagcaggctcaaatgctggagatgcaagtggagcttacaagtatg

SEQ ID NO: 13584 - DNA, 308 bp, Homo sapiens
  misc_feature 89, 91: n = A,T,C or G
ggaagttagtgcttaagggtaatagacttttttcttttcttttctttttgagacagagtcttgctcttttgcccaggctggagttcagngncgcaatctcggctcactgcagcctccgcttcccaggtgcaggcgatcctccttgctcctcacaggggaggctaggcaggataattcgttttccaggagccctctcttgggggaaacacctattttccccttaacatttgggggaacaaaaagggagttcccgttaaacattgttgcgtggggatgaggcgcccacattggctcccttaccctccgtg

SEQ ID NO: 13585 - DNA, 310 bp, Homo sapiens
aaatgcctgcagggacccccggactagacagccctcagccttcatggggccggggggcagtgggcagctgctcttgaacaacaggcaattgttaccttgcaagaaagcaggctcagcgtgtcagacactcctgcttttcaagagaagctggaagttcaggaccagcctggccaacacggtgaaactcgatctctactaaaaatacaaaaattagcggggcgtggtggcgcatgcctgtaatcccagctacttgggaggctggggcaggagaatcgcttgaacctgggaggcagaagttgcagtgagccga

SEQ ID NO: 13586 - DNA, 311 bp, Homo sapiens
ccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccggga

SEQ ID NO: 13587 - DNA, 261 bp, Homo sapiens
agacaaaactattattcaactcaacagggggccttttttttctatacccccagccttgtaaaaaccctttggtgggtgggcccaccccccacttagatggttgggaaaaattggtttttttggaaacttgggggcgcccttggtttttttggaccccttaataggtggcgaaaaccggctaccccccgccgtgggtttcttttttatttccagggctcgggggggggggggggggtggatcacctgagatcaggagttcag

SEQ ID NO: 13588 - DNA, 310 bp, Homo sapiens
ccaccatgactggcaaattttcgtattataagtagagatagggtttctccatgttggtcagactggtcttgaactcccgccctcaggtgatctgcccgcctctgcctcccaaaatgctgagattacagatgtgagccactgtgcccggctgcctgagacattttgggcaacagccgtgacagaagaaacgtgcatcccttctgtgcaggggatttaagaagtggctcatggctgattatgatttctttgctccgtttctggaactgcgggagcatcttctgggataagggtctatctgtttgagtctctg

SEQ ID NO: 13589 - DNA, 307 bp, Homo sapiens
tgagcagaaaaggatagagtgtgacctgccaagagatactggacagtggcctccactttgtgtacccgggttggccattctccttatcggcacagtcaggataagaaaactctaagtttattcggatcccttggaggacacttctacatgggaacaattgcagctgtcatcttggactttacttcccagccaactcagtggggaaagaggggagcattctggggacctctgtagaggggcttcaacctggatagattcccaatcagagtgaagttcaacttcctccaggatatttcctccccctggg

SEQ ID NO: 13590 - DNA, 303 bp, Homo sapiens
ggagcctttgactatgctgagcctcacagtattccaggaggggtatagtaagtaacagctggttctgggaccacttttgctcagagcattctgtggaatatgggtctccagaacattctctgagaactattactcaatctatttaaacacacaaatataactctgtataagagggaggacactggctggccgtggtggctcacacctgtaatcccagcactttgggaggctgaggtggacagatcacttcaggcctggagttggagaccagtctggccaactctgtctctactaaaaatacaa

SEQ ID NO: 13591 - DNA, 295 bp, Homo sapiens
cattacgcccacactctgcaactaacagaaatatctcctctcccctgtatatgttaggaccaagaataaaatcaaacatgtggaggacatgtcagctagcctgggatttccaagataccccggttggtaagaactacttggggtgccctcatctggagattctggcttagtagatcagaggtgggcctgataatttatatccatgagcataccaggtaattcttataactaagcgagttttggaaaacacagggctcatctaggccagcaaaggtttcctgtcccagagtgggca

SEQ ID NO: 13592 - DNA, 304 bp, Homo sapiens
tgatccatccactgaattctctcagagaaatgagaactcagagccataagcctgctaggaatttgcaagaatcttgggaagtgcttcataatcccccaggtgtagaatggaggttccaggcaatactctatggacttcaaaatacaggaagacctcagatgacacaggatacattccaaatttgcagaactggactcagtccattcagttgaattccaacagttttcaaatttgttaaagtacaaatattttgattcattgtattaaaaagtggttataggccaagcgcgggggtgcacactgg

SEQ ID NO: 13593 - DNA, 321 bp, Homo sapiens
  misc_feature 13, 14, 15, 16, 17, 18, 19, 20, 21, 22, 23: n = A,T,C or G
tacggctgcaagnnnnnnnnnnnggggagcttgtccttctcatacttccactgggagaactcagggtccaattaaactccagaaccaggtgagctgcaccttctcaggtatcaaaacacagggcccgccaggcacggtggctcacacctgtaatcccgtaagtttgggaggccgaggcaggtggatcacctgaggtcaggagttcgagaccagcctggccaacatggtgaaaccgcttctctattaaaaatacaaaaaattggcctggcatggtggctcatgcctgtaatcccagcactttgggaggccgaggcgggcggt

SEQ ID NO: 13594 - DNA, 286 bp, Homo sapiens
  misc_feature 286: n = A,T,C or G
tgaatattttgatcaatgaagtcatacacttaacaatagctatcaatattgaggagctataaataaattctaattttcacaaaactcagtaaggtatgtaatacaacctccgctttacaatgagaaaaataagtcttactgattcgttgatttaatccatatcagagttaataacctctttttcattaaaattggtcctttagaaacacacctgcagctgggcacggcggctcacacctgtaatcccagcactttgggaggccgagacgggcggatcacctgaggn

SEQ ID NO: 13595 - DNA, 284 bp, Homo sapiens
tgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcaaattaaccttgaaatatatttgaggattctctcttgttttaattaacacttgtgttggtaattaatagaaattcacctgtcttccgtatcagatttctgtataagcag

SEQ ID NO: 13596 - DNA, 267 bp, Homo sapiens
tccaccactcccacacagcatgcacacacggttggacctgagtgctcctgatggaacccaggctgctctgtgccgctgtaggatatccccctgcttaaggactttcgtttcatctcagaccacatctggccccgcagttcctctgatagtttcccttctgtatcactgagcacatttggggcagctcgtccgtgagcatgcagtctgcacgtgtggggtgagggtggggcgcacacaggctgtgcctgtgctctggacttgtacaga

SEQ ID NO: 13597 - DNA, 465 bp, Homo sapiens
  misc_feature 46: n = A,T,C or G
ccttactcagaaaccacacaagcttgcttgttgtgtttggtcgaancggcctaccgttgcgctaatacaacagaagggcatctctcttcatgaagggcacatacacacacacagttaaggtgctgaggaaactgggagagccaatttgacctggcctttattttgcacaagagtaactgaagcttcaaatacaatgtgtgttacataggaaccaattatgtatgtaggattaataaagataggagacctaaggccatttacatgagggcaagaatagtaaccttttgatccagagaggtagtttaaaaaatagtaaggtgttaacatatacaaataataaagttggggctttaaacatttgaatttgaaggctctgagtcatgggattaactttgtaccccagggcacagggaaaggctacccttgtgcataaggtattgaggaagcttcctggcagtaattccc

SEQ ID NO: 13598 - DNA, 417 bp, Homo sapiens
ggcacgaggcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttttctttttttttttttaaattaaaaaaggaaaagggggggtggggaaaaaacctaaaacaaaaaatgggcattagggctcaaagcacccccaggaaggggcccatgtttggggggagcaggggcttgttgaccccacctgtttttgttttggcacaaaggtttgg

SEQ ID NO: 13599 - DNA, 397 bp, Homo sapiens
  misc_feature 34: n = A,T,C or G
cgttgctgtcgcaagtttgaattgtgatgacggntgacgtttgctgatttttgactgtgcttgtagctgctccccgaactcgccgacttcctgtcggcggccggcactgtaggtgagcgcgagaggacggaggaaggaagcctgcagacagacgccttctccatcccaaggcgcgggcaggtgccgggacgctgggcctggcggcgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatcc

SEQ ID NO: 13600 - DNA, 394 bp, Homo sapiens
ggcacgagggacccatttctaggattctaagatgtaagatttcttaagttctttatcttagtctcatgcattctccacatcacgcgctgtaccatactgtgtagtcagaacagacagtgtgattgaaaagctttggaaaaagttaacacaaaggattatttagcacataggctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggt

SEQ ID NO: 13601 - DNA, 377 bp, Homo sapiens
attatgggcgtgagccaccatgcccggactctacatcagaaatttcaaaaggaatttcatagttacaagttcttcatgagaacaatagctcccagaaaacaccttccttggttccaggtttacactgaagtttttcttttttttttatttcacaacacagattctaggatacactgaagtattaagaaaaatcggggccaggtgcgggggctcacgcctgtaatcccagcactttgggaggcctaggtgggcagatcacctgaggtcaggagttcgagaccagcctgaccaacatggagaaaccccgtctctactaaaaatacaaaaaaaaattatccaggcgggggggcgcatgcctgtaatcccagggactcggg

SEQ ID NO: 13602 - DNA, 401 bp, Homo sapiens
ggcacgagccgagctcggaggcggtcgtgcggcgcggagtcctcctggatcgtggcaatgggcagacacagagcagaaagtggcggacttgggcggccacaggtaactttctcgcaaggagctgaattctttcactaaagggtacaagcccgagggacgagctgcgcgatgattggctggggagctccctcaggtgagctgccattggcagaggcgcgctcaggtaaggcccttctccaagtgcaggtaactcactccgaagtttacctgagtggagcggcggcatgcttgcagctcggcggcagcctgtgagagctgagggtcagttcttcgagtagatctcaagctgcgttttcctccttctccaaagcagggatgggaaggtggaggctactggttgg

SEQ ID NO: 13603 - DNA, 392 bp, Homo sapiens
  misc_feature 392: n = A,T,C or G
cgttgctgtcggctcaacaagcatcctagttaaagggcttatcttcatgagtaggtgacaccacagacatggtgcttacttcagaattagctctattattttcagaacattgcttaacatgttggttgagtccggcagacaaattaacatattcttgtgcataaaaattagaacaaatttggtatggccagtggaaactatggagtccaattgctttttaatctaattttgatttaagtaaatgcagttatacagaggttgcaaggaacagaattgtttttattttattctattaagtcatggtataacatgtatttaaaagattatctgtcttaccaaatgtacaatttttgtacaattattggccttggaagtagagatgacagaattcn

SEQ ID NO: 13604 - DNA, 383 bp, Homo sapiens
cggctacctgctgacaggattgcctgatgtcaacgtatctgtcttgctaaatgtccttacattgacagctcttatattgttcataccatccattacataaatatccaccatcctattatttggtattaaaactcttcctcaataagaactactttcctggagcatttctgtgtgcctctcctggtcatactaagtgcatgtagctttctgcttacgagggtgagcatttcctatccctgctgctgtcttcacagcacttaccccacagaaagatctcaggcactgacaagatatccaatctcaatgctatgttgtatcaagcctcatatattgataaaaaagtcttagtggcattaattctaaataaattactattccacacg

SEQ ID NO: 13605 - DNA, 404 bp, Homo sapiens
cttctccatgctcggaataacttcctgcatcgttcaacaggctaaagagggggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagcctgggtttcatcaactgggatgccataaaccaggacct

SEQ ID NO: 13606 - DNA, 390 bp, Homo sapiens
ggcaccagcaaagaggaaacagtttagttttagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattacgcaagatgattcgctgggaggactatgtgcttagactgtggcgcaaatactcgaataaactacaaattttaaatagcg

SEQ ID NO: 13607 - DNA, 400 bp, Homo sapiens
cgttgctgtcgcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctatgccgaggggaaacacctgatagcagaagaggcctggatgcacacctggcacgccgaggctctccgcccaga

SEQ ID NO: 13608 - DNA, 356 bp, Homo sapiens
cctcagcctgctgagtagctgggattacaggtgcccaccaccacgcccagctaatttttgcatttgtagtagagatggggcttcaccatcctggcccggctggtctcaaactcctgacctaaggcgatctgcccgcctcagcctccctgagagctgggattaaaggcgtgagccaccacacctgggcaccttatttttttatacggctctactgcatacagttgaataagaaaactattcctgtattgctgcactttcacactgcttcaaaatcggcctaggagaaacaatgctttaattgcttcgggtgcatttaattcctagagccaacgggcttggccaaaggcaacctaccc

SEQ ID NO: 13609 - DNA, 351 bp, Homo sapiens
  misc_feature 351: n = A,T,C or G
caaactcccaagcacaagtgaatcatgggtcagtgactcattgtgtgaataggggcacagagaatccctaaaccattgcttttcatatcaggagtccaacagtctttcaggttgcccctgactgagggctttgagtatttagtggagttttctggtaaatcatagctattctaatttaggtttcagcccaactagatgcttcctactatccctggtaaggaatggaactggctcacagtaaatgtagctgtttagtaatagatgcagatattcttattatcctctctagggcttctattctgatttcttatttttaagattaagaatttaatggctaaaaaagctaagtgn

SEQ ID NO: 13610 - DNA, 381 bp, Homo sapiens
cgttgctgtcgaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggggtttttttttgttttggtttttggttt

SEQ ID NO: 13611 - DNA, 344 bp, Homo sapiens
  misc_feature 344: n = A,T,C or G
ggtccagtatgtagcgtaacagccttccaaccagttagagccagtgctctggttggccattcttgctttattgcctaccctggagttagattagcgggtgaggggagatcacttttatctagactgcaggaactgagaatgggtgaggggtgattcccaaatagaaaatgaaggttctgtttatagaagaataagaaactatgtttgtctggtaaaaatagcagttgtccattctatcagttttcattcccatgttacagaaattcttaccaaacaggcttaaatagtaagcgaatgccttagttcatttcactggcagttcagagtggggggagccctggggn

SEQ ID NO: 13612 - DNA, 374 bp, Homo sapiens
cggtgctgtcggaacttttcaacatattgacacccagcgtgtattacaaacgaaacagggacagatgaaggcctgcatttgcctgaacgctatagtttgttgatccctaactagtaaatggaattcacatataaccacatggactttgcactgcacagaaaaagtcagtttggggagaatttcagacttacatgtgaaggacagatgtcaattttcatttttattttatttttgagacagagtctccctctgtggcccaggctggagtgcagaggcatgatcttggctcactgcaacctctgccccctgggttcaaacaattcttgtgtctcaacctcctgaaaagctgggaataacggcgggcacccaccacg

SEQ ID NO: 13613 - DNA, 373 bp, Homo sapiens
cgttgctgtcggaattgaagcccaggtgggtgtccaatgccagaccatggatcatcagcctgggacaccaaagtgccacactctcagagtgaggatgatcctcaggaagtcagctctaccaccctccacaccaggaagtgcaagcagactcacctcatgattgagcagaataagagaatccttgagaagtcataagtttgcatggatttgcagcacaagttcaaacaactagatggcaccaaatccctcaatttatgaagacatttaacgtggtacccaattggaaacgcctcatggcagaaacaaacataaatcctttctagaaggttgccttgtccaagtgtttcccaaaccagtttttttagggaaaatg

SEQ ID NO: 13614 - DNA, 350 bp, Homo sapiens
  misc_feature 350: n = A,T,C or G
aagctcctgtccccgaacaagaagcagaggaaaaaccacactagcaagctgcaagagttggcactgctgctgcccatagccctgaagacggggaccaagaagctcacaaaggtacagggactagaggagaggggccagatttgggacgcaggtctttaaatagcagcaaatgggtcaccctctcctgggaaacctggacagatcctttcagtggcagcattcaaatgggaatggtgctactctgaacgggaatttccgggagtctgtgatcccataactaggtgcctggaggatcctttttttgcaaaggagagaggagaaaccgggctggggaaatagagatagcacan

SEQ ID NO: 13615 - DNA, 361 bp, Homo sapiens
  misc_feature 291: n = A,T,C or G
cgtgtctgagctgtgatgacgctggccttgtgtttcgtcaggtggtgtccacaggtgccctgctggttgctttttctctgccctgggagaggctcgctgaggctgcacggctgcctgggagaggctcgctgaggctgcacggctgcctgggcggcctctgacgcgccctgtggactgcagcatccaggggatcgcgtctgcaactcttattgctttggcgtttacctattggggatttaaaaaaaaaattgttcatttttataaaaaagacatgggctggctgggcacggnggctcacgcctggaatcccaatactttgggaggctgaggtgggcggatcacctgaggtaaggatttcaag

SEQ ID NO: 13616 - DNA, 223 bp, Homo sapiens
ggaggtggaggttgcagtgagctgagatcatgccactgcactccagcatgggtgacagagactccggctcataataaaaaaaaaaaaaaaaataattttttgactgaaaaaatatttttttgtgtgggggaggggtttttttttgggcgcaagaagtaacaacctgtgttgggggggggttgcccacccccttctttttggagagcttgtgttcttttttttt

SEQ ID NO: 13617 - DNA, 477 bp, Homo sapiens
ttgttctttttgcaagatcccactcgattcaattcggcacgagatattaaaaggaggttagtgcttaacaagaatttaattgctctgcaattcatgctgtttctaaacaaacctaaactttaagatctttctaggggcagaaagcccatgagaaatacaatggaaggtaaagacaatgggacggcggaagtggttgcaccccgtgcaaccagctgcagaatgaatagggaaaacagcaaagctgtactagcctctggtttatcaactccagaccatgagaaagataactgtagatacagttacactatgacaaggctaagcacgaatcaccaacatgtttcccaaagtgggtggtggccctgaaagtgtgtttgcttgttagatggaatcaagagctaaaatcaaaggctactcctgaaccgttttagtaagacccgaggtaggagttcaaaagcctcagtctcagttcccccgtat

SEQ ID NO: 13618 - DNA, 321 bp, Homo sapiens
ggagtagaatgcttttcactagctctcaaaccttggtgtgaggaattccttggagggcttgttttaagcacagattgctgggcctactggaatcagtggttctgcaaggaggccctaaattcgcctccctgacaggttcctggcagatgtgatgctgcctgaggcctgcacttaggaccactgacatagccaactagaagaaacatgggaaggctggggagtctctccctgtagtgagccctcaggaggaggattagaatgggggcactggaggaccaggcgcggtggctcacgcctataatcccagcactttgggaggcg

SEQ ID NO: 13619 - DNA, 434 bp, Homo sapiens
  misc_feature 25, 26, 27, 28, 30, 402: n = A,T,C or G
cacagcacttgtcttttggcggatnnnntngagtcgaattcggcacgagatgccgtggtggagaacacacctgtggctatcttatgtgaggactagaggtgaagaggagatggacactgcctctggagccagcctgacaccaaggacagcacttgtcatcatccctatcctcgtcagccccaccctgctgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcanagagagagagaccgaaagagagagagagagac

SEQ ID NO: 13620 - DNA, 178 bp, Homo sapiens
  misc_feature 92: n = A,T,C or G
acgtttagccctgaacaggagccaccatgcattgcttcagcttcattaagaccatgatgatcctcttcaatttgctcatctttctgtgtggngcagccctgttggcagtgggcatctgggtgtcaatcgatggggcatcctttctgaagatcttcgggccactgtcgtccagtgccat

SEQ ID NO: 13621 - DNA, 442 bp, Homo sapiens
  misc_feature 334: n = A,T,C or G
tagcttttttgatgatcccatcgattcgccgatttaaggctgcaaggaaggagtcctgttattttgttttttcctgagcaaagccgttttcttcagagctgcggcagaaacggttgaagacgctggactgcgggcagggggcagtgcgagccgtacgatttaatgtggatggcaattactgcctgacgtgcggcagtgacaagacgctgaatctgtggaacccgcttcgggggacgctgctgcggacgtacagcggccacggctacgaggtgctggatgcggccggctcctttgacaacagtagtctctgctccggcggcggggacaaggcggnggttctgtgggatgtggcatcagggcaggtcgtgcgcaaattccggggccacgcagggaaggtgaacacggtgcagtttaatgaagaggccacaggtattctgtcccg

SEQ ID NO: 13622 - DNA, 413 bp, Homo sapiens
cgttgctgtcggtccctttccatcctcttctccctgcttccctcccagcctctggcaaccactattgtcttttatacttccatgagatcagcttttaaattccataaatgagtgagataatgtgatacttgtctttctgtgtatagcttatttcacttcacataagtccttcaagttcatccatgttggactaaataacagaatttctttttttttttaaggacaaaaaatatccgaaacaaagccaaccaatccatgacccaaagttggtgctattatatttccattgagaggggattatctcaaagtctaggttaagtccttgttccaaattaaaatctgaaattggaaggggtggataacaactagaaatatagtggaaaagaagctcctaatatggactccattcatgg

SEQ ID NO: 13623 - DNA, 167 bp, Homo sapiens
aaagcacatttcacttatatgtccagtatccccaatatctatgactttaaaagtcctgcagaacaaaggctattaccgagtgctcagtgcctgttcttgagatgcttcacattgtggcagtctcagaaataaacgttttttaactgagagcttttgtttaccatgag

SEQ ID NO: 13624 - DNA, 238 bp, Homo sapiens
gatcatacaatctagtagcctgttagaatatggagtatgacagacagattctggaagtcacattattagtatcaacctttagtgtttgtttttatagacactgacctacatataaataagattgtgaaatttgaaagaagtacaaaaacataacccataatcaaaagagaataagatcaatagaagaatattttgaaataatcaaaccaaacatttaaaataactatgcaaaatatta

SEQ ID NO: 13625 - DNA, 374 bp, Homo sapiens
tgtcgcgcaagctggagtgcagtggcatgatctcagctcactgcaacctccacttcccaggttcaagccattctcctgcctcggcctcccaagtagctggaattacaggcatcctgccaccacatctggctaatttttgtatttttaatagagatggggcgtcaacatctagaccaagggtgctcttgatcatcggaaatactgtgagccgtcgacaatgtgctcccagtgtgatgctattattttataaatccaaggctaagtataataattaggcttagaacacaataacacctctggccaaagtatcgtaaccccccactttactaataatctcctcagtttacagatgagccggtcctaatatccggttc

SEQ ID NO: 13626 - DNA, 131 bp, Homo sapiens
ttcggctgtgaaatgacaacagatggtgtcgggtgcgatatgacgaccgaatggttaccgctgctataacacgaccctaagtggatcgggttgcgggaaattcgactgcacagggggctggcgtttgactg

SEQ ID NO: 13627 - DNA, 226 bp, Homo sapiens
aaatacattttattttgttaacatttaagaaatctagttgcttcatgttgataatcaaataaataaacctaccaattagggctttaacatttgttatggaacatggtacacattcccattgaggtttaattgttaaggtttgtttgacacattttaagtgtttagactgaaatcttcacggtttggaaatcattgtacttctagcactggcagaagacatgtaaat

SEQ ID NO: 13628 - DNA, 414 bp, Homo sapiens
cgttgctgtcgaatcagctaagggattgtaatttttaattcttttgaaaaataaatattgtatttaaaagacgttatttcacagaagctaacaaagagaccttagataacatttgtttggttagccacacggttgagcacaaaacaatgtgtagatgtgttgaagattagggcaggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattaagcatattttctttttttttttttaaaaattaacactctttaggccttctatttttccgtgtt

SEQ ID NO: 13629 - DNA, 406 bp, Homo sapiens
cgttgctgtcgaatcagctaagggattgtaatttttaattcttttgaaaaataaatattgtatttaaaagacgttatttcacagaagctaacaaagagaccttagataacatttgtttggttagccacacggttgagcacaaaacaatgtgtagatgtgttgaagattagggcaggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattaagcatattttctttttttttttttaaaaattaacactctttaggccttcaatttt

SEQ ID NO: 13630 - DNA, 400 bp, Homo sapiens
  misc_feature 400: n = A,T,C or G
cgttgctgtcgctgaaataccatcagaggcccaggaggggctagttgtaactggcaaatatagtaaattaatttgctctggttgataggtagcaagcagggtttatatacattgtcacctacttttccagttaacaggagagactggagattttatgaaatttgatatttaaatgttggtaactgggttgggcaccatggctcacacctctaatcccagcacttcgggaggctgaggcgggtggagcacctgaggtcaggagttaaagaccatcctgaccagcctggtgaaacacagtctctaataaagatacaaaaattaggccgggtgtggtggctcatgcctgtaatcccagcactttggggaggccaaggtgggcggatcacctgagtcaggagtn

SEQ ID NO: 13631 - DNA, 409 bp, Homo sapiens
cgttgctgtcgcaaggatctccattctccctgtctggatacttctttggcagagatatgtcctttaggaaaaaatctcagctctaaagttaattcagacagcggtattccaggactagcagccagtgccttacttgtgagtcacggtgcttacatcagaagcctgtttgactattttctgactgaccttatgtgtgccttaccagccactctgagcatatatgaacgtatgtcagttactcccaatacagggatgagtctctctatcatacactttcgtgacggaatgagaagttaaaccaacggttcagtgtattcgtatgaacctacaggatcatcgaaatggactgactgatactcgctgcggataaatctgcatcactatctaaccattttgagcctctgaaggg

SEQ ID NO: 13632 - DNA, 386 bp, Homo sapiens
  misc_feature 386: n = A,T,C or G
atttcagatggatagtagttcaggtacattactggtacagtgtgctcaaacgttttccccatgattactaggttcttgtgatatctggtctagaaacacagccatcatttataaatctgtgtgtgtgtgtgtgtgtgtgtgtgtgtgtgtgtgtgtttcttttaatgggagaatgtgatcagagttctaaaaaactgaaataaaagtgcgtttttagaatatgacttattttgtaaattttagatagattatagagtgactactataccctttttcagagcagaggaagagaacccatttaggcatccgtttaaaggagatttggtgtgatgttcttagggtcttttatctgaaagatgaactgcggctctgtctattatagatan

SEQ ID NO: 13633 - DNA, 406 bp, Homo sapiens
cgttgctgtcgcagggttttgctttgtctcccaggctggagtgcagtgatacaatcatagctaactgcaacctccgcctcctgggctcaagcaatcctcccacctcagcctccccagtagctgggatcacaggcatgtgtgaacatgcctggctaagttttcatatttttttgtagagaaggggtttcgtcatgttgcccaggctggactcgaactcctgggctgaagagacctgcctacctctgcctcccaaagtgctgggattacaggcatgagccacccagagccaaggtctcagtcttttagtgagcttgtttatggattttgaactatatcctgtttctcagcgcctcacccccaggatggcttgaatgacctgtagttgggtatttcccttacctcatgt

SEQ ID NO: 13634 - DNA, 376 bp, Homo sapiens
  misc_feature 376: n = A,T,C or G
gtgctgcatgtttaaagtattccctctgttttacttcatgatagttggcccctttcaggttataacacggacatttttctatggttttcattatttgcacatgccaacagagtagaatagatttttaacgagcatcacttcattgcaagcaaatttattaatccagtggtactgatgaaactaaggagctctttggggtcaggctcgatggctcacgcctgtaattcttgcactttgggaggctgaggcgggtggatcacaaggtcaggagttcaagaccagcctggccaagatggtgaaaccctgtctttactaaaaatacaaaaaaattagccgggcatggtggcgggtgcctgtaatctcagctactcgggan

SEQ ID NO: 13635 - DNA, 140 bp, Homo sapiens
tactgctgcgagatgacgacacatgggtacggttggtagattacgactgaatggtactgttgcgtatcttacaccttaatggctcgtgctgtggtgaatactactctacagggaacctgttggcgtatattcctcagatg

SEQ ID NO: 13636 - DNA, 137 bp, Homo sapiens
tgggtacggttgctataagacgacaaattggttcggttgtgtttagatgacagatgggttcgtgttggctattaatctcaccaatgttttcttgttgttttatactgacgtaatgatcattttttcggttatctgcg

SEQ ID NO: 13637 - DNA, 398 bp, Homo sapiens
  misc_feature 398: n = A,T,C or G
cgttgctgtcggggagatcggaagattttttctctatctggactctgctggtgtgcctgttgactggcactgggggaaagtcgtctgaaactggggcctcagtttcttaaggaggttggtttgaatcacaatcttcaaatatagggggatctgagggtacaaaaagggtctgtgcacctcctgaaatagtatataccattgtgtgtgtgagcaaaaatgtattccaacccttcccacgcccgctcgaggtccacagtttccatcagattatcagtaaataggataccaaatgtagtgaaaagttaccattacatgccaggcgcggtggctcacgcctataatcccagcactttgggatactgagggcggcagatcacttgaggtcaggagatcaaaan

SEQ ID NO: 13638 - DNA, 209 bp, Homo sapiens
aaatacattttattttgttaacatttaagaaatctagttgcttcatgttgataatcagataaataaacctaccaattagggctttaacatttgttatggaacatggtacacattcccattgaggtttaattgttaaggtttgtttgacacattttaagtggttagactgaaatcttcacggtttggaaatcattgtacttctagcactg

SEQ ID NO: 13639 - DNA, 405 bp, Homo sapiens
tgactatgttttatctacactaaaacccttgcagttcccaatctgctcgttgtagtttaaaactttcacgcttcgttaatgtcactgcctctgtcatctttgaaaagacgatagttttgtgcctgctgaacatatatgaaatgcatgcaaaaagagtttgttgaaactctttgttacgacttgctcttcccgcttcacattctacctggcctctaatttaatattaattggtttggaaatcagagtcaacaaaaagacccacaagacttaatggggtcccatcagtcatcataatttgatttgaaaggctgaaagcgggcagcactgtcattcatagccaaacagtcctattgagaggtcttggactatcatgccagctgtcagaccactccatgcactgggtgg

SEQ ID NO: 13640 - DNA, 398 bp, Homo sapiens
cgttgctgtcggttcaggtcactgaaagcaaggaaagcctgataaactgccacggccacgaggagtctaaggacacatccaatttccattcgcatccaaaatggaatccgagacagaaagaggaccttagccttcatatctgtttttttcttatgaagcttcttctggttggaaacttgtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaat

SEQ ID NO: 13641 - DNA, 325 bp, Homo sapiens
  misc_feature 301, 303, 304, 311: n = A,T,C or G
gagtgtgactcttaaaggcaagagcatgtatattatgccaaagcagcctgaaatattttattcacagacagacagacaatgcttgactccctgctaatctgaaatacttcgtggggagggccagggaaatcacaacaaaatttcagaagtagaatgagctatttggtgtatgtctcccaggccaataaataacacgaaggaagaataaatttctttgctaaccacacgaaggagaaatacacttttttgctctaaaatattttccaattatctccacgacactggagggaaggactatcancnngtacatnaatgtgaggaaggg

SEQ ID NO: 13642 - DNA, 405 bp, Homo sapiens
cgttgctgtcgcatggagtcttgttttgatgatgacagttttctgtaactacagcttggaaactatgcaaatggtctagattcctcatagctcacatgataggatataggtagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaaacatagctaggtaagatttttatcac

SEQ ID NO: 13643 - DNA, 403 bp, Homo sapiens
catcgattcgaattccgttgctgtcgcttagtcttcatactgttttaaatgcttatttacttatccttattccccatttaggctctaagcactaagtgggtactgcaagtgctcaaaaattttggttgctagaaatagtagtgttaagtcaatgagaaatggtcttaaaatatagacccagggcagatcttttcccacctcagtacaatgagctgtcatgtgccttacttgactgggaatctatcacaaatacatgtgcagacatttctagtttagataacattaaaaaaacatttagcgaacagtatgtattctgctccctccttatacatcttgcagtacattaaggatttccagttttcctttccctcaaacagttgcagaaagtcagtataagagtgtt

SEQ ID NO: 13644 - DNA, 371 bp, Homo sapiens
gagatttgttacgtattttagacatcttctaagtaactccacagaagactctcaaaacaaaagcgtgacctcaacctgcctataggtgccctagtggagaatgcttgataccaggtgacaacccccacgcgccccaatagtgcaagaacaaagtggaggccagagaaggggctggtagtttcttcttagttctcagaaggcttatctgatgatccactcacctctccttccaccttaagggaagaatggaagataataagcaaaacttctagaaagagcaattagcccttcaacttctaatatccaggtgggtcagttcccagtgagagaggtaagtgggcaatggtaagctgtgccacacaccaagtatg

SEQ ID NO: 13645 - DNA, 420 bp, Homo sapiens
  misc_feature 401: n = A,T,C or G
tgagtgtggggccctgcgtgacagccctgcccctgagtatctaatgtgtgcgttgacagccctgcccctgagtatctaatgtgtgcgtgacagccctgcccctgagtatctaatgtgactggctgttgtctcccgggatatcttccaagagacagaataacctggatctgaggataaatgccaggaggaagggagaatgtatccatggttcccatctccattagtcaaaggtacctctacagtgccttcacagcccaggcctgactgcgcctagcggctcctcagcgtttcaggctcagcagcagcagggacaccacaagtggccaggtacagcctggaacccctcccagggctggccctagaggcaggtaaagtgaggagcaccttacatggtgcataanaagtgtccaatgccagtgc

SEQ ID NO: 13646 - DNA, 417 bp, Homo sapiens
ggcacgggaggtttcagcgagctgagatcacaccactgcactccagccttggtgacagagtgagactctgtctcaaaaaaaaaaaaaaaaaaaaagccccccccctttattattataagggggccttttgggataagcccaaacccaaaaaaaatccgggggggggggcaccccccccctgggaattttttaaaaaaaaatgtttttttcggacccttgggggggggcccccttttttggtcaccgttaataggggggaaaaaaggtgttaattacaaaaagggactttttttttttttggggccttgggggaggggggggggagtttattcatgtcccctttttcttcccagaagaggaatatttcccccgctcagaaagggaatcctgcgcccttttatgccctggggggttttg

SEQ ID NO: 13647 - DNA, 375 bp, Homo sapiens
gatttgtggtgagattctctcccaggccacaagacatttcctgctcggaaccttgtttactaattgtaagtactttacaagtaagaacttgttttaaaaacttagcattcaaaaaaaaaaagctttttttaaaagaaattggattttcttgtttttttcttagcaggttatattttgagtttcagctaaaagactaaggttttcttatctaatggctttaaatttatacatttaggcaaattcaacaattttttgctaagcattttgccaaatgccaggcttttcaaagaagggtaagatcccacccttgaatcctcatcaattgctgctttttgcagaaaacacatattatacattgtatttagaaacatgaag

SEQ ID NO: 13648 - DNA, 164 bp, Homo sapiens
agtaaaaacaaaatcaagactaagagaggaggaattagaatgagactcatgtaccctccttccccactccaggggaaggagagactgtttgggaatgccctcccactacttccagggcagaggctgtgcagaagagccttggagaatctgcagcccactgatgg

SEQ ID NO: 13649 - DNA, 239 bp, Homo sapiens
atgccctctccccatgaagaatcactctgaattcttcaccactgatgctttccatccggaggtgaaacggcccagacaccctgtcccctcccctctctcactcctcttacaggcacagtgcggccctcgcatgaactccccgtcgacccctgccccctgcctgatctctatcccacgctcctctctgcgtcttctgcctacctaccgcccttccttctcaatccgccgcgcgcttcccc

SEQ ID NO: 13650 - DNA, 406 bp, Homo sapiens
gaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgag

SEQ ID NO: 13651 - DNA, 406 bp, Homo sapiens
  misc_feature 329, 406: n = A,T,C or G
cgttgctgtcgcttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccagatgaaactaagatacggtcataccctgttactgaacagagagtgaagcacaccanacccagaacataccccagtttgcttcagggtgaatataacaacagacatccaaacatcaagcaagatcagaagtccn

SEQ ID NO: 13652 - DNA, 186 bp, Homo sapiens
caacgcgtctctgttctggctacataggggggcgctttttttttttttccccacatggtttactgctctttttgtgtagttggttaaaacccctgttctttgttgggtctggataaggacgccctctctgtttggatgcttgtggcgctctacggcgggtttgttttggcgagcccttttatatgg

SEQ ID NO: 13653 - DNA, 411 bp, Homo sapiens
  misc_feature 411: n = A,T,C or G
cgttgctgtcggaattgaagcccaggtgggtgtccaatgccagaccatggatcatcagcctgggacaccaaagtgccacactctcagagtgaggatgatcctcaggaagtcagctctaccaccctccacaccaggaagtgcaagcagactcacctcatgattgagcagaataagagaatccttgagaagtcataagtttgcatggatttgcagcacaagttcaaacaactagatggcaccaaatccctcaatttatgaagacatttaacgtggtacccaattggaaacgcctcatggcagaaacaaacataaatcctttctagaaggttgccttgtccaagtgtttcccaaaccagtttttttagggaaaatgcacagcttactataaaaaaattttaacctaaacttggn

SEQ ID NO: 13654 - DNA, 354 bp, Homo sapiens
ctgggaatacaactgttccagcaaaagggcccctgtcttgggaaggcccacgctgaggaggggaggatggcccgaccttaggggacatagtcagagactatgctttcaagcctccatggcctcccttgcacggcagagaagagggtatagaaagtatggacagggagcccagtggagacggagctggccagccaggaaggacctatgtattctgggcaggaaggtgagaagggctccctactccaggcctgcccaggccgtctcctgctccaagctccgctagctgccccgggctacgctagctgccctgttgcccgcaccaccacgttccctggcgcctgcgggagggaaacg

SEQ ID NO: 13655 - DNA, 381 bp, Homo sapiens
tgcctcagcctctcgagtagttgagactacaggtgcccatcaccatgcgtggctaatttttgtatttttaatagagacggggttttaccatactggccaggttggtcttgaactcctgaccttgtggcctgcctgcctcggcctcccaaagtgttgggattacaggcgtgagccaccatgcctggactaagagtgtgtgtgtgagtatgactttctcaattcgcgtctcccctccccttccttattgcgtcatcagggtagtctttccgtaagacacgtcgcaatcaaggcggtcgagtcctagacatcctttcttccttagggcgtccagctcattgcattaacacgactatctgttttttatctacggtgcgtagaccg

SEQ ID NO: 13656 - DNA, 398 bp, Homo sapiens
ggcacgagacaaaatgggttcaccaggcttgtttacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattccctgggaggacttatgtgcttagact

SEQ ID NO: 13657 - DNA, 383 bp, Homo sapiens
gatttgtggtgagattctctcccaggccacaagacatttcctgctcggaaccttgtttactaattgtaagtactttacaagtaagaacttgttttaaaaacttagcattcaaaaaaaaaaagctttttttaaaagtaattggattttctggtttttttcttaccaggttatattttgagtttcagctaaaaaactaaggttttcttatctaatggctttaaatttatacattaagccaaattcaccattttcttgttaagcattttgccaaatgccaggcttttcaaagtagggaaagatcccagccttgaatcctcatcaattgctgctttttgcagcaaacacatattatacattgtatttaggaacagggatcattaatg

SEQ ID NO: 13658 - DNA, 405 bp, Homo sapiens
  misc_feature 405: n = A,T,C or G
cgttgctgtcggttttatctacactataacccttgcagttcccaatctggtcgatgaagtgtaaaactttcacgcttcgatgatgtcactgcctctgacatctttgaaaagacgatagttgtgtgcctgctgaacatatatgaaatgcatgcaaaaagagtttgttgaaactctttgttacaacttgctctttccgcttcacattctacctggcctctaatttaatattaattgttttggaaatcagagacaccaaaaagacccacaagacttaatggggtcccatcagtcatcataatttgatttgaaaggctgaaagcgggcaccactgtcattcatatccaaacagtactattgacaggaaatggactattaggaccagctggcaaaccactccctgcactn

SEQ ID NO: 13659 - DNA, 405 bp, Homo sapiens
cgttgctgtcggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggctt

SEQ ID NO: 13660 - DNA, 402 bp, Homo sapiens
  misc_feature 402: n = A,T,C or G
cgttgctgtcgtcaggacaccgggagtggaaggcaaccggtacgcgctgggtctcagccgctgcaaaaacccggcatcgcagggcaagagttgttccagcgtcctccgctgactccaaaccagcgggtcttgaccaagggattccaagagagaggattaggcccggctaagcacctgggagcagctgtggaaaaaggagagacaatcatcaggcacgatgccaaaaatgaactgtgacctgaaaaagagaagaaaggaaaattgtgcaggatgctacgttttgttttttaaaagtgggggttgaggcaataaaatacggaatatttgattaacgtaatccagaattgtaaagttgattgctcgggaggaagaaaggactgggacacaggcgatgggcctacn

SEQ ID NO: 13661 - DNA, 417 bp, Homo sapiens
cgttgctgtcgggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttcc

SEQ ID NO: 13662 - DNA, 405 bp, Homo sapiens
cggcacgaggagacaggactacgcgcctggagtaggagaaggaggaaaaaagagaccatagacttgcatcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttc

SEQ ID NO: 13663 - DNA, 421 bp, Homo sapiens
  misc_feature 421: n = A,T,C or G
atcgattcgaattccgttgctgtcgcagcaccattatttgggtctttcagggtggccatctctgttagaagacagtagcatgttaacatcactgcattgagtttttgtctggtgtaaagaatgacttttaatgtaaacaaactgcaggtttttttcaaactaattttaagaatttagtcttatttcgttgtaaactgcggatctaattatattacattactctgttcagatgggatggatactaccacttgtccatgattttcatttgaaaagcaaggatctatatcatttccccccagacagcattatttaacactccccttaactgtgtttgaactttctcttttaacacaaatgtcacgtctttacagttgtaatatcaccatgtttcccattgctgataatacttatatgaaccccn

SEQ ID NO: 13664 - DNA, 418 bp, Homo sapiens
ggcacgagccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctg

SEQ ID NO: 13665 - DNA, 404 bp, Homo sapiens
  misc_feature 404: n = A,T,C or G
tcgaattccgttgctgtcgggggtttcatcatgttgttcatgctggtcttgaactcctgacctcaggtgatccatcttcctcagcctcccaaagtgctgggattacaggcgtgagccgccacgtccggctaacaagtacttttttatttttattttattttttggatggagtctcactctgtcgcccactgcactctagtctgggtgacagagcaagactccatctcaaaaaaaaaaaaaaaaaaattttggtaaccttaggggtttaaaaacaacaaaattcatttccattttggagggtggaacccccaaaataaagcccccagaaaagccacctcttttttgagaggggaggggccccatggaagggttggcccctgcccttgagcccggtgaaccccccn

SEQ ID NO: 13666 - DNA, 403 bp, Homo sapiens
tcgaattccgttgctgtcgggaggatactttcctgtcccctggctttgggtttgcccacgtggcttgctctggccttggaatgaagcagaaacgaaaggctgccagttccgagcccacgtctgaagtcgccttaggtggttccgcgggccccgtgcgctcccaccttcacccagagggccttctctggtgcagccgctgcttcttcagcctccgcccaaaaggaacggagccccctggccgatccgcaggcctacagggagccacagagcgcagcggctggaccagcgttcaagcccaagcacaggcctgcgagaaccttgttccagccgccgtttatgatggttgattatgacgcgttgcagtggcggtagctcaccaatccagtgcgtgcacccgctcctt

SEQ ID NO: 13667 - DNA, 410 bp, Homo sapiens
  misc_feature 410: n = A,T,C or G
cgttgctgtcgcactttagggattgttacagtcactgttcaatgtgccttcccatagagttctttcattcctttgctcaacaagaaaacttggcaaagcctttaaatatagaggccctttttttttttttttttccccaaaaaaaattctaatggggtgccccggctgggaggggagggccgaatcttgagctagttgctccccccgaccccgaaatgaagggaattgcccggcttagcattcccaagtgacgggagaaagcgggtgtaccccccaccacgctggaatgatcgagtcgcatggactgagcggtcagacgcgggaagtaagaggcaaccggagcacccatttggattacgtaggtgctagtttttggccaggaaccggagagaatgcggcctgcattgacn

SEQ ID NO: 13668 - DNA, 420 bp, Homo sapiens
ggcacgagaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttatagggaagaggttggaa

SEQ ID NO: 13669 - DNA, 400 bp, Homo sapiens
  misc_feature 374: n = A,T,C or G
cgttgctgtcgagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaangttggcttcatcaaacaagaatagga

SEQ ID NO: 13670 - DNA, 423 bp, Homo sapiens
ttccgaaacaagcccggcttttggccgaagcggcctacggctgttataagacgactttaatgggtgggagagaatgttagcttttgaagcttttttatgtagcgctcttctctttttgttgataccccaggggtggctcacttgtattagagaatctttacagtccttagggtttctgaacagatgtttttcctcccttaaatggtgaagtacccccacctcttggccaggtggaagtggatgagtctggaccactgggatcagtgcagggaagagcccagggaaaatttctggggacatagagccacatttcagttttcttcccagggaagaacagattgtcaggacactggatcccaatgagtgggacgtactaaattcttagcaagtgcacattaaaattcagggtaggagagaaggata

SEQ ID NO: 13671 - DNA, 380 bp, Homo sapiens
gcaataaattgtaaaagaagcattcatatgcttctgttaaatccactgtctttttttgagacagaatttcgtacttgttgcgcaggctggagtgcaatggcaccatcttggctcacctcaacctccgcctcccaggttcaagcgattctactgcctcaatctcttaaatatctcggcatagaacactcatgccccgcccgccatcctgactcagttactgtccatatctccctcagcctcaacatacctgctctcccagttttacccacctcttaccccactcatctcttcccaccacgtcgtaccacagcaacaagaacccattctctcctgttcattccctcgacttatccacgacaactaatcaccctgtattcccg

SEQ ID NO: 13672 - DNA, 402 bp, Homo sapiens
cgttgctgtcgccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcct

SEQ ID NO: 13673 - DNA, 400 bp, Homo sapiens
ggcacgcgggtgccttctagcttataaccattttccttgtctcttctgggttgggcaggactgacactccgaacctggcggaagaaggttcatcttcctcgcacagtgtgggttcttggagttcatccagggaaggcggcgcctctttctcaggtcctgcaggctggtctctgagcctgcccccacgaactttctggattccaaggagggatggtgagccctttgacctctgcagaccctctacttgcgaaaagcagcattgaagcagccttttcccattgtagaagggacagggagtcagatccccttaaccccccggctttcaggaccccagaagtgccttccaagcttcccccaagatccacatcacccacgaacctgccactgtttttgctgtgcc

SEQ ID NO: 13674 - DNA, 399 bp, Homo sapiens
  misc_feature 399: n = A,T,C or G
ggcacgaggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcan

SEQ ID NO: 13675 - DNA, 408 bp, Homo sapiens
cgttgctgtcggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctacatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacc

SEQ ID NO: 13676 - DNA, 405 bp, Homo sapiens
  misc_feature 405: n = A,T,C or G
cgttgctgtcggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaagggn

SEQ ID NO: 13677 - DNA, 409 bp, Homo sapiens
  misc_feature 351: n = A,T,C or G
cgttgctgtcggcttcctagctaccaataatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccanaatcaagtactatgcagagctgtgtgccccacctgggaacagggatcctgagcagctg

SEQ ID NO: 13678 - DNA, 402 bp, Homo sapiens
cgttgctgtcggaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaa

SEQ ID NO: 13679 - DNA, 405 bp, Homo sapiens
cgttgctgtcgccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaaccaggattggaatgaccccaaatcccagcttcagcagtgttgcttgacacttaggacagaaggaaaagagccagacattcctct

SEQ ID NO: 13680 - DNA, 411 bp, Homo sapiens
  misc_feature 411: n = A,T,C or G
cgttgctgtcggccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgn

SEQ ID NO: 13681 - DNA, 360 bp, Homo sapiens
ggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatccccaaacctgcagggaaatccacttaa

SEQ ID NO: 13682 - DNA, 405 bp, Homo sapiens
cgttgctgtcgctggatcacggctgctaatctggatgaagcccatgggaacactcatatggtggagaggatcattgaccgagccatcacctcgctgcgggccaacggaggggatatcaaccgggagcactggatccaggatgcctacgaatgtgacaaggctgggagtgtggtcacctgccatgccgatatgcgtgccgtgattgtgattgggattgaggaggaagatcggaagcatacctgcatggaggatgctgacagttgtgtaacccacaatgccctggtgtgtgcacgagccatctacgcctacgccctgcaggtgttccccagcaagaagagtgtgtggctgcgcgccgcgtacttctagaagaaccatggcactcgggagtccctggaagcactcctg

SEQ ID NO: 13683 - DNA, 400 bp, Homo sapiens
cgttgctgtcggggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctccccc

SEQ ID NO: 13684 - DNA, 399 bp, Homo sapiens
  misc_feature 399: n = A,T,C or G
gagaagcacacctacacctcatgggatcttgaggacatggaaaaataccgcatgcagtccatccggagagagagccgtgctcggcataaggtgaaagggcctgtcatgtcccaatatgataacatgaccccggcggtgcaggacgacttgggtgggatctatgtcatccatctgcgtagtaaatcagatcctgggaaaactggacttctctcagtggcagaatgaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaagaagctn

SEQ ID NO: 13685 - DNA, 348 bp, Homo sapiens
aaagggtgggagtggggctacagataaaaaactatacagtaagtataatgtacactgcttgggtgacaggagcactaaaatcttataattcactgctatataattcacccatgtaacgaaaaaaacgcttataccccacaagctattgaaaaaaaaaaaagtatcccttaggaatacaattttttttttgaggctgtacggcaggtgacctatttttatcataaactcaaaagggtttggctaatttttacatacatactctaggggctaatttcacagggtagcacaaggctttaacaatttccttgctcaattaaatcaatttaacaataaactggaaaatgaaag

SEQ ID NO: 13686 - DNA, 360 bp, Homo sapiens
  misc_feature 360: n = A,T,C or G
atggctttggcctctgagtctttccaagtagtggcgttggtgggtctgccctccgcaagacatctgtcgtgagtgtgactcttcttcagatcagcaacagcagtcgttccctcccccgaactcattctcaagccagtcagtaagactctcttcaaagggagttgtcctgtaagtcctggcaaccgagtggtgcagcttaggagtgctgctatgcgttttaaaacggacagctggccgggcgcagtggctcacgcctgtaatcccaacactttgggaggtcgaggcgggaggatcacttgagggcaggagttcaagaccagcctggccaacatagagaaaccctgtctctacgaaaaaaan

SEQ ID NO: 13687 - DNA, 344 bp, Homo sapiens
  misc_feature 344: n = A,T,C or G
gggaaatttgattattgataaatcatttgatattagtgagaaattgttaattaagagtgataatgacattatggttatgtaagaaagtgtccatattttagagatgctaatagaaggatgaagaaataaaatgatgtgacttttgtgtttgcttaagttactttggtaaagaaagaaataataaaaaaactaaatgaagcatatttgttgaagatcatttgaccatatacacaagagtttatttctgggctctattttattccattggtctatttgtctgttttcatgccagcactacactgttttgattactatggctttgtaatatgttttgaaatcaggan

SEQ ID NO: 13688 - DNA, 219 bp, Homo sapiens
ttccttcaaattctgtctatatagtattttagcaaacctatgctagtaacattagaaaaaaaataaatttactaaccaaagactttatgaaggtcatacatgaagaaatgggtgttttagtaagaaacagaaatttcttaagcttctcattagatttctttagattttagttcaaaatagatttgagtgagtttatttctgatgcgttgctttaccctg

SEQ ID NO: 13689 - DNA, 344 bp, Homo sapiens
  misc_feature 250: n = A,T,C or G
gatgccttgagagtttcctgttgcacaatctgtttgtctgtagagaagtggcatccagagggcggtaggggaggaaaaaaaaatgaagtaatgggacagagcagacacaggtaaagagggccttaggtcctcaggaaaggggaaagggagggatatggcccttccctccaggtcctcatatttgttgccccttgttctggaacggacccagaggcttgccttcagagggttctaatttactctgtattcntgtgtggaaaagcaagaggcagcatgtccagtggactgtgagactgagcactctaaagccagtagggtcaagtcactggtagcccactggcacc

SEQ ID NO: 13690 - DNA, 353 bp, Homo sapiens
cagtacattgggcaaataatgattacgatgagaggcatgacagtgaatggatgaaacgattctgtttttgttttttttttttcccccaaaattgagtcccctcaatttttttcaccgttatccacagacttcaaaggcttaattactgcctgttagatttaggaggttttaaattttgccccctatgttccttgaaaacaccgctctttaaaaaagggggaaaaggccgggggcggtggctcaaacctgaaatcccaacctttggggaggttgagtcaggcggttcacaagggcgggaaacctaccctttttactaacgtggttacccccgctttactaaactcccaatattg

SEQ ID NO: 13691 - DNA, 381 bp, Homo sapiens
  misc_feature 381: n = A,T,C or G
cgttgctgtcggatatgatgttttattcctagcctttcttcaacacatggattcattctgcaaagcaggtgagagaggaggcaggtcaggtctttactagaaagccttacctgacaccagatgctgtagagaaacccagtttctagaaggctgtcattgtccacaggtctggggagaactctttttttcttgcacatctcaaccctcttcatttggggaattcacaattgtgtaagtcttggtggaagacaggatcctgtttctggtcaaggaaaatacaaggtcagatatgttgtctccctgaacgttggtgtgtgaatcagggttcctcagagaaaatagaaccaataggggcttgtgtgtgtgtgcacgtgtgcacgn

SEQ ID NO: 13692 - DNA, 358 bp, Homo sapiens
  misc_feature 249: n = A,T,C or G
ctaatacataggataaatacttgaggtgatggataccctatttaccctgatgtgattattattcattgcatgcctgtatgaaaatatctcatgaaaccataaatatataccctagtatctacccatggaaataaaaattaaaaaaataataataattaaaaaaacagtaaagcagacattatagggaagttttcaaaaaaagaaactaaaataaggtaaaataacaagggctcaatcttctgtttttgntcatttattcacactgctgcctaacataaaagaaatatacgaacataaatgggaagaaattccatccagaactctatcatatttaccttttttaaatcttggttaaaaa

SEQ ID NO: 13693 - DNA, 356 bp, Homo sapiens
  misc_feature 330: n = A,T,C or G
ggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctanagtaactgaagatccacaaaagaagg

SEQ ID NO: 13694 - DNA, 356 bp, Homo sapiens
tactgtcatttgtgcatatgtagttacattttcctggaaagacctctctgtcttttcaaattgttatgttccttgaagacccaattcaaaattaactttgtggtgtgaaaaatttctttgccattccttagaaggaataattattcctgacatacttaatatttgatatgtattactattttatcgctacctttggatacttgtgtgtctttactcacctcataaagaggggttttatgcaccggctaatctaacaactacttcttaaaatccgtgtattaggacttgttaatttataataaaggcccgtcggtcaactgcgtgctttaaactataaaaatgggggctttacacag

SEQ ID NO: 13695 - DNA, 351 bp, Homo sapiens
  misc_feature 247: n = A,T,C or G
catttggcagcagtgaactgtctcaggaaggcattttaaggggagctgggattgtcatcctagggaaatggccttttggcagcattgaactgtctcaggaaggcattttaagagggctggaattgtcaattgtcatactagggaaatggccttgagcgaataaaaactatgctagggtttgttcaagtctctttgtgtgtgtgtgtgtgtgtgtgtgtgtgtctgtgtgtgtgtgtctgggggtcangtgggtgaaactgtgctgaaatttgcagatcgtataggccaacggtgaggcctaaatgaaaagtgtgctcatagaggcccgatgtaagtttgcgcataaaaggg

SEQ ID NO: 13696 - DNA, 358 bp, Homo sapiens
atattctttccacaattcctcttactggaatattgaggggagaaaacagattgatgaaaaacgtgcaaagccagattacttaacagttcgctttcgcaagtctgaacactgaaagacagtaggtaatattccttagagtagaggagaaagtaatgtaaacctggggttcttccctcacccaagatggtgttatcaggttaaggtgacagataaatattttttggtatgaataatccaaacaatatatcaggcttaagttcttcctgaaagaaaaatgttcaatcacttaaaagagaacagtataaggccggacgtggtggctgacgcctgtaatcccagcactttgggaggccgaaga

SEQ ID NO: 13697 - DNA, 345 bp, Homo sapiens
tggaagaagaagaattgtcttgggccacacataaaatacactaacagtagctgatgagctataaaaaaaaaaaaaaaaggggctggccatatttttcaggattccccccttcccaaataaccaaaaaagccctccctttaaaggggctgaacatggttgttaactgcccacaccagtacccataaaccccatggggctttgaaattttaattttattttttatctgataaagttaaaattttagtttcttgcccgggcccgggggttcccccttattccccaccactcttgggaggcccgagctctggtgggtcccgagtctaaataaatatatcctcttcttcg

SEQ ID NO: 13698 - DNA, 321 bp, Homo sapiens
tgtgcgaatgcttcacattttccataaatcaaaagggaaaaaaaagttgtgagtgaaatgtcattaaccaggacattttagaaatgcagaacctggacttttgattgcacaccatagataaaaatgcaggaaaccatagtttccaactcatggcaccatcattttgtatctttggggctataacttgccctgggaagaactatttcatttctcaacaattctaactcttcttctgaggaatcccagttactactgagaatgagtccaataacttccttcaatgttaagtcagtgatccagccagaatcagaaatattctta

SEQ ID NO: 13699 - DNA, 344 bp, Homo sapiens
  misc_feature 344: n = A,T,C or G
attttaagataaccttgaaaagaatggaaatggtacatcatttgaaaggtagtggggaaagtaagaaagtgtggaacaggaaaaaaaaccaagaacttaagaagtaaaagcaggtaagattaaaaaaaagaaagactataaaaagaaggggaaaaaaaaacatagaaaaaaaatcgaaacacatcagtgaccagaataaaggcaaacagtcactactgccagttaaaagacagattctaggccaagcgtgggggctcacgcctgtaatcccaacactttgggaggccaaggcagatgggtcacctgaggtcaggagtttgagacctgcctggccaacatggtgn

SEQ ID NO: 13700 - DNA, 369 bp, Homo sapiens
ttcaggactgtgagaaataaatgctttttagttataagccacccaatttatgtgttttgttataagatcccccaatggactcagacaatttggctggccagttctggctctgggtctcccatgaggctgccatcgtacatcagccagggctgcagtcatctcaaggcctgactgggggcatcttggaggctggataccacaagtacctaccatgagctaggtggtgtacaagtaatatatagcaacaacaatcataatgtacaattggaagttatttcatgtttactatgtgtccagatgttaagtactttccctgagttacctcctttatcttcataaaaaccctacaaatttggtctgggtatcatc

SEQ ID NO: 13701 - DNA, 360 bp, Homo sapiens
aggggcttcccagacctgtgactgactgaacacgtgtgtgtcattacagcaaagaccaataaggcttgcaggaaaaacttgttgaattctctttgacctaaagtcacccacattcatttaactgtgaagctcttttcctcccactgcgtagcatcctatggatctatcattctttaaaatcggtatgggaaattctggtgtagataccatttgtaattagatagagtctcttaacctctttggaacatacgccttttgagaaaaggatggtcggaagggattgtgcacaattctgtgctcttcgaagcccaccgaagacccgcctccatgatcagggaaagcaaagaagggaacaaaaaa

SEQ ID NO: 13702 - DNA, 355 bp, Homo sapiens
gcctgagtgacagagtaagactccgtctcaaaaaataaattaaaaaaaattttttaatctacataacactgatatatagaaaaaatgaccatgctgaaacactgtggattttagaagcaatgcgctgttgatagcccacaatgattgtcagttcacatgcaagagtcccaatgcaacctgaggattaatatgcataaaaccgcagttgttctaaaggtacaagttacttacatgcacatacataatgtacacctacacgcagttttttaaaagacagaagaaatgtcaatagtaaccaatgtcaacagcacacgttataagtgtggaattatggttttctttttagttttctata

SEQ ID NO: 13703 - DNA, 392 bp, Homo sapiens
cgttgctgtcggcaggctaatgtttcatatgcatgtattttatttttatttaaagttatttttacatggcagtggaatgtgccttcatctgtcaacattaaccccattggacttgcagggcactcccttaaaaggaactgtcgcttaggggattaggcaactaaaccggacctcttgaattacttcttcactgtgctttctgaggaaatgctgattggttactgctaaagattccactaacaattcaaattggggatctttgttcccatggcatgaaaatgcccatgcccgcatgcaaaaatgctgagggtctgaaagacagattgttttgtggaaagtaaagagctctggtctggaagaagctgtttcccttaagcgtgttcgggtgtgat

SEQ ID NO: 13704 - DNA, 355 bp, Homo sapiens
  misc_feature 355: n = A,T,C or G
tcagcctcccaagtagctgggatcacaggttatctctaggatagcttctaacccaacattaagcactaaaataaatattgcttccctttgcagtctctcctagggccagccaagatggaatgggggatggtcagaggaaaaaggggcagagagtactctgcctcatccagttccaaatgttggggtccctcaaggctcagacctaggccctcttctctttcctctctacactcttttcctagaagtcacctcatctgttgccatgggtttgggtaccatagttatacactggtaactccaaaatccacatctccagcccataactctcctctgaatgccaaattctccacttggn

SEQ ID NO: 13705 - DNA, 308 bp, Homo sapiens
ggtctcgaactcccgacctcaggtgatccacccgcctcggcctcccaaagtgctgggattataggtgtgggccaccatgcctggccaacgcaaggtaaacttttaacgtggaatagaaaaaataattttgttaaatccctgggatggaaataacatagcgaccaaaagagtacatctttctctcacatggcaaagttttcttcttgatgctacagtataaaagtaaaaagcacggtttcagtcttccaccagatgtttaaccccaatccccactgttgtttttcacaaagcttttgggatcacctgtt

SEQ ID NO: 13706 - DNA, 373 bp, Homo sapiens
cgttgctgtcgatttgaaaaggttgtggtgtagttggtctgtaattaagttgcagatttaaaactgctgttagctttgtaaatcaaaatataggtgttttttgtcctggtatatcgtcattccagctgcagatggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactact

SEQ ID NO: 13707 - DNA, 355 bp, Homo sapiens
ttctttttaggtgtattataatcatttgcttacatcagtttcctttacaaaatttaggacagaaatctagtctgattcattctgatactactagagcatagtagaaagtagaatcttattaaacttctgttgatttgattaaaagggtacataacgaagtgaaggcagaaataaagatgttctttgaaaccaatgagaacaaagacacaacataccagaatctctgggacacattcaaagcagtgtgtagaggaaaatttatagcactaaatgcccacaagagaaagcaggaaagatccaaaattgacaccctaacatcacaattaaaagaactagaaaagcaagagcaaacaca

SEQ ID NO: 13708 - DNA, 351 bp, Homo sapiens
tagaattttattctatctaattcgtttatactcccagagttcgaaattacattttacctacaataaatgagataacacttgcaaattatatggtactctgcctaacacacgttaataactcaatacatgttagcaataaacttttagtatagtagtcaaagtattaatttctcacattgcaaagttccttcaaagacatgaatacaacctttctaatgactccttgttcatcaagatacctcttcaaattattctatttacttcattcagtatattatctgtgtataccgatatgatattacactcttttttttttttgaaagggaatctaattctgtaacggaggcgggg

SEQ ID NO: 13709 - DNA, 348 bp, Homo sapiens
acatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaagagtgaacacctttcagtactttctagaacaactctagaaagaaatatatagaaacagcaaccaagtatttagcagtttttctaatttgtaagaccctttgggaaaaaaagaaa

SEQ ID NO: 13710 - DNA, 370 bp, Homo sapiens
  misc_feature 311: n = A,T,C or G
gagatttgttacggattttagacatcttctaagtaactccacagaagactctcaaaacaaaagcgtgacctcaacctgcctataggtgccctagtggagaatgcttgataccaggtgacaacccccacgcgccccaatagtgcaagaacaaagtggaggccagagaaggggctggtagtttcttcttagttctcagaaggcttatctgatgatccactcacctctccttccaccttaagggaagaatggaagataataagcaaaacttctagaaagagcaattagcccttcaacttctaatatccaggtgngtcagttcccagtgagagaggtaagtgggcaatggtaagctgtgccacacaccaggtag

SEQ ID NO: 13711 - DNA, 363 bp, Homo sapiens
ttccttttttctgaggttctgaaacaaaaacaaaacgtaggctctgcaacagctgaaggagcttttgaattctttctgaagaggaaattgactttacctaaccaatgcacttcctgtgtatgctatatccgctaaagagcaagacaggacctcagaggcacagtgctcaactgcagaatttcctcttggccattcgaaatgtattacagcgttctgacacaaggtcttcacttattctggtatctgtaatatgtatacaaagcaactgagggtcctgttaaaaatacagatttggccgggtgcggtggctcatgcctgtaatcccagcaccttgggaggctgaggcgggcagatcacaaggtc

SEQ ID NO: 13712 - DNA, 355 bp, Homo sapiens
  misc_feature 355: n = A,T,C or G
attgcaccactgcactccagcctgggtgacagagcaagactgtctaaaaacaacaacaacaacaacaacaaaaaaaccataaaagaaagaaaaagagagagaaaggaagcaaggaaggaaggaagatataaaaaagaaaaagaaagaaagaaaagaaaaggaaagaaaagaaagaaggaaagagaaagaaagaaagaaagagaaatcgatcgaaagaaagaaacaaaaaaagaaagaaagaaatccatctagtagctctgtgttgggggattaaagagacaaatactggtggctgggagcccagtgaggaagctgtggggaggaagtaagtacattgggatgctcagagactacn

SEQ ID NO: 13713 - DNA, 367 bp, Homo sapiens
tacagggaaagggaattccaaaccaagtgcacagcacaaacaaataaatgaagacctaaagcattgaatctttcatggacacttctaggcctaaatcccttgactttataaatgtcatggtaaattgcataatgcatatcatcatgccaaaattcatattttataatgccatatgttagatctccttactgtggtttcacctgaggcaatcttctgaaattttctttaaaaaaatgaagagttgtctgggcgcggtggctcacgcctgtaatcccagcactttgggaggccgaggtgggtggatcacctgaggtcaggagttcaagaacagcctggacaacatggtgaaaccctgtctttacaaaaa

SEQ ID NO: 13714 - DNA, 356 bp, Homo sapiens
ggatcaaatccattgcaggaatgaaggatttatttttttttcagtgtctgaagtactgccaacaaataaccctcagctctcagtccccttgtggattgcccctgctaaataaagccaccagagcctgatttatgcctcttcctgaggtggcctgtttccaatgacagaccactgttggagtatgaaggcctaaccagctcatctaatttggggagagctctaaagaataaggttattttcagctccagagtctcatgacatctcaaactacatcatagctcatcatcttctgaccaaacagccttcttcatttcctgtctatgctattgctccaaagagcatttcctaataaacct

SEQ ID NO: 13715 - DNA, 354 bp, Homo sapiens
caccatcatatatgcattttgttgttgaccgaaacgtcgttatatattctttccatacatagcatgtggaaagaatagatctcttttttttaattgttccacactttaccatataatggaatacgcaaaatttcacaatacctttcaggatgtaaaatacatataccctttgacgacattagaaaagagaaaatgtgggccgggcgcggtggctcatgcctgtaatcccagcactttgggaggccgaggcgggcggatcacgaggtcaggagatcgagaccatcctgggtaacacggtgaaaccccgtctctactaaaaatacaaaaaactagctgggcgtggtggcgggcacc

SEQ ID NO: 13716 - DNA, 183 bp, Homo sapiens
tgggttccgctgtgagaacacgacagatgggttcggctgccatatgacgatagacaggtactcgctgcgatttcactgactgattgtctccgtctccataatttttctaattgttactggtgggagtcttctccctgtcttgcctttttgtttgtaatgtcttgacagtgccgcgatccctcc

SEQ ID NO: 13717 - DNA, 351 bp, Homo sapiens
tcagcatacaaccctagatgatcttgtcgtgaagatgaaggagatcacagacaacatcttgccagggtctgagttttaatgctggcgttttagatatcctgttgggctacaaaaacatgtcaggcaagatgttaagttttgtttaaagcatcaagaattccaggcccggcgcggtggctcacgactgtaatcccagcactttgggaggcctaggcgggcggatcacgaggtcaagaggtcgagaccatcctggttaacacggtgaaaccccgtctgtactaaatatacaaaaaatttgccggccgtggtagcgggcgcctgttgtcccagctacttgggaggctgacgcag

SEQ ID NO: 13718 - DNA, 347 bp, Homo sapiens
tataaatagttatcaaatactcacagtatttcaggtactgttttaagtcctttggaaattttctataattaaaatttacaataatctttcgagatagcaactatgattattccaacttttaaaaaattgaagtttagagaggataaacaattgcccatggccaggtagctactaagttacagttccaagattcaaacatacagcttgactccagagtctatgcttttaatcaatacttaaaactgtcttgatgtagattctgatgggatattcagctatttctcctcagaattgtatatgtgggaatagtatctgaaaaacttggattcctttatatgtaaggaaaa

SEQ ID NO: 13719 - DNA, 346 bp, Homo sapiens
ttccagttcctgcttcataacagatgctcaacagatgtttattgattatgaaaaggatccctgaaaagctttctcctggaattagactctcagccctagaatagagcaagcctgcagaaacgagaactggaggcttgaaagtcctccataactgggttgaagagaaaccattttcctgtaatctttttttttttttttttttttggaaaaggaatttttttttggggcccgggggggaaccccagggcctgctcgagaggtgcggaaaccctgggtcgaaaagaccacccaaagacgccgcgccaaccttcttttttctggggaaaaaagggggctgcccctcccc

SEQ ID NO: 13720 - DNA, 350 bp, Homo sapiens
catagaaatccaccattcacgtaagttttggcctggtgttattgcagtctcttaatttagccaacaaagaaggttggctcaaagacacctgtttttgcatgtaaagtatcaggctggaaggcttggtcgggcatggttttagcaacaggactttcatttgtgatagttcagtcacgtcctggggaattgaggagaagatccaccctaccaaaggccagtcttgctttagcaccaaagaattaattttaaaagttagagttggccgggcatggtggctcacatctgtaatcccagcactttgggaagccaaggtgggcagatcacctgaggttaggagtttgagaccagcc

SEQ ID NO: 13721 - DNA, 369 bp, Homo sapiens
ggattattgagaacaacagaattcaaaacccttgaaaaagaaaatgatgtgtatctatattttaagcagaaatacacaaacacacttatagtaactacaaataacatctagtagctcagacctattgccatttatttcatgttcaatattgtacagacaacatactatgaaaagtgatgtaccatatttatacgtatacaggtgaatttcaatccaacactaagataattactttatgttgtagaaccatatataaatacttttttgccctgctctaaccattgcttatcaagactttaagattatgaatgaatggtcatacttattatatatagaaactattatttgatgaagggtacttgcattcct

SEQ ID NO: 13722 - DNA, 357 bp, Homo sapiens
agaatagctttcatcccaaaatttgcttggaaatagttagatcatttgatttaattttcacttttataaaataagtgtaggaatcctaaaattgattacttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacacctgtaatcct

SEQ ID NO: 13723 - DNA, 264 bp, Homo sapiens
gtgtgtagtgatcatctgtagttgttcaaacgctctctgaagcttatgctcttgttcatgtcccatttttgagttgtgcctacatgatgctggcaacagataagacatgtagttttaataaatcactaacctttatattctgcttatttttaaattataaattccatctgtgtaaatagtttctctcttcttgcactttactaaaagcagttaaaagaaaccattctgaggctgggcacggtggctcatgcctgtaatcccagc

SEQ ID NO: 13724 - DNA, 352 bp, Homo sapiens
  misc_feature 37: n = A,T,C or G
tggtcttttggtttttgttgtgttcatttcacagcanatcagtgagcgtgtccttactgcctggccccagttcaagtcctggtgttagtgcttcggctttgaagtcagatgacctggggtcaagcctgtgccttgccactgggtggctgagtggccttgggcaagctatttgctaaactttctgtttctgcatgtatacaaagtgaataagactgattcctttcctttggaaggctgttgaaggtcaggcctggccactgattcttataattctttttactaaaagcagaccgaaaagtttaggatcgctttggggccactcctcttgaattcaagccttgcccccttttcc

SEQ ID NO: 13725 - DNA, 350 bp, Homo sapiens
tacctccaggcatgtggacatgatggctagagctacagtcacattttttttttaataccatgaggcaagtctttggatgaaagttaggggttaagtaaggagaaacagaagaatcataggcacctgggccactgttgttactacagagcttctgcaccagctctacctaagaagaatatctcttcctaatcttagtgatatgtaggaaaagaactctctatttgtttaagccattttttttcctagactctcttataagcagcaaaaaaaagtcccaatgtggtggccccttcccatagcctctgaaatgaaagaaatgggttagaaggcagaagtggatatagatgaat

SEQ ID NO: 13726 - DNA, 380 bp, Homo sapiens
  misc_feature 360, 380: n = A,T,C or G
cggtgctgtcgggattattatgtttggaagattattatttttgaaagacaacttttctgttgccaaactgtcttctaaagaggttgttcacatttctagtctactaacaatttatgaaaatgcccaccttccatgggggaatattaaagactttgcctgaaatgatagaactctattgggtagtggctgaagtaagtttgagttggtaaatcaggggtcagattatggaaaaacttacatgttggagaatcagctattctcttggtgagtttcttctttctttgacagattaacaactttccagcaggccaaatgagaattattggctagctttgtggagctgtgagggaaccctcttanaagatttctcattctctctn

SEQ ID NO: 13727 - DNA, 395 bp, Homo sapiens
cgttgctgtcgatttttgaattttttcgtagagacagggttttgctatgtttctcaggctggtctaaaaattccagagctcaggtgatctgctcaccctagcctcccaaagtgctgggattacaggtgtgagctaccgcatccagccctgaatattctttcagaggtagggttttgtgtgttttgtttttagttcaagcagtttgactacatcctaaggtataaaggtactaataaacaagtcagtttttcttttgtgcatttttctttattttagagccttcagggaaatttttttttagaaagatcaagagaaggccaggcgtggtagcttacgcctgtaatcccagcactttgggtggccgaggtggacagatcacctgaggtcacgagttg

SEQ ID NO: 13728 - DNA, 356 bp, Homo sapiens
cggggttggggttgccgataccactgctggtatgctgtgtaaaaacagccttgtttgagtagattgcgaggctatcgctatattgacttccctcttcagctgcgttattgaggatcacaacttattttgccagcactctacgctatgggaccacatagaggtgctctaagatagtaacattaaagaggacatataatataaccaaaaatttgagttccagataagtttggtgtctcactagcaagatgacgttaaataactcatttaatttttttgaaatcttaattttctgttcctgaaaataaaaagcaatctgtctcttgtccaaaagactatgtagggtttttaaaaatttt

SEQ ID NO: 13729 - DNA, 393 bp, Homo sapiens
cgttgctgtcggtggcgggcgccggtagtcccagctactgggaggctgaggcaggagcatcgcttgaacccgggaggcggaggttgcagtgaaccaagatcgcgctactgcactccagcctggcgacagagggagactccgtctcaaaaaaaagccgggcagaattaatgattttgaagctccgagaaacaggattaaattcctctttcaaaccgaaatcggaatttgattttttaaaagtgtaaaataccataaacttttaaggttagttgttcggtaaccatgtcaccaattttaaggcactttctgagttgtgtatagtttctccagagccctaggggaaatgttttgcaaaatatgcacgtttagctttccaaaacaagttgtcttttt

SEQ ID NO: 13730 - DNA, 346 bp, Homo sapiens
  misc_feature 346: n = A,T,C or G
cgggaaggaagattacctgctgtcaaattagaaaattacaattaaaccattgatatttccgtgagaagagaaaactagtaaccgtgaagaagtgagggaaaacaaatgatgacgtcatgttaacaataggaaagacatgtccttttgtaaaagatgctgtcacccatcacagactatttcttccaatatggatttgcaaaacatgacagtcgagctcaccaaatctctcgtggttgccgtggggcagggcgaggtggcccacacctgtaatcccagtactttgagaggccaaggagggaggattgcttgagcccaggaggtcaaggctgtaatgagccatgatcan

SEQ ID NO: 13731 - DNA, 353 bp, Homo sapiens
ccatgtgaggtgacgccccaccctgcttcggctctccctctgtaggctgcacccactgtccaaccagtcccaaagagatgtaccaggtaccttagtgggaaatcactcgtcttctgcgtcaatcacactgggagctgcagaccagagctgttcctattcagccatcttggaacagacctcccatggtagcatctttaaactgaaatattggacagagagtttccattgctgtagtattttgcttaattattatctttatagcagggataatagttgacaaaaaggaagcatgaaagttttaccatcactgagtctgctaggccttttttggggtctagtaatgcagttttaaa

SEQ ID NO: 13732 - DNA, 347 bp, Homo sapiens
  misc_feature 347: n = A,T,C or G
gagtagcagcagtgacttaacagatttttttttcattgctgctgcttcttaatcccttttgagcctcaatttctttttgtataaaaggggaacaataacgattttgtagagatgaggtatgcaaagtctctggctgcagtgagcactcagtaataagagctatttattgggccaggattccaactactttcataaaaatagcaggaaagtcaaatggaaagctgacttgatggtaggggaggcttctgcccaccaactagttccacgtttctcaaccctgcactgaatgttaaaatcacctggggaacttctgaaaaattatgatgtctggtcccaaccccatggan

SEQ ID NO: 13733 - DNA, 359 bp, Homo sapiens
cgggtgactcaatgtattcacaggcttcaaaaatatgctctaagaaaaaaatgggggaaaaggaacagtttttcatttcaaaagaattccagccaatgaatgtcaaaggaaagagggaaatacagtatcaccattaggcaaacaccacagtaataattattgctgataagatccactaatggatgctaagattaatgggcaaaagttgaggagaaataagatatttgccgaagcctcaaaggtatctccctcaagatatttattaatacaagccgtgcgcggtggctcacgcctgtaatcccagcactttgggaggccgaggcgggcggatcacgaggtcaggagatcgagaccatccg

SEQ ID NO: 13734 - DNA, 225 bp, Homo sapiens
  misc_feature 225: n = A,T,C or G
ttccttcaaattctgtctatatagtattttagcaaacctatgctagtaacattagaaaaaaaataaatttactaaccaaagactttatgaaggtcatacatgaagaaatgggtgttttagtaagaaacagaaatttcttaagcttctcattagatttctttagattttagttcaaaatagatttgagtgagtttatttctgatgcgttgctttaccctgattacn

SEQ ID NO: 13735 - DNA, 397 bp, Homo sapiens
caattctgcacgagcctagctacaggttttaggtatgataaagacttggttaccacaaatagctgaccagaaaccataattgggcggaggcaagcatcagctgaccaagcattttccaagccaccacagtgattcagctgcttcctctcctgcatctcctatggaaaagatggaccaaacacagctaggacatcaagctttaaaaccaaagcaaccttggcacctcacacaatggccagctatgaacctcacctggatccacaccactccaatttgcaacccccctctcagctccccaggtactatctcctttagccatggacctttaagcactggaaccggcattggcgtattcttttcctccgcatggagtgcaacccttctcccactctgcccg

SEQ ID NO: 13736 - DNA, 347 bp, Homo sapiens
tagataagtattggtcaactttgatgaatcacccataaccttaaactaataagtcaaaacctctttatactttgacaaagcaccattagatgattcttaggtccaccaaaggttgataatcactggcctagatgatacagcaataggtaaaactagggtgacagcagtggaaatggtaggggataactaccaagaaactgttttcagtaagaactaaaaggcattacagattgatgaaatgtaagaatatgaagacaaacagtcaaagatttaaatcttgattactgaaaaacttacgatactattaaaagattaagaagtcaggaggagcttaaaaacctagagaa

SEQ ID NO: 13737 - DNA, 366 bp, Homo sapiens
agggcaagactatacagactttaactttgaattcccccaaattagtacagggtttagtacagagaaaggacttgatacatttttatacacttttgaagaataaattgatatttatttagtactcagtgtcagccaagcacttaaacactttacattcattaccccatggcatcctcacagccttctgaggtagaaagactcactgaaggttcagtaaagtggggaggaaggcacgacttgaactcaggtctgtctgactccagatgtcttagaaaggtagaatctttcacttggaagacagtatggttaagatcatgttctccgggccgggcacagtggctcacacctgtaatcccagcactttgg

SEQ ID NO: 13738 - DNA, 346 bp, Homo sapiens
tacctgtgcccaagcagacatctcccccaatttgtgtatttacacccctcctgcctgcagaaaggatgaaacaggattaccctcaaatttacagctataattaaactattattaaaatccaggtaaaaaaacaagagcactgcaaagaagagcgtgtgtgtgtgtgtgtgtgtgtgtgtgtgtgtgtgtgtgcgcgtgtataaaaattctgtcacacacacctgggctggggcagcttctctgggatccctgaatcacagagtgctagcaccagaggggctttcagagataaacacgcttcacctgtttttatataggactgacacagattaagagatttggcagg

SEQ ID NO: 13739 - DNA, 189 bp, Homo sapiens
atatacgtgtattttttgggacttgcctgtttctgttaatatcggagtgttaaagaacatctctgagtaatttggttttgtcattgaactatttttagtacattcatgtctgaagagtgatgtgacttgagaactaagcttcttcctgctttacattcatcatttttccagaagccacgtagtgtgcca

SEQ ID NO: 13740 - DNA, 348 bp, Homo sapiens
gggaaatttgattattgataaatcatttgatattagtgagaaattgttaattaagagtgataatgacattatggttatgtaagaaagtgtccatattttagagatgctaatagaaggatgaagaaataaaatgatgtgacttttgtgtttgcttaagttactttggtaaagaaagaaataataaaaaaactaaatgaagcatatttgttgaagatcatttgaccatatacacaagagtttatttctgggctctattttattccattggtctatttgtctgttttcatgccagcactacactggtttgattactatggctttgtaatatgttttgaaatcaggaagtgt

SEQ ID NO: 13741 - DNA, 187 bp, Homo sapiens
atatacgtgtattttttgggacttgcctgtttctgttaatatcggagtgttaaagaacatctctgagtaatttggttttgtcattgaactatttttagtacattcatgtctgaagagtgatgtgacttgagaactaagcttcttcctgctttacattcatcatttttccagaagccacgtagtgggc

SEQ ID NO: 13742 - DNA, 188 bp, Homo sapiens
agtggaacgatatcttcagaacgctgagagcgaagaattctcaacctagaagtattccagagagcgtaccttctatgaatgcagataaaataaagacaatttgtagataaacaaaaactgcagcatttattaccaagggactaaagtaatgtctaaagaatctatttcaggaaggaggataaacatgg

SEQ ID NO: 13743 - DNA, 393 bp, Homo sapiens
ggcacgagctggggaggagccaaagccttggcgctcacctaagccgcagggagatacacccaactgggagatgaggaaacagcaacccacagaggagaactaacccacacaggatcatttcgtgaaggagcaaggctgaagaaccagacctggactttcttaggcaagtaaattctgattatatcacggagacttgctttgagaaatctgccccttttcactgtgagatggcgtcattaacacatctagttctctcctaagcagccagcaaacatttattatacactagatattatattggcatttgagatgatacaaaggaataaaatggggcaattagctctagtaatttggaggtctcaacttacggatattccaagttcctttgaaacg

SEQ ID NO: 13744 - DNA, 369 bp, Homo sapiens
tgtgtctaaggaactgaatgtttaatgtgacttaattttcattgacttataagcaacaatgccacctgaactttagcatttcttatatcctcagcccatttttactttagcaccctagcaaacattcagaagtgacatggtcattttcttccttctgggatggagcgttggctctctttattgtcattaagatctttgaaagcaataagaagatataattagccgggcatggtggctcacgcctgtaatctcagcactttgggaggccaaggagggtggatcacctgaggtcaggagttcaagaccagcctggccaacatggtgaaaccccatctctactaacaatgcaaaaaattagccgggcctggg

SEQ ID NO: 13745 - DNA, 358 bp, Homo sapiens
  misc_feature 291: n = A,T,C or G
tctccatctcaaaaaataaataaataataaaggtaggggtttcttaattcttttagacagatatcctcacattaatctgtaaaggacaaaaaaataagactttaaactcttaatttgaaaagatatctccatttaaatctcctttgcttattttattgaccacctcctttgcggatttcatttcctatccttgatttagaaaaaggttaagggccggtcgtggaggctcatgcctagaatcccagcaccttgagaggctgacgcaggtggatcatgacgtcacgagatcangaccatcctggctaacacagtgaaaccccatctctactaaaaatacaaaaaattagccgcgcgtgtg

SEQ ID NO: 13746 - DNA, 365 bp, Homo sapiens
ttagccttttgtatgcttttactggataattttctctaaggtagagggtgaggagctatatattatgtaacattttagaaatagcagaaaaccatttagggggaagaacacacaccaaaactacccgataacttctttcctgattaaaattatcttccaacaattcaattatatgtaaagagggaaccgtggctacacacgtatttattaactgtttctggcggtccagaggaagctggattatttttaccataacaaaatcaagtttttttcagccgggcgcggtggctcaagcctgtaatcccagcactttgggaggccgaggcaggcggatcacgaggtcaggagatggagaccatcctggt

SEQ ID NO: 13747 - DNA, 366 bp, Homo sapiens
gcgctctgtggctgggcattttaaacctgacctttctggctctgagtttttccattttaaacctgacctttctggatccaggcgaaggcagagacaagataaaataggattattggatggcagaatgtattcaactatttctcctgaaacttggaaccgtattataccatgggggataccacactgacggaaacggtggataaatgtgagttcatatatactcctccacaaatatacatgtctcatgctgggcgcattggctcacgcctgtaatcacagcactttgggaggccaaggccggcccatgacttgaagtcacgagtgtgtgaccagcctgaccaacatggtgaaaccctatgtttactc

SEQ ID NO: 13748 - DNA, 367 bp, Homo sapiens
ggatcaatacaacaaagttttctgtttagaaaatacaaaaaaaaactataaatctctaaagaaaaaaggccgtgtcctctgaactatgccacagatatagaatgtagaaagattgtataatcattacatgtttaaagtagatggtgaaagcctagctcggcacctaggacggcacaaagtaaatccttaacaaatgcctgtaagtagtgggtacttttgtaaagaaaaggctccatgtttttgttgttctggaggtgtgtgtgtgtgtgtgtgtgtgcgaccctcaacaccgccacataattactaactaaccctgtgtacggtagtcccccctttttcttataaacggcccctcattctttatttc

SEQ ID NO: 13749 - DNA, 367 bp, Homo sapiens
  misc_feature 367: n = A,T,C or G
gcatccagcacgggataaagaggctgtgagaaggatgaacagatttttggaagacgcacatttttgtaaagctaactcagatagacttcactccgtcctcatgccctgccagtatctttaattttaaaagaggaagaaggaagcatcgtctcttctccccaacagataatactgggtgctctgtgcacagggtgacattaaaaaaattaaaaaattaaagaggaaggaaggaagcaacgtctcttctccccaacagataatgccaggtgctctgtgcacaaggtgacgttatccattcattcctctctcaggtgtgggagtgagggtaggggagggcatggcaacgatggcctttgccagggacctn

SEQ ID NO: 13750 - DNA, 337 bp, Homo sapiens
acaacaaaacaaaaccaggtgtagtgtggctctaaaggaacatctgaccaggttcctggggaaccagggccatgggaggaagaagggactcttctcccatgagaagggcctggagatgcagggactgtcaagtcactttggccaactttttttgctcccctagaatgaactctgcactaaaagtggagaatcacttctatgagagaaagacatacaaagaaaagatataaggcaatgctacagtaagttgggcatatctatcaaaatttaaaaacatgtatactctttgaggagtcctattctttcaggaattcattttgcccttattaactatatc

SEQ ID NO: 13751 - DNA, 383 bp, Homo sapiens
  misc_feature 5: n = A,T,C or G
ttggnctcggttggacagtatgacagaaagggacacaggttggagcacagaaagaagaatcatagaggtgccaaaggaacttagacataatgatgtcgttcaagccaacaagccaagctgaagtaaatgaaaccatacccaacccttacccaccaagcagttttatggctcctggatttcaacaggctctgggttcaatcaacttagaaaaccaagctcatggtgctcagcgtgctcagccctatggcatcacatctccgggaatctttgctagcagtcaaccgggtcaaggaaatatataaatgataaatccaagtgtgggaacagcagtaatgaactttaaagaagaagcaaaggcactatgggtgatccacatcatggtt

SEQ ID NO: 13752 - DNA, 355 bp, Homo sapiens
ctcttgcggtgagggaaagcaaggggaccatcccttgccaccattatctggtaaatcccccatgtgatgcctaatgccttccatccaggcatctaggcctaccccaaatcagcaagtttgaaaggactttgttgtttatatatacatttgcttcattcagctatgaagcaccctgtctcttaccagacctgcaccctccaccccactgatttgcttttgggttgttaaagggttgcgatacactgcacttgccagacatacctctaaaatagctgttgactcttgcctcatccctaaactctcctgctgggagacccctcctattctatatgcgacgctttcatgtgtgtacccg

SEQ ID NO: 13753 - DNA, 350 bp, Homo sapiens
agttcgaagaggtagggagagaatttccatgggaaaaaattgttggattgtacttcaatacaagtaacaggaacttcaagaggacctctaagaaaattatatgtaccacttggagtgtaggaacatatggactggatctgagacccagtaagaacagtaagggtaaagtctatggctgtgaccacagcactgtgtctggtcacaaaataaggaagcctgcagtgggagcaaacttcaccttcattgataacgagcaaaggaagctcaggtcaaagggagccaccatggggctgccttaaaagggatcctacccaagaggttaagtgctctagcagaacaatgggacccta

SEQ ID NO: 13754 - DNA, 376 bp, Homo sapiens
cgttgctgtcggtggcgctctttatatcttggttaccttatctttctgtggaagagatttgatgtctaggtttgtcacatcatgcctgtttcctatcactaccaacagggttgttatctagcaaccccgattgaatacgtggacgtcgcggcttggcctcacagactgtgcgaggatagggtacttggggtgcgcctttgcaaattcgtatttataactagagtacttgcatttccttagagtacctgacttgcccagagagaattagcctttaattttaatttgtatgacagaggattggaaaccttagtcccagtacgtttagcaacattccaaatagcttacaatttctgctacatgccagtgcagttataag

SEQ ID NO: 13755 - DNA, 375 bp, Homo sapiens
tctacggttgcgacaaaacgacagaaggggcattttgatgtctagaatcaggggatccaggatcatcaccaaggtcattttcctagacagatgtgctgaggctgtagaaagtgctttttatttggatgggagcttgtgcataaatgcgagaggggctgcccatctgacggactagaggagactcatggctgaaccggaacaggacatcggggagaagccagcagagcttgtgtttaaagtcataattcagaaccccaaagaaaatgacttcattgaaattgagctgaagagacaagaactgagttaccaaaacctactaaacgagagttgctgtgaactggggattaaaccacaacgagtggagaatatcacact

SEQ ID NO: 13756 - DNA, 343 bp, Homo sapiens
  misc_feature 343: n = A,T,C or G
actatcgaaacagatcaaacgcatagagaaagaatacaacctttcaaattatttatatgaacacagtataatatggatgcccaaattcaatgaaatagcgcttctctctacaaccacctagggctagtacttgagaaaactgatactggcgcacaaccttcaatactatcacaacatatttcttagacctatacccatatgtttatctaaatcacatggaaaaataactgtgcacaaatagagaattcttatgaaagaatttaatgaagagggagtgaagaatggtctattataagcctactgcaactaaaagattgatgctctgctgcactaaaagatgagn

SEQ ID NO: 13757 - DNA, 358 bp, Homo sapiens
atactctcttatatgctagagatagaccccagctaatgagctctccctagaacaggtattctgtcactcactcacacacacacacacacacacacacacacacacacacacctttttttacactgagagaatgagaaaaacattaacttttagctctccggtggccatattttcttaaaggaggaaatcattacacagtaaagcattaatggccagtgtgtgcttaatttaacaacactacaaattcatgtagagatgtctgattctctagagaggaaactgtcattccttagctgcagtcccctcttcaactgaagaaatacatttcaccactaggggtccacaggggaacaaagga

SEQ ID NO: 13758 - DNA, 353 bp, Homo sapiens
aagttagttttgcagctctccagcatatagaagagcagttctatattctgatttctttcattatagtgcactgacttccactggttatgtgggtaagaagggtctctgacaatttataaaacaagatggggaaaggagaccagcaaagcatgtatataaaacatttgttgcttttttaatcaaggagaccagaaactgtggtagtgccccaacgctttgattgaaggccgctgtatattgagtgtattcctcatgacatattcggactgattcagactttccacagtgcttattagctcattctgtgcctcaattcttctgagcacattgtcccattaagagtagtcaaaagg

SEQ ID NO: 13759 - DNA, 353 bp, Homo sapiens
  misc_feature 353: n = A,T,C or G
cgggggtggagcttcaggtatgaatttttctttctctttttttagtgggcacagctatgatatcagaaggtaggcctggaaccaagctgatgggagagggaagacctgaactggtcagtataagaaggaaatgatatatgaacaggaatgaaatggggcgcgagtggtcatatagcaaagaaggaagtgtgggcagtgagtgcctgatggctgcggagtttctgtttcaaacgataaaaaaaaattttagaaatggacacaacattggccgggcacggtggctcacacctgtaatcccagcactttgggaggctgaggcgggtggatcacctgaggtcaggggttcgagaccn

SEQ ID NO: 13760 - DNA, 343 bp, Homo sapiens
tactgctttgtgaggaatgtaaaaaagactaacggaaataatgcaatgatttacaacgtatgaatgatgcttaaaatgtagtactaataaaagataataattattatgcactatgattactgtgcaagttttaagaatgaaaactctccctaacacttggaagtgagcacactaccattgtccaatgtgaaaattacagaacagctcccacacactatagggaagatctttctatcatcaggacagagacaaacctagctgctccttctaagaactctattcatatacttatacacagaccaccattaatacaccatgagttctgtcaaggaatcttatttat

SEQ ID NO: 13761 - DNA, 360 bp, Homo sapiens
ttcactgtctcctcactcccaactgtgggcagccaggtgtgcttctacattgcaggtctggccccacatcccctgctgcagacctccactggcgcccccgtgaccctcaggatctgttcccagctctggaacaggctctccggacccctggccactggcaccctgggcagcttacctcgtcccactcctgatagccccccaatgaccactttatgcttcagccaaatctagctgttgacagctcctcaaacgcttgggctggctaagcctctacagtttccatgactctcttctgagccggaaacacctgcctcctccctacgtgcattcattcccacccccgaaacgggacaaactcct

SEQ ID NO: 13762 - DNA, 305 bp, Homo sapiens
  misc_feature 305: n = A,T,C or G
agtcataagcatcttttcaacacttgactgtttcctgtgaaatgtatttaccctcataatagttctagtaaacagaccctgcgatttgggtggcttgagcccatcctggctcttcagccaagatgacaaatttataaatccattctaatcacatcatcatttagcaaatgctttatttctggatccaaatttacatgtctacctgaatctaagattttatgcttatcacggctatggagagaacatctcttcctattttgtgagcaggggatactagaacaataaagcgctcgctcatgacccan

SEQ ID NO: 13763 - DNA, 356 bp, Homo sapiens
ctcaggagaaggttagaattcactataacaaaagtaatagggttattaatatgactagtattctaagactctcttaataggtgggagcaggtagctcagtttacgggtagacatttatgggtaagtaacaacattggtgaagtgcaaacacctctctcctagcacacacaacacacacatacgtacattctttttctttcacacagacacaaacacactcccatggacaaagaaatgctacgaagaatttccttctctcaaatatgctggatgactctgttaggttttcccacatagaatggagacttgagtgtttagtctgggccccacgcatgcagataagcaccaagttggat

SEQ ID NO: 13764 - DNA, 351 bp, Homo sapiens
gacacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctatggcatcacatctccgggaatctttgctagcagtcaaccgggtcaaggaaatatataaatgataaatccaagtgtgggaacagcagtaatgaactttaaagaagaagcaaaggcactaggggtgatccagatcatggt

SEQ ID NO: 13765 - DNA, 292 bp, Homo sapiens
ccatagttaaattatctaactatgttataaacattgggaataactatgttataaacactgggaattacagagaaatattatggaaaggtctgattctaaaaatgcttataattgcttggagaaacttggtcgtgaataccaagacaataaaagtcaaacaaaatccttaatttagtttactgcagttgttcatgtggcactggtccctatggaagcccaaaaaaagtatccgtattataagtaaagctgtgccaaaacatgttaaagacttatatttctttatacttataga

SEQ ID NO: 13766 - DNA, 346 bp, Homo sapiens
gaatatggagattggcagtggcagcgagaggttttggggtacagctccgcacactgattattgagtcagcagttaatggaatctgccaacacaaaactgaaatgagattccatgtaaagcctacacaatagaaaaatgaatgtttaatgagcatgaattgtatcataccatgctgtttctaaaagtctccaagcttagaggaaccttagagaggatcttaatgagctataataatagcttccattcgcaaactggtatgtataagtctaacatgtccacattagatcgctgctccctccaacaaacatggggaggcttagcagtttcctctcactctactaactgc

SEQ ID NO: 13767 - DNA, 347 bp, Homo sapiens
  misc_feature 347: n = A,T,C or G
cgggcttacttctcacgatgtcaaagttcatcatacagtcacacagagctgcaagggagtctaggaaaaacagtctcaaaaagtagaggtggacagcttctcagggatctcccaagctctgatgactctctcaactctgcttctctctgggttccagactagattctctcagaaaaagtcttggaatataggatggaaaaaaaaatccagctgctgcacctatagattcacagtctgagcttctcccaccaccctctcagtctttgctgatcaaattcaggagaaggttaactagcctgtcttgaaccgtatgtctatctctgggataatctctgcacctgagaaan

SEQ ID NO: 13768 - DNA, 368 bp, Homo sapiens
  misc_feature 354, 368: n = A,T,C or G
ctctcagcctcgtgctatacaccattaaaacaacaaatgactggctggaaatagaggctttcacagaacagatcctgagcctgtgaccttccacatccagctgcccattatcctttggttcacggaaacagccctgacaagctcagcatggctacagaggcctcctaaagagagggtggagcgaaacctgggccctctgatatatgcacctgtggacggagactcttctctgtcctctatcccttgtcagatgccagggtattagatatggctatcctttccccacacctctttaccatctgggaagccccttgggattcactgagtgaatagcaatggaagtttgtacactangccgatagcactgn

SEQ ID NO: 13769 - DNA, 288 bp, Homo sapiens
ctatgatccaggtaagagttgggggaactgcagagtgacccgagctaggccagtgactttggagttagtttctttacctctttgggcattagtggcctcctctggggctggacttagagtcttgggagtcttttagtgcctactttgttttatttctgagccaaagtgatttggataatacacagtacttaaagaactgaagccaagccagcttccagtccctgggcccagtatatgtgggaaaccggtacctactgagtccccatgggatgacacaggtactgccct

SEQ ID NO: 13770 - DNA, 393 bp, Homo sapiens
cgttgctgtcgaacacaattagccactttttcagctacacttctcactcagctgcaccctacacttctcactcaggtgcacccccttctgctgtcctttccccaacgtactgggtcccgagcgtggtgggtatttgccacactgggtgccagctcagcagccccccacctctctttattctctccaaagctggtctttctgactatcattgtggtagggggaggacagatgctaaaggtggaagctgacctggagaaagagacacacggggtgactgtggcaaaggacagctggaaaagaaactctatcacttcttcattggcaaccacaaggcacctgaggccatggcactcccagaggctgtgcgcagagccaagcctctcaacctcttcg

SEQ ID NO: 13771 - DNA, 368 bp, Homo sapiens
taatatttttaggagatacagggttttgccatgctgcctaagctggtctcaaactcctggactcaagcaatccacctgccccagcctcccaaagtgctggggttacaggcatgagccactgagcccggccttaagacatttttcttacgaggtattttttagcccttagggaaatttatcatgaaagcaatagagttcagagcaagaactctggaatcagagctcatatttgattctggataaaacctgaagagttatataaccttggagaagctaactgccattttgaaccatagtttcctcacgtgggaaaagggtttcatgttaatatatataactcatggattataatgaagactacatgacaa

SEQ ID NO: 13772 - DNA, 387 bp, Homo sapiens
  misc_feature 208, 211, 212, 218: n = A,T,C or G
cgttgctgtcgcaggtgggcatgaacgtttgtaaacacaccagcactgatgcctccacatgggtggccctggagaatgccccaacagaggtcaggacagctggggacgccgtctcagccctggtggccagcaccgccttacgtcaggaggctgcagtgccaaggacagcaagctatctaaacccccagtgtgtgcctcggggagctancanntataangcaccattaaataaattggttgtgcctggaaatgcaaggagggcaatagctttgtaaattgggttacatttttctccttgaatttttctatggtcctagagctttccaatcatttaatggcattgtcggatatcttttacatttcaattggcatccatgaaattacatg

SEQ ID NO: 13773 - DNA, 354 bp, Homo sapiens
  misc_feature 45: n = A,T,C or G
ttgcccaggctgagagtgcagtgatgtgatactggcttactgcancctctgcctcctgggctcaagagattctcctgccccagcctcctgagtagctgggattataggtgtacaccaccacgcatggctgcttttttggaatgaaaaaaaagatggccataaacatagcctgtaggtccttccacttctcgtaacccaacctcctgaacccctagcattaaagtgggtcttcagaaaaaagggcagccattggggaccctcagaaaaaaagggattttcccttttcttttattaacaagaggccggtccccttggagaagagcaggttcgccttcgagggccgcgatatcgccg

SEQ ID NO: 13774 - DNA, 350 bp, Homo sapiens
cagttactcacaaaagaccacgtaccaaaataattgcggccttttccattaaatacaataccctataaaactggaagacaaactgggcttgtgatttccagcccaaagaaataagatagccagatgcttctggcctgtatagcttatggattaacacatgcgatgtcaagatattcacccagactttgaacaccattaaaaataacatcctttttttgtaacttgaaaggcacagatgtacggagcctctgctttgcccccactacctgacttattgtaaacgcctttcttacataaacatgcatcacttaacatcagagatacattctttgagaaatgtgaagccaggc

SEQ ID NO: 13775 - DNA, 346 bp, Homo sapiens
gaagtggaggtggcggggagcctagattgtgcctttgcactccagccagggtgttaagagtgaaactccacctcacaaaaaaaaaaaaaaaaagcccctttctaaaaaacgccctggaacttaaggatttttacccgaaagcctttggtcttttacccacccactaagggtcttttcaataccccctggaaacccttgggcttctgggaaactggatgggaaacacatgtttggggaaccttgccccaaaagcaatatttctcccaaaagttcggggtggccaaggactttcctttgcagaaaattaatttgttattttataaaagggcccccggtggaccttgtt

SEQ ID NO: 13776 - DNA, 382 bp, Homo sapiens
  misc_feature 382: n = A,T,C or G
cgttgctgtcgggagatgctggtcattctggagaagctgcggaaagtaacaggcaacgagatgctgggcctcgaggagggggaccttgaagacgacttcgaccctgcccagcacgaccagctcatgcacaagagctttggggacgagttctacggggccgcggaggaggagaagccacaatttgaggaagaagaagggcttgaagacgactggaactgggacacgtgggacgggcctgagcaggagggatactggagccagcaggagctgcactgtgaggaccccaacttctacatggacgccgactacgaccccagccagccgaggaagaaaaagcgcgaggcccccttgacgggcaagaagaaacgcaagtcccccttcn

SEQ ID NO: 13777 - DNA, 395 bp, Homo sapiens
gtccgttgctgtcgggctcctgttgcaatatgaggctgatctggaagctctggggggggggagattgtccctgctgtcttttccagctattgggtacagcattttgggcaggagaatctaggaccatgccacatcaggtctctccttaacccattccattcgactgttatcacagctatgcttccagagtgctctgcgcattttcacgatcagcaaacaatgagcaaatctctgttctggaagctgggaagtccaggatcaaggcactgtcatctggaacctgaggagagacttcttcctgcatccttacatggggggagacaaaagagtggcagagaatgaatatactcccagcccattcgagagggaagagccctcacctcatcactttcctg

SEQ ID NO: 13778 - DNA, 386 bp, Homo sapiens
cgttgctgtcggcggcccacattgtccattattcaactgcacgtgtgtgctgcgtgcttcacatcctctattgagagttacagcaagtgttaaacgaggtgagttcacataacaggaattctggaactgcttgaaaactaggacgattgggcaatatcgggcttaactccacctgatggcaggtgacccggatagaaaatggccctgcgtttagccaggatgtggctctccagcttggcttcagtgtgatcacttggcagtgcgctttctctttcgatagtgaaatccttctctatacctatgttttgctttggttcttaaggtgggaaacagaatgggccacggaggttgagtgactgaagaccaagggttggtgcagcctcctc

SEQ ID NO: 13779 - DNA, 356 bp, Homo sapiens
aaggctgttgtcatgtggcagagagaaagccccttatgcgcgttaggggccagaagttggcgctggtgtttgtgcacggctgtgagtaagcgcgtaataaataaatcagaacgagatggacggagaccatgcgctgtgctttcatcctgctcatcccccagctgaggaggtttctgacccccatacccgtcctgcagccttcgagcaaatgtgtggaaaggaaaataacccatatcgaaatcagaacaacggtgttttaaaaatacgaattgagtctggccaggcgtggtggctcacgcctgtaatcccagcactttgggaggccgaggcaggtgggtcacctgaggtcaggagat

SEQ ID NO: 13780 - DNA, 352 bp, Homo sapiens
  misc_feature 352: n = A,T,C or G
ctaatagacatccaaatgcagcctacttgcaagcaggagttaagtcagtttcactctcgtatcttgtatttgtgcccccagcccttggagcgtaatgagaaggagccggcggcagggagacaggaaccacaggactccactccagctgtggattctaacccagacctcttcccccacatccactaattcttcacagaacctttaaactgggtgtgggctctctgcaagtttcgctgtggtttctaagtccttagtggttgatccacttgacaactaatttttttaagttggtagctccctgcggtatttgacagtttttggtttggttttgtttttgagacagggtctcacn

SEQ ID NO: 13781 - DNA, 298 bp, Homo sapiens
gaggcgggaggataagtcttaaagctgcgtttgcaaaacaagcatgtgtttactgggcggcataatagcttgggcagcttttgggaagagctgctacaatttgggagggatgtcagtttcacacctcccatcaaaggaaggtgaggaaatccactagacttacatcctccaggccaaaagctagaaagtgtccttttacctgcatgcttccaactgcgtgtccctgacgccctggtttcatggtgctcctgtacctactttaaggagactcaccccgcttgctcacgaacgaaagagg

SEQ ID NO: 13782 - DNA, 348 bp, Homo sapiens
tttggtattgccggtattattgatggtaaactgactaaaatcatacatggaataatagaaatcaggcctaacatcagatagacttttccattcagttaagttattgtgtagcaaaatttattttgtcagttcactacacaatgtgacagtatatagtttctctaatagagtaacattaaagaggacatataatataaccaaaaatttgagttccagataagtttggtgtctcactagcaagatgacgttaaataactcatttaatttttttgaaaacttaattttctgttctgtaaaataaaaagcaatctgtctcttgtccaaaagactatgtaggttttttaaaaa

SEQ ID NO: 13783 - DNA, 368 bp, Homo sapiens
  misc_feature 368: n = A,T,C or G
acattcatcaatgctctggaccatagcatggtgaggaaagggtagagcagctcagtgccccaaggcccagagcctgccaggccaggataggagagcatcccatggctggaggagccctggggcagccactgccctctgcctcccatagctccagacacaaatcaacagggctggcgggcctcccagtgtatagcctagggcaggataggggagtcactggcagccaggctttctaagccagagggcccttggagatctttcactgttgtttcccatttacagtcagtgaaactgaggcccagagagggaaagtaactttcccaaagaaacacagcaactgagtggcacggctgggattgtaactcccn

SEQ ID NO: 13784 - DNA, 349 bp, Homo sapiens
cacatacgcgtttctatttttcttcctctcctcctgatctccttaaaaatgaatctagagttggtggctttttccccctcctctttggccagttccacagttcagttcttcctgaaaacagggatgatgaacttgtaggatcaggacaaatgtgtgtttttcaaaaacttaaggctgggtgtgaaacaccttctgtggacaaggatttgtaaacttctctcctccctccagctgcggccccagcctaactgatagttacttgattcagtgtgctagacacttaaatagcatctatgtctctttcaagggaatttgtcaaataatgcgtgttagctaattgttgcaagca

SEQ ID NO: 13785 - DNA, 349 bp, Homo sapiens
  misc_feature 245: n = A,T,C or G
tccattgcagggtatcgccaggtgccttgaacttcccgaggcaagaagaccctggagacaggtagcagggtggccagggctggggtggcttcaaaactcacagacaagcagatgcttcaagtctgggaagcctaagcccaggtggctgcaattctgatgtcacctagataagccactgtcaactctgccatccccttccccaggctcagaggctgaggacagagaagctggggttgtgccccagntctttctagtaagactcaaaggacaaagggtgggcccagggaacatgggtgaccctggcctcatcctcagtgcccattgcttgcagggcaagggctccagcttg

SEQ ID NO: 13786 - DNA, 383 bp, Homo sapiens
cgttgctgtcgattgagtttaaccatgttccaagagaaaatacaattaatgaatagtcacaaggttgctaatctgatcaatgccgggtgataggacatttaatctgattgtctgtgactgcaattgcacagagctttggcagccaagaggaccgccctggctggcaagagcgtttgtagtctggtcactccttggggtggaggtggggctggggagctgtgatgtaaacagatgtggggaggagagaaggcgcccagagcatgagaggaactggctgaaaggatcgaacacagggaggtgagcccacagaaagtaggtacctttcatgccaggaatgggagagacagccccatttttttttctgagacagagtctcgaagtgg

SEQ ID NO: 13787 - DNA, 361 bp, Homo sapiens
cctaattccctcacaagcattcagtccctccaccctgaggtggtgaaatccctgcaggcatttataagtatacctggacagaagaaatacaagataccgttctattaactcaatatagtgttgctaagttcgtacttttgctttggttattttattttataaataggtatcactcgcatggttccaaatgcggtaggcacagagagtatatatgatggaattacatgctccttccctgcactcagcaaccgagatattcccgctacgggcactcaaaggtttcattgtctgaaatatcaggctaaacgtagttcatggttaggaagcaacaaccgtaaataatccccatccaaacggaggg

SEQ ID NO: 13788 - DNA, 365 bp, Homo sapiens
gggtgaagcaagtaaggagcataccttagtcacagcccggcccttggtgaatgggtgtactataaactaaatctgcctgccaatcatgggacaaggcagaacacttgtctatctctgtctaagctcccctgaaaatttatgaagagatgtccgctcgcacatgagtttgagactaaaacttatgtttcctaagtaaaacccacatcaggaaaaccctagtccagtaaaatccaataacaagaacttctcttatgttggtaaaatccgtggttgcttgagagaaacaagagagaaataaattatctctagagaatttaccaaagaaaatgaaccttaatccttgtctcataagatttctatagaaa

SEQ ID NO: 13789 - DNA, 396 bp, Homo sapiens
ggcacgagcggcagcagcgcatttggcttttccacctgctggtgccctggaggctctgagccccggcggcgcccgggcccacgcggaacgacggggcgagatgcgagccacccctctggctgctcctgcgggttccctgtccaggaagaagcggatggagttggatgacaacttagataccgagcgttccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcggtcctaccaggccctgcactgccctacaggcacttgagatacctgcaaggtgtg

SEQ ID NO: 13790 - DNA, 354 bp, Homo sapiens
  misc_feature 352, 354: n = A,T,C or G
cagcaggagatctgtccctgcttcaatccacgagaagcctcacaagtgtctggagggagaaacgtccttgaggacagtaggaaactactgtcctcagccctggaaactgtgctaggtaactcagacaaatcaagtggccgttcagcagcatcacactgcaggaagtatgttccacaggtcccttgggcacaaacccccagccaaccctcccacactgctgggaaatcccccttaggactttccctatttaggacagggcagtgctctgatgatttactagagccaaggccaacctgggttatagcaccacctattgccgaaaagaaggcagcaacctaggagaaaaatttanan

SEQ ID NO: 13791 - DNA, 265 bp, Homo sapiens
  misc_feature 186: n = A,T,C or G
cgatatctggaagggcagggacatgagctgggtggggggcaagtaggacctccatcagtggggatatgactcagctgtgagaagggacagatggagtgcaggtccagccaggggctgcagtggggctggggtccttagagctcagtatgagcttcagcacgaggtgggccttgtgtgtgcacgtangtccttcccggaaggcatctccagagtaaaggtcatggtcaggaatagttcatgattggagactgaaactgcacatagg

SEQ ID NO: 13792 - DNA, 378 bp, Homo sapiens
cgttgctgtcgcaccctgatggagacagagggggacagcccccacccatctgtccccggcagggctcttgctctcacagccccctggaacaagccccatgccccaaccttgggcctggctactggcccagaaggcaccaggcctcatgagaatgctgggggaccccaaagtggggggtcccataacctgacctcctggggctacacctcatgcctggacaagacgctgtgggctgtccgggccttgaacagccctgcagctgcacccccgatcctgatacctcaccccattcactgccagcatgctaaggctactggcgggcatcctctctgctcaaaattatagacctgtctccctgacacacctgctgtgccctct

SEQ ID NO: 13793 - DNA, 344 bp, Homo sapiens
tgaggtgccctgccaggaccctgccagctcttgttggacagggaccgcctctctcctgcccattgaccccagggccagatgtgggacagaggaatgtgcatggtgggggcctgggcttctccgtgtgtgtcctgtctccttccagcttcttagacgtggtggcccagagtgcttttcagtgcacccgagccatgatgagcgagtggctgtgatgacccacgcagccagtcctttgtgcaaggaggggaagggagggccctacccgtattcaagctcagctgtcggcactgtggtttcttgcaccctcttaaacctgagactccccctctgattgcagttgaacg

SEQ ID NO: 13794 - DNA, 348 bp, Homo sapiens
ttcattcgctcgccaccacagaaatccagaaacgaatatatagcaccagaatttttcaccagcaacaacccagaactcaaatatgggatgaaacaattcctggagccacaaaaaagtggagaaactccaagcagataggaaaagaatccagactcccacatccacaatgcccctcccccaaattcttcccagcgccaagcacacaggaaatcttccctcaattcacagtttatgtacttgaaaaagagagattgagatggtcaaccggcttccccaccttcttgggttcccagcaggagacttgtccttgctttaacccacaggaatcatcatgactgagtgaaggaa

SEQ ID NO: 13795 - DNA, 378 bp, Homo sapiens
cgttgctgtcgggaagaagagccaaccaatcacaccagagcttccaccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagcta

SEQ ID NO: 13796 - DNA, 349 bp, Homo sapiens
  misc_feature 296: n = A,T,C or G
acacccagaaaagcccgttccaagctcgggaagttgcagaggagaaaacctggagtctagcgtcctggctctgcctggtgatgggccagcggcccgtgcccagagaaacccactggaggaggatggagggcggccctgcccccgggacagaccagccttgaccggagcgaaggagggagtgcgccacgcaaagcaccacaggcggcgcgggggccttccctggaaggccaggctcctttccaactgggctgcctctcggcttcaacgtcctaaagcggggacggctgaaccccggncatggctgacttgactccacctcggaatacttgatagggttcgcctatcgctc

SEQ ID NO: 13797 - DNA, 394 bp, Homo sapiens
  misc_feature 394: n = A,T,C or G
cgttgctgtcgccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcgaagcatacagcccataggatctggaagagagaaagaacagcctaaagaaatggcttgagaaan

SEQ ID NO: 13798 - DNA, 282 bp, Homo sapiens
ctccccttcacatctggccagctgccatggggcctagctcaaagaaggggccccctcccagggccagcttcaggatctgatcctgccccccagctctaccccacaccatactatgctggcctcgctgagtcacatgtgcaggtgcccctcccctcaaacacctgtgacctcccagcctcataccaagtctttggctcttctgagacccctagcacctgttgacgcaactgtgctaatgagctgggaaagcttccccaaccccgtcccacataaggggggtgg

SEQ ID NO: 13799 - DNA, 396 bp, Homo sapiens
cgttgctgtcggtgcggcgtctgatttctttgtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggccttccctgctcgattttggacgaggcctaagtaaaccccctatgccctgccccagacctggctctttcctaaccccctcaacggtgggaggaactggcaaaaggtgcgcctgggcacaaacttcccggatctaaaggcccctttcagattttgaccaaaggggcg

SEQ ID NO: 13800 - DNA, 389 bp, Homo sapiens
tactacggttgcgacatgacgacagacggtgacgggtgcgggcagaccacagctggattgcgctgcgaaaagagctctatttgggacggctgcgatgctactgctgtatgtgtcgcctgtatgagctcgactaaacgggtctggctgcgacaatacgcactgattgtatgttttgcgttcagacgaaggagggggacggctttgttgagaattcccacatctttgggttcagcttggcattaaagagtgtagtgataaattattgatgttttttatgggaacggggagggcccgcacaaacgtcatgtacttgctatcctgatctactctagttcttttgtttttcaggtgaggaaactaaaatctactgaacttagtctataataagc

SEQ ID NO: 13801 - DNA, 385 bp, Homo sapiens
  misc_feature 385: n = A,T,C or G
ggcacgagatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccacagggaggctcaggggactggttgggccagggatgan

SEQ ID NO: 13802 - DNA, 392 bp, Homo sapiens
ggcacgagggtgtgtctgtgtttgagatgaggctgtcgtctttcaaagggtgtgtccatggctgttatccatgtagctatgtctctgtgtgaaggtgtggctattgtctgtgatgacattgcctcggagagtgcatctgagggatctacaagactgtctgtgtccaagagtgcagctgttggcggtgagcctgtgtgactgtggctgttgccttagagtgtgggtgtgtgggtattgcacagagggtgtatctgtgtgcagtggtgcatccgttagggtgtgtgggaacatgacgttgtctttgagagtggtttcatgagggttatttgtaagggtgtgactgttgcctgagagagtgctcgggtggtctttgcgaaactcggtgcctgttg

SEQ ID NO: 13803 - DNA, 381 bp, Homo sapiens
ggcacgaggcccccttcaggctaagtttcatgcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcacgagtggagaaagggaaaggcaggtctggtgt

SEQ ID NO: 13804 - DNA, 387 bp, Homo sapiens
cgttgctgtcggacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaa

SEQ ID NO: 13805 - DNA, 386 bp, Homo sapiens
  misc_feature 386: n = A,T,C or G
cgttgctgtcgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaan

SEQ ID NO: 13806 - DNA, 364 bp, Homo sapiens
aataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaacctggcctcgtaatgcagcctactatagccctcatggacatatattagcattagctggatttggaa

SEQ ID NO: 13807 - DNA, 389 bp, Homo sapiens
ggcacgagcagcaacaagttcatgctggttctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacagggaggaagtgctcggaggtcgctcggctgacggagggcatgtcgggccgggagatcgctcagctggccgtgtcctggcaggccacggcgtatgcctccgaggacggggtcctgaccgaagccatgatggacacccgcgtgcaagatgctgtcccgcagccccagcagaagatgg

SEQ ID NO: 13808 - DNA, 393 bp, Homo sapiens
  misc_feature 393: n = A,T,C or G
cgttgctgtcggatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatan

SEQ ID NO: 13809 - DNA, 395 bp, Homo sapiens
tgggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgg

SEQ ID NO: 13810 - DNA, 396 bp, Homo sapiens
ggcacgagggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacc

SEQ ID NO: 13811 - DNA, 319 bp, Homo sapiens
tattattctcattggctgcggtagatgaggtatttttaggccttacctaattcatctgtaaaaaataagttaatgttttttgaatgcctgctactggggccaagggttagacgtagctcatctcagtgtcctctaccaccttacagggagagaataccgtttgcaaataggggcccaaaaagatcactgtgctggcccaaagtcacacagctgataagtggcagggcagaggcctcattgtgcctcccagtacaaagatagcagtctcttcctgcattacagaattgtgagaatgagaagataatgaaccagaaagcac

SEQ ID NO: 13812 - DNA, 301 bp, Homo sapiens
atgcctggctaattttttatttttagtagagatggggtttcaccatgttggccaggctggtctcgaactcctgacctcaagtgatctgcccaccccagcctcccaaactgctgagatcacaggtgtgagccatcgtgcctggcctgtttaatgaatttctgactggaggcttaatttttttgtttttttcacagggtctctttgagaggatgacagtgggaagcgcctactgtggctgttgcggctgcaggcctggctccttccactctcgggctgcccttcacggtgccaggtttgtggg

SEQ ID NO: 13813 - DNA, 340 bp, Homo sapiens
tatttttgcgtggaatataataatatctgaaacctccacaggtcctttatacataacattctacctacaaataagagtcactacacatgtgaagcagcaatgtcatatgaccaataatcaagaggggaaaaaaaaagcaaaacaagcaaatagatgatctgcataattgaagttaacagacaagaactttaaaacaaccataattgggacttctggatagctaagggcataacagctgcaccatttagctatatgcctccctgtatttcctccctaaagaattaaaaccaacaaaaaatggtatgtaaatctagacgaaaccatgccttcggcataactt

SEQ ID NO: 13814 - DNA, 328 bp, Homo sapiens
ggaaaaaaaagcaaaacaagcaaatagatgatctgcataattgaagttaacagacaagaactttaaaacaaccataattgggacttctggatagctaagggcataacagctgcaccatttagctatatgcctccctgtatttcctccctaaagaattaaaaccaacaaaaaatggtatgtaaatctagacgaaaccatgccttcggcataacttgaagacagagaatgctaaaatattaaaatgaccgtgactaggctgggcacagtggctcacacctgtaatcccagcactttgggaggctgaggcaggtggatcacttgaggccag

SEQ ID NO: 13815 - DNA, 324 bp, Homo sapiens
aaggcagcaggtgccagtgtcagtaaaggccctgcctggctcccttgctgagaatccaggctatgcctgagctagggtgtgcacgtgtgtgtgactgtgtgtgtgtattgcaaaacaaagtttcttgggtttagctagatttcattttaccttctgagtgagcttgtattttccatggaaaatggacaattctttcttttccataggtcaggaagctgttcctgcattctttgggaccagaaaaataattttcatttatcttctgtcattatctgactctttcctcctaaatctcatttacactgatgtaaatgtaatatttta

SEQ ID NO: 13816 - DNA, 333 bp, Homo sapiens
tcattacattattttccttgtaattaatttgctaaacggaggtgaacaaagtagtcctaaactaaaatttatttaccatttctcctttaaatacaaagacaaatatgatctattcatgacattataccactgtttctgttatttcccatattaacttggcgtagttgtttaaaacattcttttcttctttgtagatgaagaaaatatgacagtgaaataacgattactattgatcagtcatagttgtttaaaataatgtctaatgggctgggtgcggtggttcacacctgtaatctcagcactttgggaagccgaggcgggaggatcacgagg

SEQ ID NO: 13817 - DNA, 341 bp, Homo sapiens
aacggccaggaatgctcacaaatatagtgacagtaatggtgtcattctgaggccttcgcctcaaggcagggcttgaaaggggataaagtctaatggcactagctggcatttcaaattctagatgcctgaggcagactggcaccgaaacagctcctcgtttctctcaaagtgaacatataattcatagagggttaacaaaataatatcgtgaagtttttcccctttaaatctctaacggtggcggggcgcggtggctcacgcctgtaatcccagcactttgggaggccgaggggggaagatcccttgaagtcaagagtccgagaccagcctgggcaacatcg

SEQ ID NO: 13818 - DNA, 332 bp, Homo sapiens
gtctgatcatatatcctgatttttaggtaagaatacatagccatgacagcaagagaatatctctgcagcttctgatgtacactgaagagcaaaataacttaagacatgtaaagttaggtgcctcaaaaagtaaacactgcatgctcccaaggggaaaaacaattctacaaaacagagagttaaaaaaagagaaagaggccgggcacagtggctcacgcctgtaatcccagcactttgggaggcgaggcaggtggatcacaaggtcaggagattgagaccatcctggctaacacggtgaaactccgtctctactaaaaatacaaaaaattagg

SEQ ID NO: 13819 - DNA, 328 bp, Homo sapiens
ctgtgttgcaggcataaacccaagtggcttttaaagatcagctgtgattaatagtagtcagttggaagtcagagtcatcagtttaaaatttagctcaacaaatggtggcttgcttggtagttcctgtgtttaacattatttttggaagaaaaagaaaaaaaaggaaggtagaggaagggagaatgttttgattgttttctaatttattgatctctcccttgcatcatcaccaagactgttaactggttcccagaatgttgtgggttgagcttctgtgctgtaatgtggtttgatttttttagaggggagataagggtatctcctgtct

SEQ ID NO: 13820 - DNA, 319 bp, Homo sapiens
gagaactaagtattttctctgcattagccataacacatattattttaattaaggtttctgtttttttaatcacctcatggaaacactgagtctaggctgagatgggggcctttagtattggatgaggctcacttatgcccactagcctttatgtaggtatgttttacatttcttaacatgcactcatttaagtgtatgattaaatgactttcagtaactttagtgagtggtacaaccatcactagaaatcagttttagaacattttatctcttcagtaagatatttgtgactgtttacagttaatccctgttcttacct

SEQ ID NO: 13821 - DNA, 332 bp, Homo sapiens
tctgctatcctacttgagcttctgtatccacttgtggtaccacatgcttcacagtgttttgtcatggtttatttacatgacaatcaccagtagaagtttggaagatttttgaagataggacactatcatcatcattttgaatctctactatctagtactaacccacaaataacaagcacttgagaaatgtttgagtgcctgagtggatcagctttccacttggtaaaactttaggtaaatttcatcctgttaaactggtcctgtgtattagccgctcacttaccaccatttgtctctctttcacatcaattggtgaatagaaaaatggctct

SEQ ID NO: 13822 - DNA, 177 bp, Homo sapiens
cacttgatgcatatactaaattttctttgatcaattttaagtgcctcaatttttagtccctttaattagaaggtagccagtatccagtaccaaaaattgagaacactgtttcctgatctaaagagttcctttttactgttcatgcttgctccaaagatatttttctcatactgatgg

SEQ ID NO: 13823 - DNA, 328 bp, Homo sapiens
  misc_feature 328: n = A,T,C or G
atgacctgacaatttcatatacaaatacattgtgaaatggttaccacaatcaaattcatgaatatatccatcaccacacatggttaccatcctttgagttttaaggtgaattaatggaatgcgtgtcattcatatgcatattcatatgcatgtcatttgcataccattccttgactcaagaaagttgctatatgagtgaaagataattattgatcatatgaacttaagatacaattattctcatctggccaggtgcagtggctcacgcctgtaatcccagcactttgggaggcagaggcaggtagatcacttgaggtcagaagtttgn

SEQ ID NO: 13824 - DNA, 335 bp, Homo sapiens
  misc_feature 318: n = A,T,C or G
cccactgaaagttattacaaaaaattgtgcagagtaaatcaactaatcccagtgaatcaactaatccaaggctgtgatcattttaataactctccacaaaggctcagaaaatttctccacccatgaatttcttctacacagctgtgattataatgtgatacaaaagcaacatccttcagctagtgcagttgccaggagagagtggcagagccgcagagtgtggggtagaccctacatttgaatccatcagcaagccgtgctttctgcctctcaacacaggcacagcaagagtctttaaaggagaaagacaactgcggngcctggtaaaccgaaat

SEQ ID NO: 13825 - DNA, 329 bp, Homo sapiens
  misc_feature 285: n = A,T,C or G
cttagcacaacacagaaaagctttaaacactcttacctttgactggaattacacacacacacacacacacatacacacacacacatacacacacacacactaaggctttcccacaaagccatgatgcatccttaaaaataacacacagctctgaaaagtgaatgtcgggggtgaagagagccctcctacactccttttcctagagatgacaaggttgtgggggcatggctgactgtgaggagcaaaaaatgagagggagatatcattttacttctttgtactgcnataataaaaagaacagatagaatggaaggaagaggccaggggca

SEQ ID NO: 13826 - DNA, 229 bp, Homo sapiens
atttttttaatttaatatgttacaaaatagctgtagtatcatatttttaattgatggatggatttatccacatgaacgacatggcataatctatgcctaatactctctacccagctgggcattgttgactattcaatgtttacgaaatagatcccatccctacttgactccagaagtgctattttctaagtacatgttgaaaagtataatttcaatcagtcaagaatcc

SEQ ID NO: 13827 - DNA, 267 bp, Homo sapiens
gcccacctacagtcctggcagaattggacttcagcagaaccggggtcctcccttttgttggcctgtggggaaacacttctgatgggcccctttttgtaaggttgcaagtagtcacatgaatactatcagccacactggccagatcaggggacaatcctatgtcctgggacttgaaacgttcttgtccacgtgtggcgcttggtgactaccatggccagggaccagcaggccctgtctgccttcagcctagagcagggctctgagccg

SEQ ID NO: 13828 - DNA, 338 bp, Homo sapiens
tccaagtttccccaaacatcttacagtttaagtgagggtaaccattgatagactatatattgtaaaaagatactagtacttctgaggaaatttacaattcagcaacacaacttataaaataccattaaaatgctgtcttctattcatactgcgaaaacctatagagctattttgaaaaaacaaaaaccaagaaagctctttatgtccttgacatagtaaggtctctaaatatatagcaaatagagaaagggagatcagtacagtgtgtatattatgacaccatttgtaaaacattatctgcgttcatcattttcttatatatgtataaaataactcag

SEQ ID NO: 13829 - DNA, 325 bp, Homo sapiens
gagaactaagtattttctctgcattagccataacacatattattttaattaaggtttctgtttttttaatcacctcatggaaacactgagtctaggctgagatgggggcctttagtattggatgaggctcacttatgcccactagcctttatgtaggtatgttttacatttcttaacatgcactcatttaagtgtatgattaaatgactttcagtaactttagtgagtggtacaaccatcactagaaatcagttttagaacattttatctcttcagtaagatatttgtgactgtttacagttaatccctgttcttaccttgaggc

SEQ ID NO: 13830 - DNA, 336 bp, Homo sapiens
tcatctttgtaatatctacatgcccagtacctaatatatatttattcaatgtgatatttcttatcaattcatacctgagaattcacttaactttgccatcacatgagttctagcaagcaggaatatacagtgattatgcctagaattttaaacatcagatctgacctaagaaataacaatcccaactgtaagaaagaagtggtttggggaagtcaaacactaaagaaatactttcaaaccagtctaaaactaactaaatggttaatcttatattaacaaaaacatgcaacctagattaacaaaagcatacaaatctcaatttcattatgtgcattt

SEQ ID NO: 13831 - DNA, 323 bp, Homo sapiens
actaaaaatacaaaaattagccggacgcagtggcacgcgcctgtaatcccagctactcaagaggctgaggcacgagaatcacttgaacccgggagggagaggttgcagtgagccaagatcgtaccaccgcactccagcctgggtgacagagtgagactctgtctccaaaaaaaaaactttgcttgtatattatttttgccttacagtggatcattctagtaggaaaggacaataagattttttaacaaaaatgtgtcatgccagcaagagatgttatattcttttctcatttcttccccacccaaaaataagctaccatatag

SEQ ID NO: 13832 - DNA, 340 bp, Homo sapiens
ggaagggtgagattttctactgcattagttgaggcaatattagctataacaaaacagatcaaatagtgtataatgactcattccaaataaacatttgtttttcatttatgtaactattgcaggttggtaggggactttctcctccttgcagatattttggaatccacctttgaagatgggaatacaacatgtgacttataagatttagtaaatagggaatacagagggcaaatggaaattcagtaggcaacaaatggtgtccaatgttataatcattcatgtgaagtttggtaaatatcccactccattgttttatagtctgaacacttgattttacata

SEQ ID NO: 13833 - DNA, 321 bp, Homo sapiens
ataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaaatttgggtgtctcttgtatattttttgtaagaatctcattttttatgcttgaaagatttggtgaaaagaatgtggttgaccataatttgcaacattgtcttattaaaaataaact

SEQ ID NO: 13834 - DNA, 327 bp, Homo sapiens
  misc_feature 214: n = A,T,C or G
aagcccaaattttaatgcacttctgactttaaaacttgttatttcttatatatcctttgacctccttagaactgacatttaactccctaaaaaaatactagagcttgttagtcaggcaaactacatttactagacttactagtactctcattgaagaaacagtgagtatattagtccattctcacattgctatccagacacacccaagtctggngaatttattatttatttatttatctgaggcagagtcttgctctgtcacccaagctggagcgcagtggcgcgatcttgtctcattgcaaggtcgattctccaagttcaagggtg

SEQ ID NO: 13835 - DNA, 193 bp, Homo sapiens
caaataccttctgtgcaaagatagactatgaataatgactttgttttcttctatttattcatggtcaggaaggacatattttccttccttactatcatcttgctgtcaaacttcttgaggttaacttggttatatagtcttttacttggaaaggagagtagttaaatctgaccaatttaattgatcagaaaat

SEQ ID NO: 13836 - DNA, 334 bp, Homo sapiens
ggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaagaggatgatccagaggcttcggaggagggcgacgtgggaaggagcaggtagcccaagctcccatctcccacccaatcgttcgggcagcttggatccacgtaacatcttgtcattctaaatatgtcagatttaacttggaaaacaaaaaaaaaagaattccactcctaaaaaattttactaagaaatat

SEQ ID NO: 13837 - DNA, 326 bp, Homo sapiens
gactgtatctcattggggatacgaagctctacacacttgaagatggtgaaggaatataaaaatctatgtctcacagtccagacttggagtacaagtaataagaagaataaaacttaatcccttaagtagattcaccataagttagctcagagcaattccagtgcaagtatggtctgtgatccagtagtatcttacagacagcaagttgaacattgtgggatgcatgagctattgaggcctttgcagctttctgctacatggaggctagggccagagtcaagatttatgctttgcagcacactggtcagctgtttttgcaaatcaag

SEQ ID NO: 13838 - DNA, 329 bp, Homo sapiens
aaataagaaaatgtaaaggactttgacaaatgtaccggctcagaacattctgagaagacaattttttaatgtaaaggtgatgattgaatagttggatatgtgcacgtttagcaaaaatgggttaggcacagttaagagtaggtattttattcaggaagaatagaaggcaactagatgggggagtttggcctgagttttgacatttgatagaaatgattgtgttttctttttttttttttttgagattggagttggtttttgtcctccatgttggtagtttttgggactttttcttgggttacacatcttctagttctctgtagtgtgag

SEQ ID NO: 13839 - DNA, 337 bp, Homo sapiens
aaaacattaaatcttccctggggaaaggtacatcatccagagatgcaatatttaaaaagaatgccccgcattcatacaaacattatgaggcgtatcagaaataagaccaaataaccaaaaccataagaaaaaaagacaaggaaaactcacagacgattggctaatgagactatcacagataattttttttaaatctattattaacatgttcaataaaaagatgaaaagatggagaattttattagagaaatggaatatctaaaaatgaattacttgaagagttgctaaatgaaatgtagaataactgtaagtgaaagcacagttggtgtaacagcgg

SEQ ID NO: 13840 - DNA, 330 bp, Homo sapiens
tgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagccgtgggtctgatgaaaa

SEQ ID NO: 13841 - DNA, 185 bp, Homo sapiens
acgacagaaggggggctaccccggctactcctgctcagcatggctgctttagtgactgttctcttcacaggtgtccggaggctgcactgcagcgcagccgcttgggcgggcggccagtggcgactacagcagggactggctgccaacccctccggctacgggccccttaccgagctcccaaactg

SEQ ID NO: 13842 - DNA, 339 bp, Homo sapiens
gaacatcacactccggggacagatttttttctaacctagccgcacaactgctctaaggttttatacagaccttctgcctcatcagcttccatctcatctcatttcatgctggatctaaaaatgactctgctgcaggaacacacacactgcctgacagggctatcttaagggcctttataaggaagcagatggccaggcacaggggctcatacctgtaatcccagtactttgggaggccaagatgggtggatcacctgatgtcaggagttcaagaccagcctggccaacatggtgaaacctcatctgtactaacaatacaaaaattaaccgggtgaggtc

SEQ ID NO: 13843 - DNA, 331 bp, Homo sapiens
cctgatatcaggtgatccacccgcctcggcctcccaaagtgctgggattacaggtgtgagccactgcgcctggccaatactccttttattttaaaaaggacaagttagacactagtttgcatgcatagcttattgattatcctgcagtggggtcatagctccccatttgtgatgccggaagattgcctgtggaatcacaagacctcttccaatgttctgttatgctataaaaagaccagaacttttacattttaaattaaaagaatgtctgtgcatttttaaaaaataataaaacaaaaccagtagttgtggcagtagtagctggtagtgg

SEQ ID NO: 13844 - DNA, 339 bp, Homo sapiens
gcatagaagctaagaaatagtaaaacttatgtaatcacattatgcttgggaaactgttttcttgcaaacaaaggtatttgtctcttatttattgtgttgatcatgaaaatagtatctctaccctgaggtgttacaaaaaattaatcaagtcagcatgtatactgcatatgtgtcttctggaatatttaccatttaatcaagaacctaaaaaatatataacctagctcccaaaaagtaacatcagtggttaattgtcaggttaaagaaaagtaaaataaggctgggcatggtggctcacgcctgtaatcccagcactttgggaggtcgaggtgggtggat

SEQ ID NO: 13845 - DNA, 205 bp, Homo sapiens
gtgttcctggcccctagcgtggtaggtgcggggttgccagccccgctgggaagccccagccacaccccagggtgtttgctgctctgaggcctgggcctgcctgggtgctaggcttggggctaggggggtgagcgcggatgttttctaacgtgccttgtcacgcccactctagtgtgctggactctccctgagatcccgctgctgg

SEQ ID NO: 13846 - DNA, 281 bp, Homo sapiens
tgtttgcatatacccaaattgacctcaaataactttccaaatggagtcttcaacagtaagttgaagtccaatattgacaaagcattaaccttctagtgttattttagcattggcctaatgttagcactttctataagacaaatttcagttactacatcatacctcattactagctgttgcttgaagtcaacatgttagtttatctatttcaaccttgtccagtaaattatatgcaagttcagaaataaaaaaaaagtatatactattcaatctctgagatc

SEQ ID NO: 13847 - DNA, 189 bp, Homo sapiens
tcaattatgaaattactcatttaattgtattgaaatatgtgttatttaaatctctatctgtaacctacgggtataacaatatgtctatactgaggtaataatcatttaacctggcataatatcaattattttagaaaatatgtaactgaaaactcttccttttcataagagttggggaaacatctgatt

SEQ ID NO: 13848 - DNA, 331 bp, Homo sapiens
cataattcagtttacagcaagaagataaattatttttgcgtggaatataataatatctgaaacctccacaggtcctttatacataacattctacctacaaataagagtcactacacatgtgaagcagcaatgtcatatgaccaataatcaagagagaaaaaaaagcaaaacaagcaaatagatgatctgcataattgaagttaacagacaagaactttaaaacaaccataattgggacttctggatagctaagggcataacagctgcaccatttagctatatgcctccctgtatttcctccctaaagaattaaaaccaacaaaaaatggtg

SEQ ID NO: 13849 - DNA, 325 bp, Homo sapiens
ttgtaaaagagttcttgagatacagcactgaatgtaaaggaaaatattggagcattcaactacatttgagaaataacttctgtttattaaaagatactataagaatgaaagcacaagccctaatgaatattcttgtttgatactaaaccaaagcttgagaagtggtagtttcgcaagtttttcaagtggtttggtgcaatctgaagactgcaatcccatcaatgaactttatatctttaccctttaaaattataatttatgggccgggcgcagtggtttacgcctgtaatcccagcacttcgggaggctgaagcgggtggatcaa

SEQ ID NO: 13850 - DNA, 333 bp, Homo sapiens
agtgtagtggcatgacctctgcctcccgggttcaagtgatcctcgtgcctcagccacctgaatagctgggattacaggcgtgtgccagctaatttttgtatttttagtagagacagggttttgccatgattgccaggcttgtcttgaacttctgacctcaagtgatccacctgcctcagcctcctaaagtgcactatttatggtgaggggttggttttgaaatagtccattaaggtgattagcatttgcttttgataaagacgatttacgggttggctgcttttgttttcatgggagataagtcccccacttctgctatggcttaaagtggtg

SEQ ID NO: 13851 - DNA, 340 bp, Homo sapiens
tgaagattaagaggcagggattcaaggctgaggaagcaacatgcacaaacaaagttacaatatgacaccttcaaggaagaccaacaaggtagaaataggcctgaaattccaggtctattagacagaatgggaggagatcaaacagtaaacagattaggcagagtaggaggagatgaaacagtaaagtcagaggccagctcaggaaagattttaaaggccagtcaaacatggcacagggagccgtaaatgaactggtaaattaagatcacgggctctggaccatacagcctgagttcagatctctgttgccccacttcctatttgtgaggcctgggactac

SEQ ID NO: 13852 - DNA, 315 bp, Homo sapiens
gatgctaaggtcaatgggagcaacttaggttaaagggtatctggagtgcgatgagcagctagcaattttaaatagggtgctcaaggaaggcctaatttaattttcatgaacagcacttacagagtttaagagatgacaagaggtaatatctgacttttatgagaaactctaaaaggataaatgcataggtaaaggctcaaacctaattttaataagtaagacttaaagaactaaatatgctgctatcagatgcttttcccctaacccatttattttaaattctatgcatatttatagaaatattaataatgtcac

SEQ ID NO: 13853 - DNA, 336 bp, Homo sapiens
cgtacaagactcaggatgggcctacttccagctaccattcagtataggagagggaagagaagtgtgagaaagcccaaggatggatctgagggaggataacagaaaactaggttcctaactcaagatgagattaagttctcctttctagtatttattttgaagaagtcagggaatcaagaaaatctctgaacacttatataactgctgataagactgtacattagttcagcccctgtgaaaagcagtttggaggtttctcaaagaaacaaaaatataactaatattcaaccccagaatcccattactgggtatatacccaaaagaaaataaaatggg

SEQ ID NO: 13854 - DNA, 341 bp, Homo sapiens
agagccaacctgtaactgctgatttagttactctatttagtcatttctaggtggagacctatatttttagccccagagactttcttccttctaaggtgggacaggaaaaccacgtgaaaggcgacatgctatcagaggcccagagaatctggagatggcagaaacttggacacatagaaaaacagggcgtttggggccgggtgcggcggctcatgcctgtaatcccagcactttgggaggctgaggcgggcagatcacgaggtcaggagatcaagaccttactggctaacacagtaaaaccctgtctctactaaaaacacaaaaaattagccaggcgtggt

SEQ ID NO: 13855 - DNA, 331 bp, Homo sapiens
  misc_feature 331: n = A,T,C or G
gttataattttaagcaacataaacaagtaagaataaatattttagaagtgcgatgttatatttcttggtttaagtggtagattgatatatgttttctatcatactaataaacaacttgtaaatatcaaatgcttcataatttagaaatgtaaaacatgataatcaaatccaaaagtaatctaacacatttaaaaactaaacatatttaggccaggtgcagtggcccaagcctgtaatcccagccctttgggagaccaaggcaggtggatcacctgaggtcaggagttcgagaccagtctgaccaacatggagaaaccctgtctctactaan

SEQ ID NO: 13856 - DNA, 337 bp, Homo sapiens
gagtctttccaaacacatccagtgggtcttcttttatttactcagctttttgtttgtttttcttttacaggaactataacatttactattggcaaactccaacaccatcctcagtaatttgggatgtctgtcaataccatcgttctgatttctgaaaattttcgctgaatgtgacatttttcctctcaaactaacccctccacagacacacccacacacacaccacacacacatgcatgcgtgcacacacagacacacacgcacatacacaccacatacacgcacacaaggcacatacacacacgcacacacacatgcacacacgtgcacacatacg

SEQ ID NO: 13857 - DNA, 322 bp, Homo sapiens
gcatgcccctagggaggtgggtgtgatcagttttttaacaatttttaaagcttaaggattcattaggaaatttgaggcttgttataattggacagtaacatcaaaaaatcatctacagggagtagcttttttcttttttttttcggagatgaagtctaactctgttgccaggctggagtgcactggtgcaatctcggatcactgcaacctacgcctcccggggtcatgccattctcctgcctcagcctcctgagtaggggggactacaggtgcctaccaccacgcccagctatttttttttgggacttttagtaaagacagg

SEQ ID NO: 13858 - DNA, 325 bp, Homo sapiens
tctcacttgatcctctcagcaaccccttgaggcaggtactaatgtgatctccatgctgcagatggggaaactgaggcccagggtttatagaatcaaaaggctggcacatggaattggtgaggatcctgcaggtcctcagcaggatgcgaggagtggcctcccagggacaggaagagccaagagcagcaggagtacagcagtgtgagaaagaaaatgccgtcagaccatgtgaggtggctcacgcctgtaatcccagcactttgggaggccaagacagaaggattacttgaggtcaggagtttgagaccagcctggccaacatggg

SEQ ID NO: 13859 - DNA, 221 bp, Homo sapiens
  misc_feature 221: n = A,T,C or G
atgctagatgactccatcagccaatatgttagcattatctagaggccttatgtgaagtcctagtggtcctttccagttctatgactttaaacatacaggtgaatcaaagcttcaggaaggcctagaccaacagctattactgaagctcccatttgtgcttaggactatgcatagagaaactctcctttgggacttggttagggtccaaagccctaaggtcn

SEQ ID NO: 13860 - DNA, 289 bp, Homo sapiens
  misc_feature 289: n = A,T,C or G
tagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacn

SEQ ID NO: 13861 - DNA, 340 bp, Homo sapiens
  misc_feature 260, 261, 262: n = A,T,C or G
cagtttgttcttaaagttaaactaatggggaaaaaaaacaggacagggaggtatctcaagttcatttgagccatttttaaaattttggtagctggtttctgtttttcttctttttaaaatagcaacaacttaagattttgtgtgccaccagcttccattccatttcataaaagcttaatctagcaagaattggtgagccctagtagaagttagaaagaaatgttgaagtgtgtatgtgtgtgtgtgtgcgtgcgtgtgtnnncccatcatactcaccttggacactttttaaaaaaacgcccttggctgggcgccggggcccccccctgtaatcccacca

SEQ ID NO: 13862 - DNA, 315 bp, Homo sapiens
ccatggccaggcttgtgagctcacatcagaaatgaaattcagaagtcattcagaatcttaccaaatccagtttttactcttgatttaaaaatattttactttttaaaattaattattgtggctcgcccagacttggcagttagaattgaatatcaggaaaggttttaagacaaacctgacgaagaaagttgaagtagtcacagtatctagaaatacaagagggcctcttttctcaggcttatattttgagataaatttcctctccttagtacatgcagggaacatttcatttcataagtttgctgattaaaaagg

SEQ ID NO: 13863 - DNA, 319 bp, Homo sapiens
aggacactggcttgccaaacaggagtctgggcacttagcagccagtgctctgtgcaaaccagccagtgctctgaattcagatgagagctttgtgtttgccttattggaaagcccttgattcctgggcttctagaggtatgtatcactcaaaatctctgcagttcttttagggtaagtgaacgctttacttcttcatctattagaaaattattctctcagcagggtgcggtggctcactcctgtaatcccagctcactcctgtactttgggaggccgaggcgggcagatcatgaggtcaggagttcgagaccagcctgac

SEQ ID NO: 13864 - DNA, 328 bp, Homo sapiens
  misc_feature 109, 110, 115, 117, 118, 129, 135, 320: n = A,T,C or G
ctgttgcccagactagagggcagtggcaccatctcggctcactgcaatctctgcctcccaggttcaaatgattctcctgcctcagcctcctgggtagctgggattacanncgccngnncagagcccaantaatanttggattgtttagtagagacggggtttcaccatcttggccaggcgggtcacaagctcctgaccgggtggagaagggcttttacgagtagaatgagccttttgggaggtggctgcctgcaattctttttttgattggattcaaatacgctgcttgagcttaagcaccttacgaacttttgaagatnttaaaggt

SEQ ID NO: 13865 - DNA, 339 bp, Homo sapiens
cttaatcattcttacagtatttgagttgagaacatttataaagatttcaagcattacagtataaacaatatgagaagattcttccaaatcttttaacttgaatgcaattattagcatgcccctagggaggtgggtgtgatcagtttttttaacaatttttaaagcttaaggattcattaggaaatttgaggcttgttataattggacagtaacatcaaaaaatcatctacagggagtagttttttcttttttttttctgagatgaagtctcactctgttgccaggctggagtgcagtggtgcaatctcggttcactgcaacctccgcctcccgggttat

SEQ ID NO: 13866 - DNA, 194 bp, Homo sapiens
gagcacctctgtgttcctaggtctgtgcagtgacttgggagtacagtgatgaatgggaccatatggtcccaccctcatgggcagtctctaattcctgccttatgaactgaagatctatttcttgtcctgactttatattcttcatggctaaaagatttggggcctctgaagagtgcatttgaactcaggcatgg

SEQ ID NO: 13867 - DNA, 339 bp, Homo sapiens
gatgccttgagagtttcctgttgcacaatctgtttgtctgtagagaagtggcatccagagggcggtaggggaggaaaaaaaaatgaagtaatgggacagagcagacacaggtaaagagggccttaggtcctcaggaaaggggaaagggagggatatggcccttccctccaggtcctcatatttgttgccccttgttctggaacggacccagaggcttgccttcagagggttctaatttactctgtattctgtgtggtaaaagcaagaggcagcatgtccagtggactgtgagactgagcactctaaagccagtagggtcaagtcactggtagcccactg

SEQ ID NO: 13868 - DNA, 333 bp, Homo sapiens
actgcaacctctgcctcacaggttcaagcgattctcctgcctcagcctcccaagtagctgggattacaggcgcccgccaccgtgcccggctaatctttagtagagacgggagtttcaccacgttgcccaggctggtcttgaactcctgacctcaggtgatcctccctccttggcctcccaagtttttaaaagatcatgctatgtggataatgagctggggatggagggaagaatggacctagggtggaaaccactggttagagtagagccacttcaagtgcatgggtttgggctataaaggtagtgctgtgagcaaaaattaaaaactcttgc

SEQ ID NO: 13869 - DNA, 340 bp, Homo sapiens
gtgctgcatgtttaaagtattccctctgttttacttcatgatagttggcccctttcaggttataacacggacatttttctatggttttcattatttgcacatgccaacagagtagaatagatttttaacgagcatcacttcattgcaagcaaatttattaatccagtggtactgatgaaactaaggagctctttggggtcaggctcgatggctcacgcctgtaattcttgcactttgggaggctgaggcgggtggatcacaaggtcaggagttcaagaccagcctggccaagatggtgaaaccctgtctttactaaaaatacaaaaaaattagccgggcc

SEQ ID NO: 13870 - DNA, 322 bp, Homo sapiens
  misc_feature 322: n = A,T,C or G
ctgtgttgcaggcataaacccaagtggcttttaaagatcagctgtgattaatagtagtcagttggaagtcagagtcatcagtttaaaatttagctcaacaaatggtggcttgcttggtagttcctgtgtttaacattatttttggaagaaaaagaaaaaaaaggaaggtagaggaagggagaatgttttgattgttttctaatttattgatctctcccttgcatcatcaccaagactgttaactggttcccagaatgttgtgggttgagcttctgtgctgtaatgtggtttgatttttttagaggggagataagggtatctn

SEQ ID NO: 13871 - DNA, 318 bp, Homo sapiens
tttccctgctcacatgttacctttgacacactctggatctgaggaagtccctaattatctcttgcttttgcagactgcttacttgctgtgtggctctaagcaagttacttagcctttctgggccctggtttcctcgtttatgaaatgaagatgatatgagcacctaattcatagggctactgtgaggatatttaagttatttaacaatgactggcccatggtacttattccaggaaacaaatgagtataattataagtattttcaggacaattctctgtgatgtaatcactcctattttacagagaaggaaacatatt

SEQ ID NO: 13872 - DNA, 326 bp, Homo sapiens
  misc_feature 326: n = A,T,C or G
ggttcaagtgattcttctgcttcagcctctccagtagctgggattacaggcgcgcaccaccatgccctgctaatttttgtatttttagtagagtcggggttttaccatgttggccaggctggtctcaaactcctgacctcaggtgatctgcccaaagtgctgagattacaggcatgaaccaccgggcctggtcaagaataaggtcatttattgttgtataggcaataagtgtgaatcaaggatacttttaaaaactcataggtgagcccgggcatggtggctgggatcagcctgcacaacccgtagtgagacaccatctctacaan

SEQ ID NO: 13873 - DNA, 342 bp, Homo sapiens
aggatttaaaacatttcctgcagagagctcatagctgggtttatcttatagattaaaataaaaaggagctaccagaaggtctgtgtgtccaatacactttgttaccatctatcaagtctattttcttaagttgtcagagctgtttgcattcataataatagctttatcaagaatcagctccttttctagcatcaaaagttaagaatttaggccaggcgcagtggctcacgcccgtaatcctagcactttgggagactgaggcgggcagatcacttgaggtcaggagttcaagaccagcctggccaacatggtgaaaccatgtctactaaaaatacaaaaatg

SEQ ID NO: 13874 - DNA, 317 bp, Homo sapiens
ttgtattaggtaatagaagttaggatttcagaacgtcatgggagacctgggggagactgcttgttttgaagttgaaagcagtacattcaaatatgtaagtgacagcatagaaaaatgtatatagggttaacgtgcagaggtctgtatttaggttttcctgtaagtttaaatcctgttgtttaaaacaaatattcggataagaataacactttaaaaccattcaagggctgggcatggtgactcatgcctgtaatcctagcactttgggaggccgaggcagaggaatcacttgagcccaggagtttgaaaccagcctg

SEQ ID NO: 13875 - DNA, 316 bp, Homo sapiens
ccttatatatgctgtactgaagacatactatcacattaacgttgcgtttatgtctatgcgtgagaattgtatttctgtgcctaagaactttgggggaggaatcattattcctgctctgatattgacgctctctctttcaacagaaatggaccttttacaatattgaatggatctcagagaagataatgacggaggctctagatctctaggactgagagaacacgcttagcacatggggtaagatgggattgcatctctcaaacatgacacctcctgcctacactgactcaaccggccatcaggctttggaaaactg

SEQ ID NO: 13876 - DNA, 340 bp, Homo sapiens
gaattgtcctagattatctaatccgctaggaccagaagaggaatttctgggttattgtggtaaagtttcatgtgatgaaccatccttgaattctctcagaataaacaccacatggtcataacatgttaattttattatttttttgtgagtgtgagacggagtttcactcttgttgcccaggctggagtgcaatggtgcaatctcagctcactacagcctccacctcctgggttcaagggattctcctgcctcagcctcctgagtagttgagactacaagtctgtgccaccacacttggctaatttttgtattattagcaaagacggggttttaccatatt

SEQ ID NO: 13877 - DNA, 241 bp, Homo sapiens
ccttagaactatctattaaattctatcacaggagatcattggatcacaacagggcagtactttctgctgataagagtatagaaatattatagagatgtctagttaccaacacgataggaaagggggcattatcagcctttagtgatgaggaccaaggatgtaaaatacccttctgtgcaggacagtacctcagaaggaagaattctgctgtaacctccaggtatctgataagtgaaaagct

SEQ ID NO: 13878 - DNA, 320 bp, Homo sapiens
aataaataaattatgtatcgtcggaggtttttactggggagagagctgtaggtaattgttgcaccacacagatgctccctccaggactgaaggacttacccctccagctgctgggattatagttggctgacactctccagcagctggcagtttccaggaactgcctgtggctgaagagaaccaccttactcaaagttctaccctcctcctaggggcagctgcatccaatgactggcctatgtggaggtataaatccatcttgccaatattcatacttatttacataatttacaatattcatacttaaagaatctgggccc

SEQ ID NO: 13879 - DNA, 235 bp, Homo sapiens
accctttgatttttttctatcccacaacaatggagccagttttttttttttttttttaaatctgaaagggctctgggtttcacttaaaaggaaggcaactcaaactgacttaaacgatacttgacaaaaaaggggggttttgtttttctgcattgggcggatggctttctgcttttataactggaagatccagggatgggggggaaatcaagattgacttgccttaactgctcag

SEQ ID NO: 13880 - DNA, 341 bp, Homo sapiens
aggacggctctgtctggaatctttgaggccgggaatacaggagccctaatgtgactttggactcggaattacctggaaatcagtgatttgtgccccacgttatgaagctatcaatttccaaagacagttaaaagacccctggctcaaaatggatagttaacatgaccaaaaaactaaaactgacttttgagtactgtattagacagtcattaactaaacctaagatattattttcttttgccagtagtgctttgttagcttgtgtgccataggggtgagctcagtggtattctgacaacctatgattcaacccttcctattaaaaaccacagttcttgtgt

SEQ ID NO: 13881 - DNA, 334 bp, Homo sapiens
ataaatatgaacagtagaagctacagaaaaatgctgttgagtttttcaaaactatggcttttttttttaggtaagtaaagggaattagtaggggtttccctgttctatttactaatagaaatcgatacttgcgataacctcactaatcttcacatcttttatccaattttatccattcatactataaatgattattcattaccttccactctgcagggagatggcaaaaccaaacacacatatattctctctcttcctctctctctcttcctctctttctgacacacacacaaacacacacacacacatatcagatgttaaagaagttcacatg

SEQ ID NO: 13882 - DNA, 332 bp, Homo sapiens
ataaatatgaacagtagaagctacagaaaaatgctgttgagtttttcaaaactatggcttttttttttaggtaagtaaagtgaattagtaggggtttccctgttctatttactaatagaaatcgatacttgcgataacctcactaatcttcacatcttttatccaattttatccattcatactataaatgattattcattaccttccactctgcagggagatggcaaaaccaaacacacatatattctctctcttcctctctctctcttcctctctttctgacacacacacaaacacacacacacacatatcagatgttaaagaagttcacg

SEQ ID NO: 13883 - DNA, 331 bp, Homo sapiens
  misc_feature 76: n = A,T,C or G
ctcccagagtagcgtgagattacaggtgtgagtcactacacccagctaattttttttttttaaggggagatggggnctcactatgttccccaggctggccttgaactcctggcctcaggcagccctcctgcctcaacctcccaaagtcctggaattacaggcgtgagcccccatgcccggggcattcatatattatacacaacaacccgcaggctccattcatgcacgaacccccattgtcttcggccctttccagccctgcgctcgcatcattccctctatctcgggaacccgcgcccctcccccttttcaagatggtccacccctcgcc

SEQ ID NO: 13884 - DNA, 326 bp, Homo sapiens
taatttctgtgcccctttactcaaagataggacaagacaaagaaaatgaaaacagacacaaactccaaggtccatgaaaccagaaactaatcctgaaccatgctaacaaaatagaaagcttatcaagtgattataaaccactctgcatataagcagcatataagtccaaatgcctgcagagagtactgtgggactcagaacagcacagggactagagcacgcttgttcaacctgaggcctgtgggccacatgtggcccacgacagctttcaatgtggtccaacacacattcataaactttcttaaaacattacaaggttgggcgca

SEQ ID NO: 13885 - DNA, 304 bp, Homo sapiens
agggtagaacctatatgttgctattgtattgctatttatctacttaaataactcttactgtagtatgtattgctcaaggacagagattgcgctgctcatctttgtgatatcccacttagcatagtttctaagcaaatagtatacttctttcatatatgcttatcaagtaaatgaatttgactctacctcctattgaactattcagaaattcatgtttacgattttagcaatgagaacaccaagacttatctatagagtatcagagataatacaactagggagtagatctaaaataagacatctg

SEQ ID NO: 13886 - DNA, 321 bp, Homo sapiens
  misc_feature 321: n = A,T,C or G
gaggtttcatttgtggtgacattctctcccaggccacaaaacatttcctgctcggaaccttgcttactaattgtaagaactttaccagtaagaacttgctttaaaaacttagcattcaaaaaaaaagctctctttaaaagttatttgattttcttggtttttttcttaccatgctatattttgagtttcacctaaaaaactaaggttatcttatctaattgctttaaatttatacatttagtcacattcaacaatttgttgctaatcattttgccagatgccaggcttttccaagaagtgtaggatcccatccttgaatcn

SEQ ID NO: 13887 - DNA, 239 bp, Homo sapiens
cagatccacacttcggatgaaaatggctgaaaaggaggcagagatggcagaagactaaaggaaagcgccgagctgtgacttgacgcccattccaagggcagtgtggctcttgtgagaccaaaagaagagtaggaatgaacgcgggggtcctgtgagcagcgggtggctttgctgagcttggtgctcttagaagaccagccacttttgtccctgcagcccggggccacagagccagacac

SEQ ID NO: 13888 - DNA, 317 bp, Homo sapiens
gatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagctggtgattgtgagatctgttagcggcaggctgagcagatactacttggttttgcttggtatgagatactactgtttgcttagtatgagattttttccagcctgtctcttaaactcctgtgacatctt

SEQ ID NO: 13889 - DNA, 318 bp, Homo sapiens
cggacctatccgtattgcggaccccaaagctcttcccggggcctttctttctctttgacaaagcatagctaaggtagctgggaaaggtgccaagagagagaagagagagaagcgatccagaagagagagctcccaccctcgctgctgactggcctgcgaccttcaggcctgcctcttacattctctcgcccttcccaaattattactaacacatgagtctgacatacagcgagctccacagaggaaagacctgtattctctggactatacagaatgatctacggacagagtgataggaggctgagtccacactctgga

SEQ ID NO: 13890 - DNA, 317 bp, Homo sapiens
tcccacccgacccaagcacctgtactttgtcactctcccatttctggctagaccaggactccctttgacatctctaaccttgcagaggtgtgactctgccagagcactcttagatgtcgtacaggtgcatttgaagccttgtattttctcttaaaagataactggcgggtaatggagcgtgctgactctattgctaaagagaaagaataggctgggcgcggtggctcacgcctgggagccactttgggaggccgaggcagggggaatacctgagggcaggaagttgagaccagcctggcccacatgaccaaaccccc

SEQ ID NO: 13891 - DNA, 315 bp, Homo sapiens
  misc_feature 297, 315: n = A,T,C or G
gtagatcattttatttcctcttaatgtttatactgattactgttacattagctggatttttcaaaacaatgttgaagagtgatgacagacgtgactgtcttgttcttaattttcatggaagtaagaatgcaaaatattaatagggaatagtattccctattagtatgacatttacttttggttattagtaggtagtcattaacatgtttaagagtttccgctattcctgttttatagtgttattgctagaagtggttcctgaattttataaaatgccttttcagcatctattgatanaattgtatgatttttttn

SEQ ID NO: 13892 - DNA, 342 bp, Homo sapiens
aaagtgttcagtcctagatgtttaactccttagctacttttgtaccagggatcaaactgattgaaagtaaatggtttatgtgggtcaaaaatgaggaaccaggctttgccattaagcttgattcttctaactctagctgagtcccacctggctttttcttggcttctgtaatcatgaactatttccaatagccagtggatataaggagttatagtagaaccaatggatggtttatagttgagaccctctgcattgtatgttacctatttcaagatttaagagtcattgctgggcacggtggctcacacctctaatcctagcactttgggaggccaaggtggg

SEQ ID NO: 13893 - DNA, 339 bp, Homo sapiens
tatatatgataggaacgtgagcttgaggagtcgcaattgctggaatttgcttggggaatttgcctgccccaaatgaagctcctcttttcccttaacctagcttctcaagattctctcccttagttgaagatattactcgttacctaatcatccaagaaagacctcagagaattactcttgactccgtcctccttcttactccctattataaatcccacatagtttgccttgtgtaaatatttttcaaattacccaccccccattccctttcctgcttccacagctgtgatggaatccctcaactttcttttcaatatttcctgtagatttagacaaaaa

SEQ ID NO: 13894 - DNA, 336 bp, Homo sapiens
  misc_feature 336: n = A,T,C or G
cgctgggagcccctcggcatcatgctctggccagcaaagcccctgcggcagcggcagcagctgtggctgccatcatcctggacaccatgttgccttgagaggcaattgttccttcccccattccatgggcactttcccagttatgacacaggatgatctggtcccagtgctgtaatggggagtggggatcacaggtggggcaatggaggagctctgaaagtggctttggatatctcactacccaaaaggaaaggcattagccaccatggccccaacaaaactaaaataaaaaggaaagggggtcaggcacggtggctcacgcctgtaatcccagan

SEQ ID NO: 13895 - DNA, 333 bp, Homo sapiens
  misc_feature 290: n = A,T,C or G
ggtttctcaaactggcttgaggttaacaattacctgagccatgtattaaaaaatggagactccagagttactgaagcagcatctacagggtggggcccaggaatctatattcttagcagatgtgagccttaccatctggccctttggaaaatgatgcaagaagaaacttctctgggagaatttcaatctggaggcagcaggggaggggagtgatcttgcagagcctgtggcatcatctggtgcccatgacaagacaagagtggctctgggttcttcttaggcttcccccnatcccctcctcttagaactatagccattcgtcacatgaggtcg

SEQ ID NO: 13896 - DNA, 336 bp, Homo sapiens
ttaatatacggaagtagctgtcttcctacaccttagtcaatagctaatcaaacttcttaatcatgttaatcgggtatttttaaaatgctttcagtatagtttcaatttgcttaactcttacattgactgcaactgaggatcatttcatacatttaggagccacttgtctttcctttgaactgtctctgaatgtgcccacttgtctactgagttgttggtcttttctatcagcaagcgatcttgctttttaaaggaaattagccctttgaacatgctgcatggcaactatttcttcccagcttatcactggagtcccaattttgtttatactagttt

SEQ ID NO: 13897 - DNA, 337 bp, Homo sapiens
caagatgcttcagaactttctgtatccagtgacagcccagctgataagtatatcaaaaaggatattactgtaagctagtcatatttgaaaatagctgatatgttagctcttttttattgagagcagatatacaaagtatttcatgatgctataggatattaacaattatttctctcaaaactcttctgagggaagactcggctattattgaatgagttctgttgaattctctctgttccctcaattcttctacctccactgcataaatatatattgcatactggccaagtgcaatgactcacacctgtaatcccagtactgggaggccgagatgggg

SEQ ID NO: 13898 - DNA, 333 bp, Homo sapiens
ggcctctactgggaaccaccttctgcaggacagtcaccaggccagatccagaaggcttgaggccctgtggtccccatccttgggagaagtcagctccagcaccatgaagggcatcctcgttgctggtatcactgcagtgcttgttgcagctgtagaatctctgagctgcgtgtagtgtaattcatgggaaaaatcccgtgtcaacagcattgcctctgaatgtccctcacatgccaacaccagctgtatcagctcctcagccagctcctctctagagacaccagtcagattataccagaatatgttctgctcagcggaaaactgcagtgagga

SEQ ID NO: 13899 - DNA, 328 bp, Homo sapiens
gggagcccaaagacagtgacagggcatggtagaagggacttgctggactgttcacctttccaggccaccccttgaaaggaagcagatgtgggcaaaaaagagcaactccatttttcacacagtcagagccagcccaactgcagatggcctgtacatcgcagcaccaagcacatccctggtctaaagtgtcagttcttttttttttttttaataaaactttaagttctagggaacatgggcccaacgggcatgttggggacatatgaatacatggcccatgttgctgggctgcccccattaactgggcattctaagcaaactatcggag

SEQ ID NO: 13900 - DNA, 331 bp, Homo sapiens
tgcttcctcggggctgggagaatgaccctaattctgaggtctctgggcggctgtgttctgcctggaaaaagcatctctggccacagaatcgatgttcatcttggagaccttctaggcttaagctgccttttgtctaaagacattcaatattggtatgatttcttgagctgtgtaacattcacatggctcaaaaatcgtgcaaatgtgccaggtaaagagtgcaaagcagccaggcacagtggctcacgcctgtaatcccaacattttgggaggccaaggagggtggatcacttgaagtcaagactttgagaacacgctggccaacatggtg

SEQ ID NO: 13901 - DNA, 328 bp, Homo sapiens
gaagcctctactgggaaccaccttctgtaggacagtcaccaggccagatccagaaggcttgaggccctgtggtccccatccttgggagaagtcagctccagcaccatgaagggcatcctcgttgctggtatcactgcagtgctcgttgcaactgtaaaatctctcacctaggggctgagcaactcactgaaaaaatcctgtgtcaacagtattggctctgaatgttcctcacatgccaacaccagctgtattatctcctcatgcctggtccctcttataaacaccacataatttatacccagattctgttctgatcaccggtgaaccg

SEQ ID NO: 13902 - DNA, 329 bp, Homo sapiens
ggtccaccccaagtctggcttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaagtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcc

SEQ ID NO: 13903 - DNA, 196 bp, Homo sapiens
agatctattatatcttaatctctttccaaaagctattcaaatgaagagctccctattggtatcaataatagattattcattttagttttgaaaatatacatctgcttcttagaatacaaaataatgtactctgttttgtgttggctatatttaatatctcttagattaaaactgttcataaaaaagtaatggcacg

SEQ ID NO: 13904 - DNA, 331 bp, Homo sapiens
gggagcccaaagacagtgacagggcatggtagaagggacttgctggactgttcacctttccaggccaccccttgaaaggaagcagatgtgggcaaaaaagagcaactccatttttcacacagtcagagccagcccaactgcagatggcctgtacatcgcagcaccaagcacatccctggtctaaagtgtcagttcttttttttttttttaataaaactttaagttctagggaacatgggcacaacgggcatgttggggacatatgtatacatgggccatgttgctgggctgcccccataaactgggcattctcagcaaactatcgcaggga

SEQ ID NO: 13905 - DNA, 318 bp, Homo sapiens
tattcaaccatctaaaactctgccttcataataatgatggatttgctgtcatcataactcattcgtaggtaatcttgcaagagctgaactttggaactactgccatttggaagggttccattcactctaagggaaacctgagaatctgagttcatttactttttattcccccttttagcagtaatttgttcatttacctttaatgttgaaaggaagcaggttgaggccagccatgatggctcacacctgtaatcccaacactttgggaggccgagaccggcagatcacttgaggccaggagttcaagaccagcctggc

SEQ ID NO: 13906 - DNA, 315 bp, Homo sapiens
ataacaggcccagactgcctgctgccagcacccaggcatgctatctgaggggcctagaaatcacttcaccctgcccaccacagcccatgcctgagcgcattatcaggggcctgaggacaagcccaccccacatgtactactcaaacccccacctgcacaagcatgttgtccagagggatggggattgtcacatcctgcataccaccactacatagacacacacacacacacacatgcactcacacattccaggggcctgaggatgggcctgcccagcatgttgccaccaccaccaccagcacccacctgcaccat

SEQ ID NO: 13907 - DNA, 314 bp, Homo sapiens
gaaaactatggcaggaacacagtctcacagccaagagagatccccacccttgagaagacaccttcctgcctgcctgtacagccccctcgcagaggctgcaggtatcaagggctgatcccatgctcccagagcgctaccaaggaagggtcttcagaaaaaaatgctcatgaggcaagggggctgcaacccgtgccacagaaagccagatctttctttgcaccagttgtacagtttctgcaaaactgaagactgacattgaaaacgactgctggtcagctattccttgatcactcctagagagtgtatgttactaa

SEQ ID NO: 13908 - DNA, 342 bp, Homo sapiens
  misc_feature 323, 342: n = A,T,C or G
gacacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctatggcatcacatctccgggaatctttgctagcagtcaaccgggtcaaggaaatatataaatgataaatccaagtgtgggaacagcagtaatgaactttaaagaagaagcanaggcactaggggtgatccn

SEQ ID NO: 13909 - DNA, 339 bp, Homo sapiens
aaagaatgtactggcctcaatttctgataaggtatggatgaaccttcctcatgccagacaagaaagcaggatagattagcacactatggtaaaatgtatttcttcaaattaataaacctacatgagataattcacattagccaataaggcagaatacagtaaaattatataacaataattatttttctaagaagtgaggaaacagatgaataaaaagtgaatccctcccaggaaaggtaaacagcaactgtggcccaatgtctctgcatctctggaaataaggagctgaagaggctggaaaggtatattgacagaaagctgatataagagaagagatgg

SEQ ID NO: 13910 - DNA, 304 bp, Homo sapiens
  misc_feature 304: n = A,T,C or G
tatactatctttaactggtttttcacgatggggcactaggaatctcgacattaatcttgcacagaggacttctacagagtctgagaagatatcatcatgctgaatctgatcatactgctttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagn

SEQ ID NO: 13911 - DNA, 324 bp, Homo sapiens
aaagggctgggagtggggcaaagatgatagtgacaatgtccgattggccaggtaagccaggcctagtcttttcatctattttgtgctgggatttcttccacatgtggcatccatctcccagggatttttcctcagctcaggcaagacagtcacaagctaagatgagttttgggaagatggggaggtagaggagaggttgggcaccaggactctttcatggtgcagctgctttttctccctgtgaaagagatgggaatcctagcatctcaacttgttcttttcttacaataggaaaagtgttcatacactgattcatctctaaag

SEQ ID NO: 13912 - DNA, 315 bp, Homo sapiens
cttccatgcaggaatcttctctttcagtgattctgttgtatttccagctttcctgagccattgaggcccaccatagggttttgcacatagtaagggctcagaaaatacgagttctcttcctctttcactttatcaccattaggccttccagccagacttcatatctttcctttccttcctatcttgggttacgccatctctctcactaagagttctttgctgaccctggggccaaattagcaagatgtgaccaacagcactgcaatagacatcagaagacccaaaccctaggccacctctaggctagccgtggaa

SEQ ID NO: 13913 - DNA, 338 bp, Homo sapiens
gagggttttcaggcagaggaacagttggccaaggaagtcagcttctcagagctcaagaggttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggaggtgctgaatgttactt

SEQ ID NO: 13914 - DNA, 337 bp, Homo sapiens
tatctcatagagtactgggattctgaaagtgaaaggtttatacccagtaaaagtatgggagtgctggaccaagctaacatgtacaagaagaaatatggtatatatttatggaaatagataatgaaaatgctgaattgaagagcaaagtttggacaatggagaatttttcagtttatcaatattggtgcactcttccatgaaggagtatttaactctgtgataagtaccctggaagaatgaagttatattacgactatgttggagcttgggcactagaagcatgctgaaagtgttttccactttaagtgaagtagaaatgctaagaggtggccgggcg

SEQ ID NO: 13915 - DNA, 335 bp, Homo sapiens
gagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggag

SEQ ID NO: 13916 - DNA, 337 bp, Homo sapiens
  misc_feature 337: n = A,T,C or G
gacacgcgttcctcaccatggctttgatagaggacactgcatctgagataatgttgccagtgattggatccagttcctgactgggcttctgactggtttttggctggttgtttcgatttgatgggcttcatgtaaacttttgacacacttctatgaccctgatcaagccatttcaccttcattctctgcatttttaccattagggagacaaggtatagaatatttactttgttctacaggagcgctagggaaattatacaaccccattcttctccagtcactaaggaatataagttcatctgtcaaaggaaaaatatcaacctaaatattgctattn

SEQ ID NO: 13917 - DNA, 326 bp, Homo sapiens
ggcaagctggggggactttgttagccatgaaacctccaggggtgggtgttgagcttgggtttgtttcgctgtcctcccttctgctctcaggggagggtgtgggcctgtcaaggctgttgtcatgtggcagagagaaggccccttaggcgcgttaggggccagaagttggcgctggtgtttgtgcacggctgtgagtaagcgcgtaataaataaatcagaacgagatggacggagaccatgcgctgtgctttcatcctgctcagcccccagctgaggaggtttctgacccccatacccgtcctgcagccttcgagcaaatgtggggg

SEQ ID NO: 13918 - DNA, 321 bp, Homo sapiens
tcctgtcagattagattctcgtaggagcacaaaccctattgtgaattgtgcatgcaaggcatctaggttgcatattccttatgagaatccagcaaatgcctgatgatccgaggtagaatggtttcatccccaaaccactccacccccagcctgtgaaaaaactgtgttccattaaaaccagtccagtccttggttccaaaatgattgggggctgcttctctagcccacagggagtaataatccttcagtaaggtatagtccagtgcaccaacaaggtgagcttctgggacaaaggaaaccaagatatgcactttgcagagg

SEQ ID NO: 13919 - DNA, 324 bp, Homo sapiens
cttgtgcacacagccaagatttcttcaatgggtgtgagctagttgagggttaaccttgtaggttgcagagtgtatttgtttgtttgtttgtttttctctgtgatgcggctagtgctctgattttgtaggaggtttttcactgaagctcatagttataaacaaggacatcactgctaacattggtaatttttcctgtgttcagctattatcgtatcaagagcattttatttcagccagtttatgtcactaccttatccatagtttctgtcttatatttttatggaaatgtctttttctcttattgggggcactacactttctttg

SEQ ID NO: 13920 - DNA, 324 bp, Homo sapiens
tagtattcttgtcttagttagcaatggaaaaagaaaagaagcaacttgggaggaagaaaggaaggaaggaaggaaggaaggacagggcaggccagggagtccaaaatatccagatgatggtgtaagcaggtacttaagttaggagaggtgaaggaacaattgaatatagctcaaggtagtgacactaaaagagagaattctaataaacatttccaaatagaaaatatagttaaacattgcgaaaactctgcacactctgaaaaaaaagaagattcttatagaatctctacctaagagaaacacacacacacacacacacgcaca

SEQ ID NO: 13921 - DNA, 334 bp, Homo sapiens
ggccgaggcgggtggatccttgaggtcaggagttccagaccagcctgtactctaccctgggccacagagcaagactatctcaaaaaaaaaaaaaaagggggccccgaaacctttttttttttaaaaaggaactttttttttgcccccaggttgaaaaaaagggggcagacccccccccaagagaatttcccccggggaaaaaaggggattcttttttctcccccccgggggagtgggaaattaggggccctgcccccaccccgaaaaaatttttttaatttttaaacaccggaggggtgttccaaatgggggccggggggtgttgaaccccctg

SEQ ID NO: 13922 - DNA, 338 bp, Homo sapiens
agcgcctggggtacaggctgggcccggcctctgtgggcactgacaagaggcccctctggggcaggcaaagggcatggttgtgggtggggctcccctgtgaggacattgagcacagctgtggcatgcgcattcagcaggaaatggtcaggggcatgagctgatctgtctattgcttctgagctcacagtgccctgaggagtacggtgctcaaacctcatgagcaaggtgaggcctgtcaagagagccatgtgtgctcagcagacccaggctgcagggcgagaacagggcttcctcagcctgtgatagggaccagtcaggtgcaggcaagaatctgggcc

SEQ ID NO: 13923 - DNA, 333 bp, Homo sapiens
gctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattggggatacgaagctctacacacttgaagatggtgaaggaataaaaatctatgtctcacagtccagacttggagtacaagtaataagaagaataaaacttaatcccttaagtagattcaccataagt

SEQ ID NO: 13924 - DNA, 212 bp, Homo sapiens
gctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattgggga

SEQ ID NO: 13925 - DNA, 332 bp, Homo sapiens
gcatcatcacgcagatggtgtgctgtaggtaaactagccagtctcctgtgcccccagcctccctttttgggctgttttccccatttccatggaaccctttcctctgcggtcggggcctaggagccatctgtctacaaacctagtgttgaagaagaactgcatgatgccctggttcatcagcctagagaggtgggcagcaccctgcaattcccgtcctagattcatcactgcttttgtaagctgcttttgcctgtgcttctcagccttggtgaagtcatctgcattcacagtggcttgccttcgccccccacccctggaaaaagtccttgtgg

SEQ ID NO: 13926 - DNA, 362 bp, Homo sapiens
  misc_feature 22: n = A,T,C or G
tatcggctgctagaagacgaanaagggagcagggcttgtggggaggggacctgggagtcaagatgaaagctcccacgcgccgggtgatagtttactggattgtaacccacagaataaaaagccacgagcccacagtgacgcacacgaacaattcgctgagtgaagagtcggtgtacacggagctgccctttctccttcctggccctggtgggagaatttttatcacaagtgggtgatgggttttgtccagtgcttttccatgtccgccgggatggaataaacgtgacgtttgtctgggggcctgtcagtgtacagcacgtcacggatcatctgcatgtgtgcccaggaccggggcagtcacg

SEQ ID NO: 13927 - DNA, 350 bp, Homo sapiens
acgacagagggggcctcctgagtacctgggattacaggcacccgccaccacgcctggctgacttttgtctttttagtagagacggggtttcactatattggccaggctagtcttgaactcctgacctcaagtgatccacttgccttggcctcccaaagtgctaggattacaggcatgagccaccacacctagccaggattcccaatctttatttgccttgaggctgatggaaaattgctggagttctacctgggattcttaatataaactaacatatatacatatacaaatatatatgtgtgtacatataactgtaaaaaatagtgcgggccaagcacagtggctcatgt

SEQ ID NO: 13928 - DNA, 323 bp, Homo sapiens
ggtgcacgtgcacccatggtgccattgccaccggcatgaatgcacccactcccctgccactgtgccaccttgccaccattgccagcgcatagactcacaccagtggccctgcccccatcccatgccacaaccaccactggtctggatgtgggcacaaaggttggcagccccacaccggccagcacccattcccccacactgaaactgccatgggtgcaaatgggcacatggaccccagttgccacgtccccccactgctagctgccactgctgctgttgccaatgactgcaaggaagctggtaatcccagacttatcagtatc

SEQ ID NO: 13929 - DNA, 311 bp, Homo sapiens
tgctctgtcagcctgattctactcctcggggaggccctcccttttcttccaagttctatcacggtcctcttgttccccctgactgtcttctgtgcctcctcctctgggctgtagtcacctggataaaaacccatctccctcactaggctgttagctcctggaaggtagggacaagagtgggttggatcatctctgtgtccccagggcctcaggtagggccagcacacaggagggctttacactgaggatgaaaccctcaagaggaggccgggtgcgggggctcacgcctgtaatcccagcactctgggagg

SEQ ID NO: 13930 - DNA, 340 bp, Homo sapiens
ataagtgagaagaagagacccagagaagtcgccatcagccccagggtcacacagcagtggcagaattcctactagccctgcccctctccttctcccaagcgaatgtccctaaacacagccccagccagcctgagctgccccgtcatttcccgactacaagcggactgggggcgtggcttccccttaaaagaagaggaaggaggctcaggcgggaagtgacttggccctgcagccggcctgggaggctggggagggacggggtttcctgtcacccggtctggctctttccattgagtcacctgcctcgtcttgggcgtggccaggggaggaacagggtgat

SEQ ID NO: 13931 - DNA, 315 bp, Homo sapiens
  misc_feature 41, 48, 50, 51, 52, 55, 69: n = A,T,C or G
ggcacccaccaccacacctgactaatttttgtatttttagnagagacngnnnttnaccattttggccangctgggctggaactcctgacctcacgggagccacctgcctcaatctcccaaggcgctgacactccccgcgccacccactgcgccccgcggaccacccctcctcactgggagcgcgcccacccggggggccgccaccacctttcgccccccacccccacggaatggggagtaaagcgggcccccccgcccccccaccccgcgaattatcctggagctcacagagcgcacccgcccgccccccccccc

SEQ ID NO: 13932 - DNA, 208 bp, Homo sapiens
ggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcgtcccgcagtgagcagctggaggaactgttcagtcaggtggggccggtgaagcagtgcttcgtggtga

SEQ ID NO: 13933 - DNA, 319 bp, Homo sapiens
accaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattctcgacttttcagcagtgtcctttcttgatgtttcttcagtgaggggccttaaatcgattttgcaagaatttatcaggatcaaggtagatgtgtatatcgttggaactgatgatgacttcattgagaagcttaaccgg

SEQ ID NO: 13934 - DNA, 305 bp, Homo sapiens
caactcgaggagaaaaccaaatctattgaactccattgatgatttggaatgttgatagtcacaagcaaatgtaagaataagaaagactgctttctcatgaaactttttaataaaacttctggaagcattttcataaccaaatacctggagtacactgcctcactatccttagtcatgctagctttctcttccctgcagtatagatctgccaattcaaatctgtatggcaccagggctggcatacgcagaatgattcaattagtaatatggcattgttaaaatattataaagcgggccaggcacgg

SEQ ID NO: 13935 - DNA, 309 bp, Homo sapiens
catgactgactcctcttttggcatgtcttagttaagagtcatctctttagagagagtgtccttgacaaacaaatctaaagtaaacgctccctgctattttcttccataacatcctggcaatagtggcaggcagggagatgttcatattactgagcacgggtttgacttgatattagaatatatatttatttgctcagctttttttttctcatccctaataaagtttaaattaaattgaagattgttgagtttgaaaatacaggaaggagagactgtcatggattacccattgatagaggaatgtccctg

SEQ ID NO: 13936 - DNA, 310 bp, Homo sapiens
attcatcagggaccaaaacgttcatgttcattcagcattcgtgggtctgctctacccaagaagttttctcactcttcattggttctaccaagcataagcaaatcaaacaactcattgagagaatgtcatcagccaataaaataagaaactgctcccaggccctgaatcagcttattaaaattgacctctgggactagcttctcctaatacataaaattataaaaaagacttagacacagaacctcaagtctgttctaccaggaaattttacacaagtattccagaaatcaaccaatcattctaacccatt

SEQ ID NO: 13937 - DNA, 311 bp, Homo sapiens
  misc_feature 289: n = A,T,C or G
tctctctttctctcccctccttccgctgtggttaaacacagaagacagttgcagagttgtaggtcaaagggttattttaagcatatgaaaggacagcccaaacagaggataggctttatggccaaagtttgtgctcaataaagagtccctttgagccgggcgccgtggcttacgcctgtaatcccagcactttgggaggccgaggcgggtggatcacgaggtcaggagatcgagatcatcctggctaacacggtgaaaccccttctctactaaaaatataaaaaattanccgggcgtggtggtgggtgcct

SEQ ID NO: 13938 - DNA, 308 bp, Homo sapiens
ttagatttccctaattatgaatgatttgaggagcttttcatgtgcttattggccatttgggatcatttttagagaaatttctacttaactcttttcttgttaaaaaaaatttgattgttattgcttactagcggtttaacctcgtactaggtgctcagtctctctgggactgaatcttctcatcttaacagcagggacactcacctcacgaggttgctggggtgcataagatgaggtggtacgcattgatgctcaacccagtgcctgattcacgggagaaacctaaaacatttgttattattgtacca

SEQ ID NO: 13939 - DNA, 304 bp, Homo sapiens
tgatccgcccgcctcggcctcccaaagtgctgggattacaggcgtgagccaccgcgcccggcctgtaccaacttcttaatgcctcaactgcatctctgcttggacttttactgcaaacaaatatattatgtgatgtttaaaataaaagaaatatgatgttcagtaataactggtggaatgagagaatttggctccatcttctctaataacaaaggagttctgctcctacatctgagcaaaattataacctttttacataaaacaactgcgaagagtcccagcatgaacaccgcagtctctgggg

SEQ ID NO: 13940 - DNA, 150 bp, Homo sapiens
taactgggcatatttaaagagaatttaagacatagccagatgatctcacatcattttaacgtgcaagatattcgagtgtgtgcacagtgtatggaaaggtctgctgactccttattcaaaggcttgcattccagcccggtccaccactta

SEQ ID NO: 13941 - DNA, 313 bp, Homo sapiens
cgtgcctataatcctagctacttgggaggctgaagtgtgaggaccacttgaactcaggagttccagcctgcagtgagctataattacactactgcactccagtctaggcaacagaaggagaccctgtgtctttaaaaaaagacaaagaaaaaaagaaagagagtgagaaagagccaggagacataggttttagtggctctgtgaggcataaagtcctgggtgaccccatggatatttcaaagaggtcttcacatttccttgtatcacaaaatttgatgggtgactaataaaacatgtacagatgtgccttaag

SEQ ID NO: 13942 - DNA, 307 bp, Homo sapiens
  misc_feature 307: n = A,T,C or G
ggagaacccttgggggttacatttcaatatggggcaattattggtggctacaagtaggttcgtgcaattattggtggtaggatttgagctggcctgaaccacaatattcagacactaccccttctgtctgcccctctcactatcccaagggagaagggattccaaaatctcaacacttcactttcctgtattaagctgtgaatgcaaacaattgttctagtcattcaatgtcttctgaggaaaaacaattcagtgcagaatctaacatacaccatgtctatcatgtaaaatttatgccacagaaaan

SEQ ID NO: 13943 - DNA, 306 bp, Homo sapiens
  misc_feature 306: n = A,T,C or G
caggctgtgtgggaaactggctgtggtgggccggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctgtacccagaccctccagggcatggagcccattgtgaggggtctggtgctgaagtggtgggggaggcccgtgcaggcctacagctttgtcatctgcaacattcctctccccactttctttaaactttn

SEQ ID NO: 13944 - DNA, 313 bp, Homo sapiens
  misc_feature 185: n = A,T,C or G
tcctttccttttagtctttatctcattgttatatgtgattataatgttgtcatttatgcagttgtatgttctattttaaaccttaaaatttgttacttaccaactttttgaatatgcctgactgaaatgattcatactgtagcatgtgtgactcagggtagtgaaagggggtttgttttgaatancaagatgagcatcatactagtcttccaccacaaaacattccatgcaacttgagacacagatgaaacagccaattttcttcttggcttgggggtggataaagggtggattgactcatagagggcttacg

SEQ ID NO: 13945 - DNA, 310 bp, Homo sapiens
tactgacatagtgacttagtgatttagtagtgattatgtgacttagtgacatagtgacttagtgattatgtgggtttttccaaacaacaaacatgtgttgcatactttctgtgatagccaatgagaatttaaagatacatagagcataactgttgcccccaagcaacaatgtaataaagaaacaaatatatatgaagagaactgcaaaagactgcaaatatgtactttcatagaagcgtgtgcaaaaggtttggtgatgatactttaaaagggaccagagaagtcatagccagggttgatttccataagc

SEQ ID NO: 13946 - DNA, 313 bp, Homo sapiens
agagtaagaccagtaagacattctcaaagagttaatggctttttgattcagagttgctttcttgggccttttctcctttgtcagcttctttagaaatcccatgctgctccaagttgttgggatgtttgaatatctggaagtgataagagatgacagaaagtcaaggtatatgactagagcagcagccaccaagggtgagttcctagtctccttaagaagtgactggtcactcaaggtggtagaattaagagcatcactttggggagaagtagctacagatgcagctagggcagatcaagttgttaatgggccg

SEQ ID NO: 13947 - DNA, 312 bp, Homo sapiens
actgtactccagcctggtgacagagcaagactccgtctaaaacaacaacaactctaccctccttttccattataggcttctggcctgaaacaggtttgctatatagcaaaacatcaaaaacaaagccaaaagacaaatgacaaactggggcaaataggcaaacggttaatatgttaataggtcttatatataaataacattaaattgggtttggagtttttattaatatcatggacaaccattctgatttttgcattgagacagtaaccgtaacttaaaatgaccgtaggattgtctactaactaagagtga

SEQ ID NO: 13948 - DNA, 299 bp, Homo sapiens
ggccccccgtgcagccacctgctgcacttgcgcactgggagcgacacgctcgggcataagtagtgccggaaagttagctgccgagacctggtggattgcttttcgtttatcagtgcaggaaaacagcgctatagtactgcgtcacaactagcgcagactccggcagtatttatgcggtgcggcttgggaactagaatccacttcctgtcttccgcctcaggctagagggcgagcgcttcgccgtgggacttcttctgcctggctccgcctcttgccccggaagtactcacagcggacgg

SEQ ID NO: 13949 - DNA, 311 bp, Homo sapiens
ggcctctactgggaaccaccttctgtaggacagtcaccaggccagatccagaaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgct

SEQ ID NO: 13950 - DNA, 312 bp, Homo sapiens
ttccagagtaccactgagggcccgacttggatctggtactccttctccatttgtgtctcttatattagtggttccctaactttgtagcacgttagcgtcacctgggggccttttaaaaaccctgatgcccaggtcgtgcccttatttaattaagtaagaatgtctggggaggtggtccctggggctccagtagcagagtttgggagctgccttcctaccacttggcctttcattccctgtgttcccttctgtctacattggccccctactggtcccacctcagggtcttgtcctcattccccctctgcctgg

SEQ ID NO: 13951 - DNA, 304 bp, Homo sapiens
gatgtcttattttaagatattttaaaatgttttacatttgcttaaaattttacaattgagaaaacatttctgcataaacatcatatctcatttccttataataataattctgtaagcttatacactgaaaaaaatggtagaaaagtaagaaaaactgctcaaggacccacagaccattttagaattataatattaattctggtcttctaaattcagtgcacattgcattacatgacagtcctctccatctttagcaacagagataaaaatgttggcatcggggccgggcgcggtggctcacgcc

SEQ ID NO: 13952 - DNA, 302 bp, Homo sapiens
aagagttagaaagaaaagaggaaggcgggagaaagcgtgcggaagcttctgggagtgtaaactttcttgcccttggccgctgcgccctctaaagccccggtgcgctccccctaccccaggttttcggagcctcccagcctctcctcgtaaggcggttccggccgcctcatccccgtcctctgccccaccgcacccaaggtgttggtttcgggaaggacctacgctgggtcccccgaggctcctcggttcctgccgatgctctggccggacccgagggggcggcctgtggacccgcgttactt

SEQ ID NO: 13953 - DNA, 205 bp, Homo sapiens
  misc_feature 205: n = A,T,C or G
ggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcgtcccgcagtgagcagctggaggaactgttcagtcaggtggggccggtgaatcagtgcttcgtgn

SEQ ID NO: 13954 - DNA, 312 bp, Homo sapiens
tacatcattcaaaactttgtgcagattctgaactctgaggagtttcttgacctgcccgtggacactctgcaccacatcttgaagagtgatgacctttacgtgaccgaggaggctcatgtgtttgagaccgtgatgagctgggtccggcacaagccatcagaacgactctgcttactcccctatgtcctcgagaacgtgcgcttaccgcttctggacccgtggtactttgtggagacggtggaagcagatcctctcatcaggcagtgcccagaggtcttcccgctgctccaggaagccaggatgtaccacctt

SEQ ID NO: 13955 - DNA, 162 bp, Homo sapiens
ggtccccaggaagatgtccgtcagccccctggagagctggctcacggcccgctgcttcctgcccagactggataggggaccgcagggactgtggctccaccgcaatcctaccagtgtccgcccagccagataggggaaggggccgagcagggggatgaaggc

SEQ ID NO: 13956 - DNA, 292 bp, Homo sapiens
ctgcatgatttattgtgctatctggaaaatcaattttttcttcttgggaccacagaagagtctgtttcaaaacacatttgcacccttaaagctaacatattcagtcttactgcctctggtatctgtaagcagacccattccatgctatttttaggatcatttccagaaaaataatttgtttcattgtggagtctgtcaagctaaatggagttattttctttgtggagttggatgagtaaatctagtcctaagaaaatgaggatttaaaacatttcctgcagagagctcatag

SEQ ID NO: 13957 - DNA, 293 bp, Homo sapiens
ggccccccgtgcagccacctgctgcacttgcgcactgggagcgacacgctcgggcataagtagtgccggaaagttagctgccgagacctggtggattgcttttcgtttatcagtgcaggaaaacagcgctatagtactgcgtcacaactagcgcagactccggcagtatttaggcggtgcggcttgggaactagaatccacttcctgtcttccgcctcaggctagagggcgagcgcttcgccgtgggacttcttctgcctggctccgcctcttgccccggaagtactcacagc

SEQ ID NO: 13958 - DNA, 288 bp, Homo sapiens
tgttgtgccaaggggttaaagaaggtcccatctggccctgagtcccagtcctcaggtgtccctgaggtgtctatcatctgtgtggtccacattcttcagttcacatatgtccccactgagaaggctgcatcagccatcgtgaccaactctgagtcaggcttgaggacccaggaatcagtcatttgactgcttctgtgtcctgtgggggtgctgtttgtggcaatgactctctggacccatcacacagatgtcccctctctgggttcttgttgtcccctctggactctc

SEQ ID NO: 13959 - DNA, 286 bp, Homo sapiens
ctgaataatattattacagaactgaaaaaaaaaacccaaaaatactactgtaagtatataaaaacataattgaatgtgaaattgttctgttttatgtaaattatgtttaaagctaataaaggggaaatgtataaaattataaagaatttaaaaaataaggccgggcacagtggctcacgcctgtaatcccagcactttgggaggccgaggcgggcggatcactaggtcaggagatcaagaccatcctggctaacatggtgaaaccccatctctactaaaaaaaata

SEQ ID NO: 13960 - DNA, 284 bp, Homo sapiens
gactgcatgcacagggtttacattttcttgtgaatctataatcatttcaaaatgcaggtttttaaaaaaagtcgttacactggaatgaaataaaatgaaataatgtgagaaaaatagacaagaggattaaaccgcttatgcttaataatactgagactatgtcgcagagaaacttctaaggaatatttttggtcaagagatttgtatcggtgcggttcaaagatacacgaaaatttgatgttgttgaaactttcctaaaaatgatacagaggtaacaatatacg

SEQ ID NO: 13961 - DNA, 283 bp, Homo sapiens
aagaacaggcggttgctgctcatgtagatctataaatatgtgctgtatgtcttttttgctttttttttaaaaaaaaagaacaactctttttgcctctttaaattacatacaagcatcgtagtcttggtagaaccacaatttttgttgtttatttataaggcaattgagtggggcgaaaagagcattatttacctgctgaattcaacatcttggaagcaccagggaaaaaactaggatcctactattatttttgcggcagataatgactctagtttgacttctg

SEQ ID NO: 13962 - DNA, 285 bp, Homo sapiens
gcctgctacgcagccttaaaacctgaggctttaagttcctagtattgagaagccccagatttcatacttatttactctgttggtttcactttcctctccattttgtgtctcttgggataggctttgttttattttcaagctcagctatgtatataaaagaatgctgggctgggcgcagtggctcacgcctgtaatcccagcactttgggaggccgagttgggcggatcatgaggtcaggagttcgagactagcctggtcaacatggtgaaaacctgtctctacta

SEQ ID NO: 13963 - DNA, 280 bp, Homo sapiens
  misc_feature 280: n = A,T,C or G
tttgtgatctgtcatggtcatggtatttcagagttggaggatggtctgagttctgacctggtgtaggaatcccttctcccaaaactctaacagtacattctcaggcttcgtgagctcacgcttaagacacattattttctgatgctggacagcttctttaaaaaaatgtagattcttacattaagctaaaatttattttatgaaagttcaagaattctggtccaaattgggatgaggcctatggtgcaggacttccgtgaaattttatgagattacaaan

SEQ ID NO: 13964 - DNA, 274 bp, Homo sapiens
tggaaggctggcacgggggtgagggatgaaatactatctattgagttcaaggtacactactcgggtgatggatagagctaacagcccaatcttgaccactatgctatacatgcatgtaacacaactacacttgtacccctaaatttatacaatatttttttaaaaaggagaagatagtgtttagtcagatgattggtctaaggttagaggggggtgggtatatttaaacagcacacttttgtacaatctcttagatatcctaactaaagaaaac

SEQ ID NO: 13965 - DNA, 268 bp, Homo sapiens
ggctgaaataattttaagtagcttgccccaaattacatgggcaacaaaaggagctgaggtggcactaggtagagcgcaactcgtgtcattcctgcgccactttgtgaccatatcacaatgtctttcctgccctaccaaaataggtattaataacagccaatatttatatcattctcttacatgcaaaacactgctatgatgcgttatctcacctgacctccacagtgctgtaagataggcaccatgattttactccctttacacacgg

SEQ ID NO: 13966 - DNA, 428 bp, Homo sapiens
ggcacgagcccccaccctaccacacattctatagaactgcaccaaccccaggaaccgcaatcagatctctaaggcgggcgccgggaaacaggcccccgagctgccagactatgccccagactaccagcacaagttcagttttgacatcatgcctacggcccggcccaagaggaagggcaagtgtgcccgcaggacccccatccgtgcccccagcggggtgcagcaggcctcctcggccagttccctgggggcctccctcctggtctggacactggggctggcggtcactctccgctgaggacccacggcgttagcacccagcactgccacatgtccaccaaggaacagaatttattttcttctttttttaacaagcggaagatctgctgggttccaggaaaaggctggtacaggcttctggggggtgt

SEQ ID NO: 13967 - DNA, 428 bp, Homo sapiens
ggcacgaggcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaagccaagaccagcctcccagcctggtcagag

SEQ ID NO: 13968 - DNA, 426 bp, Homo sapiens
ggcacgaggcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctgggctg

SEQ ID NO: 13969 - DNA, 424 bp, Homo sapiens
tcgattcgccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtatataaagcacaaagacagattaagaaacgagcgaacaaagcagcacctgaaatcaacaatttaattgaagaagcacagaatttatcaagcagaacattgtgatatc

SEQ ID NO: 13970 - DNA, 414 bp, Homo sapiens
  misc_feature 13: n = A,T,C or G
ggcacgaggcagngaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccgggctcatgactaaccttggtgccggcgaggtggaaag

SEQ ID NO: 13971 - DNA, 404 bp, Homo sapiens
ggcacgaggaacgtcctatgtgggactttggggcaaacaccagtttggctgccccaggagaagaggccgccctggcccagctccatccatctggagagcaacacagacccaggacccccggcccgcatctggtcgacagatgtgtgtctctatctggcaggcagccccggggacccagcagaaattttgcccctagcctagctctggaatcgacctccaggtatcttgtgaacctgaggcctcctcctctcacacccaagaaggcccccaggcctgtggtgctgtggtcctggcccctgcagctgggactccaggaagcgtgccgaggcccaccatgctggctggcagctcccaagggcaggtctgtctgagccctcatactgggagtgagcctgggtagacaa

SEQ ID NO: 13972 - DNA, 317 bp, Homo sapiens
  misc_feature 181: n = A,T,C or G
ctaacggtggagcttcaggtctgcatttttctttctctttttttagtgggcacagctatgatatcaaaaggtaggcctggaaccaagctgatgggagagggaagacctgaactggtcagtataagaaggaaatgagaaatgaacaggaatgaaatggggcgcgagtggtcagagagcaaanaaggaagtgtgggcagtgagtgcctgatggctgcggagtttctgtttcaaacgataaaaaaaaattttagaaatggacacaacattggccgggcacggtggctcacacctgtaatcccagcactttgggaggctgg

SEQ ID NO: 13973 - DNA, 398 bp, Homo sapiens
cgttgctgtcggtttttcatttttttctatcatgttcttaattttcattccttttctatagcattctattcttgactcaagaatgtaacattttgtctgcatatattcatttttttgaagttttcttattcctgcatagtctattgcttcatgtattttttttgtttttgctttcttttggactctgtcatgttggaaacttttctcaattgccttccttaggtaactgcataatgtgatgtggaagattcaaaagttgattgccttatctaaattcgacagtttgaaacttccctttaggctgatctgggtcagccattttgggagagttctccagagaccttaagtcttatgtcttgtgctgggcagacaccctcagggaatagtcttccattttt

SEQ ID NO: 13974 - DNA, 395 bp, Homo sapiens
cgttgctgtcggcgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgcttccttttttttttttttaaaaaaagattttttttttaacaccgggggttttttttttccccccagcttatttctagga

SEQ ID NO: 13975 - DNA, 395 bp, Homo sapiens
  misc_feature 380: n = A,T,C or G
cgttgctgtcgcaccaggccaggagggggctggcggctagggactgcttgtctgtgagcttctagacctgggtgctctacgggtgatgggaggaccagcggggaggggcaggctccctgtccagagtcttggaggtggggccctgggtggtggctctggctgtcccggccttgagtagctgggatctcatgagtccgggagtccctctgtgtccacatcctgcagtgctgcgggggctgcccggccagatgcaggccagggctggacacttactcctcctagacttagcttgaacagtggcattaaccatggtcactcccataaacccaggctccagaccaggggcccgagagcgaggcctggggactgggaagtcccanaaccccgaggtggag

SEQ ID NO: 13976 - DNA, 396 bp, Homo sapiens
cgttgctgtcggttcaggaccagcttggacaacatggggaaaccccgtctctactaaaaatacaaaaaacagccgggtgtggtggcaggcgcctgtaatcccagctacttgggagactgaggcaggagaattgcttgaacccaggaggcggaggttccagtgagccaagatcgtgccattgcactccagcctgggtgacacagtgagacattgtcaaaaaaaaaaaaaaaaaaactgctgggggcctttttttgctgaatcccaaacatggtgaacaccttggtggggtgggcccaaccccctttgaaatggcgggaaaaaatgggcttttttgggaaaattggggagcgtttgttttttttggaccctttttaaagctgaaaaaaccgttttaac

SEQ ID NO: 13977 - DNA, 394 bp, Homo sapiens
ggcacgagcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatgccctccaag

SEQ ID NO: 13978 - DNA, 396 bp, Homo sapiens
cgttgctgtcggcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaa

SEQ ID NO: 13979 - DNA, 385 bp, Homo sapiens
cgttgctgtcggcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaa

SEQ ID NO: 13980 - DNA, 386 bp, Homo sapiens
cgttgctgtcggtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttaaaaaaagattttgtttttgcccccaggggttttttttttccccccagctta

SEQ ID NO: 13981 - DNA, 363 bp, Homo sapiens
  misc_feature 3, 316: n = A,T,C or G
tcnagtgcgcgggaggctggtgtgtctgtatatgtggtcaactctctggatgttaacaccttgctggctggccaccaagtgaagataaactggcctgggtcacaagtcttttttctgtgtctagttgcccaaggtggacacatctctgtcatgtctcaggaccagtaaactcaagctatgcttggaaggacagaattgatcaagatggaatgactcctgagaggagacagtagtgatatttctgctccactgctatttatttttctggcttcaaggttcagattcaaccatggcaggagagaaagtccttagcagnttcttattttatattttttttgggcctatgcacccctcattaataag

SEQ ID NO: 13982 - DNA, 361 bp, Homo sapiens
tgaacccggggggggggtttgcagtgagccaatattgtgccactgtactccagcctgagcaacagcgcgagagtcgttctcaaaaaaaaaaaaaaaaaaggggggggtttaaccccctggtatcccccaccttttgggggggggggggattctcattttttgccgggaaaaaatttccaggttgggattttcttaagtttggaaaggttgccccttgggctttaataacctttaaaggttaataaaaaggggggggttcccccgggaatcccccacattttgggggggccgggggggggggaccaaaggccagaattttaaacccccccggcccaacataggaaacccttgttttattaaa

SEQ ID NO: 13983 - DNA, 390 bp, Homo sapiens
ggcacgaggttgggtagagacggtgttttcaccgtgttagccaggatggtcttgatctcctgacctcgtgatccgccctcccgcctcggcatctcaaagtgctgggattacaggcgtgagccacggcgcccggacttccttcttttttaagcaaagcctgttagaatggcttggatctcgaggtggcgtcttacccgacctccgagggctctgcagccgctgcgggagaatgaccctgtcggtatttttgaggctgctttgagcgcggccccctgccaagtacccggccatcaaggccctgatgcggccagacccgcgcctcaagtgggcggtgctggtgctggtgctggtgcagatgctggcctgctggctggtgcgcgggctggcctg

SEQ ID NO: 13984 - DNA, 382 bp, Homo sapiens
cgttgctgtcggcctattacaagcacattctttgattgagtcattggatataaacttactaaatgcataaaaagcagtcaatttacgaaacttctgagttggtgggacactgttgattaataatgtactgtatgaattaagagatgctttaactttgattttacattttataggtaacatgtggacattatagtatcaaacatattggcattatgtcggcatactagaaacattgtatttcctgtgcttttaaagtatactctttacatgatctgagagaggattcaaggtgatagaaatagctgaggggaaaagggggaacattttggtatgaagattggccttatggtgatgggttaattacacattatgatgttagaag

SEQ ID NO: 13985 - DNA, 351 bp, Homo sapiens
tacggctgccagaagacgacggaaggggtgcagtggcacgatcttggctcactgcaacctccgcctcccgagttcaagagattctccggcctcagccccctgagcagctgggattacaggcacctgccaccaagcccagctaatttttgtatttttagtagagacggcggtcaactcctggaactctgaatgaagcgaaaatgcgtaatttgggataatatcaaacctggcgtggtgaggaaagcccaccacaagcccgcccctggaatttctccctcctataaacccaggcaacataaataagtgtggctgggcgcccgctcctcccaaaaactcttgctgaaggacgcc

SEQ ID NO: 13986 - DNA, 378 bp, Homo sapiens
cgttgctgtcggagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctgggg

SEQ ID NO: 13987 - DNA, 381 bp, Homo sapiens
cgttgctgtcgggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcgagccagagctgcatctccatcctggtgtgtacaggcgtctacaatcccaggagcccacagtcca

SEQ ID NO: 13988 - DNA, 344 bp, Homo sapiens
ttaaggaacggaagttaagaatgtaacagacaaagtaaaaagacggcagagttgactgctaagcctaatacttttaggcttctcatgttaccttgcttaaaattgctgtataatttcaaaaatgccccacttcagttttaaaaagtaaaataactatttaatttatttatagaattaaaagaaaaaaatagtaaatctgtgtttttgcctagaattagtccttagacactacatcaaaaaacaaatcttggccaggcatggtggctcacacctgtaatcccaacattttgggacaccaaggcaggcggataacctgagatcaggaattcatgacccagcttgcg

SEQ ID NO: 13989 - DNA, 376 bp, Homo sapiens
cgttgctgtcgcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatc

SEQ ID NO: 13990 - DNA, 349 bp, Homo sapiens
  misc_feature 1, 349: n = A,T,C or G
nttaatctgggtgccggggacaagaagcagaggaaaaaccacactatcaagctgcaagagttggcactgctgctgcccatagccctgaagacggggaccaagaagctcacaaaggtacagggactagaggagaggggccagatttgggacgcaggtctttaaatagcagcagatgggtcaccctctcctgggaaacctggacagatcctttcagtggcagcattcatatgggaatggggctactctgaacgggaattttcgggagtctgtgaacccataactaggtgcctgggggatcctttttttggaaaggagagaggagaaaccgggctgggggaaaaaagagatn

SEQ ID NO: 13991 - DNA, 375 bp, Homo sapiens
cgttgctgtcggttagtaccaagctaagagtttacttacagatgacagcaagcagatgctctagtaattcgtcagacattgcagggatattgtgtagtcagatattaccctcttgtggaaagaactacctcacatcattatttatttcccttctgttaccaacagccaaggaattacttagtgtggctccctgcatcaatactgggatatgcttaaacaagggaatgccataagagttcccaattgcctcgtcatagcctgggccatagatttttgttactgctaatcttgcttcttaaagttcacacccagtgcaaaaaacccaatcagcaaactaaccccaaaatccaatatatttagaaatgtaagtgttaa

SEQ ID NO: 13992 - DNA, 341 bp, Homo sapiens
acaaagaggaattagtgaatgaataaatgaaagtctatatggtaaagctggggcatggtaggactagtcctttagaagtctcctgattcttagtttactgctctttgcaatccacagcattaacccccacatatatatgccccaggtgtagcctgactcataacatcactaaccctactaccaatggtgatgtgtaagcactttgtgctgggttaaagcttcaaacttttcttattgagattagatgatctaagcagtagagtcccttaaatcaaggttcagggccaggcgcggtggctcacgcctgtaattccagcactttatgaggccgaggtggtcgg

SEQ ID NO: 13993 - DNA, 371 bp, Homo sapiens
cgttgctgtcgggctctctagctcctccctgagtgctggtgttctttgcagtgattattttgtagccatttacctgtgattcaggggccagggtgaggcccaagagtggtggtcgggcagtggacaggcgggccaggctgaaagacctctgacaaggtgctgtgtggggtgcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatg

SEQ ID NO: 13994 - DNA, 333 bp, Homo sapiens
catggggggaaaagacctctctaatgttatgtagaaagagaaggagggagtgccccttctagcgtggatgcctttggttcccagatctggatttgaggggctggctctatctcttaagaagacatttacctagcattggtaatggagatggggccttaatagggctagggaggcacacccaactccagacacagctctctgctgttccccttcccagtgcacacagtcccaattcccactccagaaaattttttaaaaacatatcttaaaaaaaccccaaagagccaagcagaccctcagcttcaagggatctcctcattctctctctctctc

SEQ ID NO: 13995 - DNA, 334 bp, Homo sapiens
acgtcctactgtaccagcaataagacaatatgaataccctgcaaccttaaggtgcttgaagtaagtaatacgctctcaatgagacaaaagcaacaatttggaaacaaaagtggaaattaacaatgccactggtttctgtttaaagaatttatgtatcgggctttcattgtgaataaactcagtaagcagctactcaaatgatgtgattacatggtctaggaatatactcttggtctccaaaatgacttctctatgactcctggtagtatatgaaacttagtaattaacactttctaccatttaaatcaaataaatatgtttatctctgtgaaag

SEQ ID NO: 13996 - DNA, 334 bp, Homo sapiens
  misc_feature 334: n = A,T,C or G
aagctcggaaaaagaaatagaagagaagggttatgatggatttccttgatttattcagattgtgaaaacctaacagataaatttccacaaaattaaagaaaattcaaatattagatgggtgaagaagtccctccaattttaaataccagtaactcatcatttacctgagactagaaaataactagatatgcttaagatgcttctccattcttgttggtctccgggctacattctttctgataggtacctagcgtgtatattacacttcacatgtgcatggcatactgcagtgaatcaagcaatctgggagggaaaccttgccagaggagaaatn

SEQ ID NO: 13997 - DNA, 328 bp, Homo sapiens
  misc_feature 328: n = A,T,C or G
tcattttatgctgccttcttagatgcaagtattcattcatcccattatttactcaatcaatgaatatttactgaatcctttctacataccagacattgaaccagacatggctcaatgaggacttggtgtagcccttgcgggagcttacagtctcagagagggaaacagtcatgtaaaaatgagtcgtggtaaaatactacaagtgtttaggatactaatgaagtgagaaaaaatagatcagatggtcttgaattctggaaggtgagctcaccagatagttgaattccaaatacatgcaatgttatggtgtgtgtgtgtgtgtgtttgn

SEQ ID NO: 13998 - DNA, 329 bp, Homo sapiens
  misc_feature 329: n = A,T,C or G
gcaatgagtcttaagaaggtaacagcctaaaaccatctcagatgaaatggagctgctcagagacttttgggagctctcagacctggtggagacctctatcccaagtcaaaatgcaacactcacttcaaacagaaatatccctacaagacattaattcacaatttcaacgctttatgacctcccactatatgccaagcacttttaaagacttcagaggaatataaaaatgaatcatatttcatcttccatctgctcaaaattctctttgggtgggcagtgtggagcagcagaaaagtacgttatttgttacaggggaggtgtggatgaan

SEQ ID NO: 13999 - DNA, 164 bp, Homo sapiens
ggcagacgcaggggtcggcgccgggtgagagcgtgcggccgggtgagagcgtgcggccggattcaccacaacatggcaaatctttttataaggaaaatggtgaaccctctgctctatctcagtcgtcacacggggaagcctcgagccctctccacatttctatt

SEQ ID NO: 14000 - DNA, 320 bp, Homo sapiens
tcaggtgggaggatcgtttgagtctgggaggttgaggctgcagtgagccataatcatgccactgcactccagcctggacaacagagcaagaccctatctcaaaaataataaaatttaaatgttgtatagagatgtatgtaaatacatagaaaaaaactggaagaatacatttaaatagttaatagtgttcaacaattttttaccaggcacctactattggtaggtgagaatatattggtgaataaaaacccattgatcttgccctcatggatcatatgtggacaagatcagcctttctcaactggagttctgagagattt

SEQ ID NO: 14001 - DNA, 369 bp, Homo sapiens
ggagatgatttggacaaatggggttttcaactttgatgtgaagggaaaaggggaagtaggggataccccttcagctgtcaggaactgggcacctacatgggaagccctagatctgcaaatgctttgagctataacaagtttgaaaagctggatgtgagacagcactctaatttaaggggatgataaaggctgggatcctaattctcaccccaaaccccaatagcatagttctatttggccaatccaaaaagcacgtgtatcttggaactgacctgtagactcccatggtctgaatgaagtgatatgtcccctaaagctttctctggctggccctaagacaattaactagtaagatagcataccagattt

SEQ ID NO: 14002 - DNA, 309 bp, Homo sapiens
  misc_feature 160: n = A,T,C or G
ctctaggagcttccaggtcacttctaactgcctgcagctctcccttctcggaaccctgctgcattcaaagaggagccgtgctatttagctcttttttcttgtctttttttttttttttaaaacagggtttccctttgccccccaggtgggagagacattnccaatgaaattctaagcaggctcccttccctcttgcgttaccccaaatcctaattgtatacctaaaaagagtgggggcataatggggcggccccacaaggccagggggtttacagtacacttggtgatagaactttctacccccaccta

SEQ ID NO: 14003 - DNA, 461 bp, Homo sapiens
gtcattgtctttttgattatcccatcgattccaattccgttgctgtcggtttcccggaggaaatgactattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggtgggctcctgagtgggggcttgaccatggacttggaccactctataggaactcagtatagtgccaacccacctgttacaattgatgtaccaatgacagacatgacatctggcttgatggggcatagcc

SEQ ID NO: 14004 - DNA, 449 bp, Homo sapiens
  misc_feature 14: n = A,T,C or G
ggagaaggcttttngatatccgcaggataccacttgcttgctcgtttggccgttagctccaaacattctacacgttgatagaaaactacgaagagggacgcttatacttgccatcatattttactctaaacccctgctactgggtcattttttgattatgcaggtaaatcccaaagcttccacaggctgctctagtattctatcgggcattttattccaaaactttttttttactttttactatatgcctagcagaggtctaaaacctttatacacattaactgacttaatcttgaccagatctgcggattcagtacattttactcccattctggagcttacgtaaatgaaacactgacacgctgatagtcatgtgttagagtcacgatttgaacctacgtaagcttggctgcaaaaactgtgttctcaaatgtctgtacttttatatg

SEQ ID NO: 14005 - DNA, 450 bp, Homo sapiens
tgacgagcacatggactttctgcgcgatgcccttcaggaccatgcgtgctacttggtgcagaagaccaccgaagggacacccacctgcattgtgagctctatggctttgaaaattacgacacaattcttttacgactcctccccttcaccatttgtgtccacattaccattgctactgtctggcatagcagtcctttttataaatctaccctaaggctccttccatcttgtactgtttcctttctccctcccatctgctccagaagaaaaaaatatatatatactacagaatccacccttgcctcactttatgatgacggcattccctatggaagccctatgctccttttcacacacacaaaaaatggaagtaatattattttctttgaaaatcatcaatcctcctactatgacatatggaaagcaaacagctgtacccacgaaaggtac

SEQ ID NO: 14006 - DNA, 416 bp, Homo sapiens
  misc_feature 276, 416: n = A,T,C or G
ctatcttagaacaagttaaatagtatatgtacttgtaataacttgtgactagatatgttagttttgtctattaatttttctgttaaaaagaatatgcattgaaatgagatggaaaacaaaatgaaaagtgtttaaaaaattaaatattttagaaggatcaatatcctaagggttgtgggtaattctttcctactttctaaaacttcagattcctttcactcacttaaggttgtactaccattaatgcaatgttttctgggagtgcaagatttgcanatgaattaataacagctagaagcctcactatttgcacttttataacattctttgcttgtatcattacaagggtaaattatatagtaataggtggaaaaaagtatcaaaaatcagtgaaaaccacatgggattcatatggn

SEQ ID NO: 14007 - DNA, 412 bp, Homo sapiens
  misc_feature 248, 368: n = A,T,C or G
aagttgcctcagaatgagacacactctttgacttcacatgcaacagaaaggcacagttttatttcaaacaaagcagtgttttgctgtaacaccgttaaaaactggaaaggaaaactcaatcaaaccaaaaactagatgcttaggaataaatggtagaattcttacaaaaccaccacgcttcaattcaatctaaatcaattcaacaaatctgtgctgaaagtataacatttagttttcttagacaccanatgaacaatacaaaatccctcaagggacttagaacattcaagttttctatatctgtggttctaagtctgttaccaacttccaggactctgcttctttccctctgcccattaacaatgcgngtgttaaagtgacttcctaccactatagtttttacagctgattc

SEQ ID NO: 14008 - DNA, 441 bp, Homo sapiens
  misc_feature 429: n = A,T,C or G
tcgatctcaattccgttgctgtcggcggacgccttccttctgaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggngtcctgaccgag

SEQ ID NO: 14009 - DNA, 403 bp, Homo sapiens
ggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaaagcggcagcacaggagacagaacgtcttctcaaagagttggagcagaatgcaaaccacccacaccggattgaaatacagaacatttttgaggaagcccagtccctcgtgagagagaaaattgtgcc

SEQ ID NO: 14010 - DNA, 430 bp, Homo sapiens
  misc_feature 401: n = A,T,C or G
ccatcgattcgaattccgttgctgtcgcccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcaggctctctgccagctgcagtgggaccacgagcccangacaggtgtgcggcgtgggacaagggtgc

SEQ ID NO: 14011 - DNA, 437 bp, Homo sapiens
gcaggatcccatcgattctaaatccgttgctgtcgcacagagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgg

SEQ ID NO: 14012 - DNA, 428 bp, Homo sapiens
cgttgctgtcgctgtcacagacacatatttggatttgtgattttattctcctggatggacaattgtgatggattttttgggttccgggcttcaagctttgcaatctcatcttctttgcccttcctcttgccataatggaagaggcgctgctaatttgggttccatcctttcctgctttcacagactgccctgtgatttcctaaaacatttccattagtttgtttgaattctctgattttcttcccttagggccctccacaggcctctgtgctagtgccttgaatgatggcaagcgtacaaaaaatattttttttctttttaaaaacgtttttgttccggccccccatgcttgtgagcccaattcatctctctcgcacgttatttccacccctctaccccctcagctttccagcgtgctcatcaggggg

SEQ ID NO: 14013 - DNA, 424 bp, Homo sapiens
  misc_feature 21, 24: n = A,T,C or G
cgagtcgtacaattttgtaanganccggagcccacgattcgaaggtccttgctttcgggaagaatattctacttatcacaccagagcttccaccgacagggggggggacgtaacacaccttggttcccctccggctttccttccccttctctcccgccttctccttaatcataccaaaagcgcctcagctctgattggctggagctctgtgctatctcagccaatcacaagccgggctgtgctcctacaccatccgaagagcgaatcgtgcagagaccgtgtctacgattggcctctccctgacaaggatttaattatgaatttttctttatggcgtgggagaggccacagcccggactccatcgactcccccggctcttagactaaaatcatgcccaagtgcaaacaacgaagacgaaagcta

SEQ ID NO: 14014 - DNA, 429 bp, Homo sapiens
cccatcgattcgaattccgatgctgtcggtggctctgtatggccagtaactgggactcgagctttcagattctcaactagccttggcaaaacagctgtaggtggcctccctgacaacagacactcagacctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctatgaggccaagctggtgtctctaggagggcccacacaggcaccctggatcccccagagagtaaattggtgtgctcaggccgcaggctgactcataggtagggcagtgggctctgcagg

SEQ ID NO: 14015 - DNA, 423 bp, Homo sapiens
  misc_feature 423: n = A,T,C or G
cgttgctgtcgggctgcggccggtttggcccttctttgtaggagagtttcatccgccctgaaatcttgccgatcgttaataactcctcaggtccctgcctgcacagggatttttcttattttgttgcctaaaagcacaccaaatgtgacatcctttcaccaatatagattacttcataccacattgtcaaggaaaggactataagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattcn

SEQ ID NO: 14016 - DNA, 252 bp, Homo sapiens
aaataaaataaaataaaataaaataaaataaagataaatcaggcagttcagtaactgaattctccccatcacaaaaagatttttcattttacaagtattcatcaactacaattgaactgtaggaaaacactttaggtagtgttttcccctgggttatacctctttttctaggttaacttttactggtcctaagcatttggcacttcaaaaataccattttatggtgttgggaaaactggcttaccgcatgca

SEQ ID NO: 14017 - DNA, 391 bp, Homo sapiens
cttgtgtggtgcactgtgctcctgtctttagggacccgtgaagacaaacttcttccttcatgatagtcatttccatgcgtctgtgtccatactatctctggttaaaacaaatcccaggtacattttaaaacacggatggtggtagatcttgcatggaatggtgatctagtcacatatattttatatactctggaaatgatgcaaaaattggctacaagaaagcttatatctctccttgtaatcttctataacaattttaaactaactttttctacatacagcatgttgtttcctagatgaggcgatgaaattctttatgcagcaagagttttccagtatatttcaaaataccttattgtgaatgtttttgaaatgtgtaattactatctga

SEQ ID NO: 14018 - DNA, 391 bp, Homo sapiens
ctcaacacacccaggtttttttgttctctctttctctctggcctcaattccatgccttactacttgattgttgtatgctaggattgagggaatatgcatgcaaatactagacaaagcacttgagggaggccttctcccacagtactggtggctgtgtaatagatgttctcaattaccaagtgcttaaactgagccctatgtacttaggcagcctgtttagagttcttacccacttgccaatgacacttgactgctgaatccaaatatgaaaaaaactatagatagattcaaggaccaaaattatggatatgccactgaaaatgtatggtagagtaggccgggcacagaggctcatgcctgtaatcccagcacttttggaggctgaggcggg

SEQ ID NO: 14019 - DNA, 258 bp, Homo sapiens
ttagatgatggatatctagaggtgtattatatcattggctctattttgtatgtttgaagtttccatagtataaaacttaggaaagttaatttaaacagacaaataccccatcatgaaaatggataatcaaaaggaactcttgataatgaaagaactaaaagtggccagatgttttcaaatgcttagctttactactaattcttcaatgttagttttacaaacaaagatgatacctcttgctgggcactgtggctcact

SEQ ID NO: 14020 - DNA, 390 bp, Homo sapiens
  misc_feature 390: n = A,T,C or G
taataactataatttattcagtacctttttacataatggaccttattcttaatgctttatgtacattaacccatctgaccctcatgacgaattacctatagcttattatgcccatttttcagataaaaatgaggttcatgaacatatatattttgcacacatgtatttttaataatttcaggccaggcgtgatggctcatgcctgtaatcccaacactttgggaggccgaggcagatggatcatctgaggtcaggagttcgagactagcctggccagcatggcgaaaccctgtctactaaaaatacaaaaaaaaaattaaccgggcatggtggtgggcgcctgtaatcccacctattcgggaggctgaggcgggagaatcgcttataccn

SEQ ID NO: 14021 - DNA, 386 bp, Homo sapiens
aataaataacttatgtatcgtcggaggtttttactgcggagagagctgtacgtaattggtgcaccacacagatgctccctccaggactgaaggacttacccctccagctgctgggattatagttggctgacactctccagcagctggcagtttccaggaactgcctgtggctgaagagaaccaccttactcagagttctaccctcctcctaggggcagctgcatccaatgactggcctatgtggaggtataaatccatcttgccaatattcatacttatttacataatttacgatattcatacttaaagattctgtgcccttacccaactcaggataggctaaaagaactagcccagcttggccgggtgcactggctcacgcctgt

SEQ ID NO: 14022 - DNA, 414 bp, Homo sapiens
ggcgttggtgtcgaaaccgttgagtttctaaatatttatttattctaacaaaaagcaatgagtacggggggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatg

SEQ ID NO: 14023 - DNA, 416 bp, Homo sapiens
cgctgctgtcgacttcgtgaaaattatttaggaggaagagccggaaggaaaaccaagtgatgcataaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcaaaaactgaggaacaaaacccttgaagatcgtttgaaaattgaagcaaaaaatgggacattgagtgtattcgacaccaacgttgggagcaaacaattgaccttcacgttaaagaggtctgaaccgcacaataaagcatcagggaggctgggaaact

SEQ ID NO: 14024 - DNA, 388 bp, Homo sapiens
tgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaactgcccaccactctctccaccccgccttggtcttccgagggtgacaggtgggacgctgaagagagctgccctcctggtcccggcctccatgtgaacagcctcctcccaaatcttcctttggatctg

SEQ ID NO: 14025 - DNA, 415 bp, Homo sapiens
  misc_feature 396: n = A,T,C or G
cgttgctgtcgctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcanagctggagacaaagtgaaa

SEQ ID NO: 14026 - DNA, 414 bp, Homo sapiens
cccggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggggaagtctgagggcccccctgcagtctca

SEQ ID NO: 14027 - DNA, 415 bp, Homo sapiens
ggcacgagcagccccaggcccccgtgctctctgccaggaggtgccttgccacttggcatggccccagtcacgggtggcacatctggggtgaatgcacgtcagtggaggcagaatcattctgtctgaatgaatggagtttccaggcccccactggccctctgtgtgagggtctgcagggtttggcaggacaggtctttctctccggcgagagcacccaccctgaccggctgctggatgagggcaccaaagctcgctagggagggctctgtccttatggaggagctgcggaatccctgcagctgtgcccccaggccctgccttgcacactttctgcagccagggcgcccctggggaggtcagggcaggccggggaggctgagggccacctggcatagtgggcaggcgggggagccgt

SEQ ID NO: 14028 - DNA, 413 bp, Homo sapiens
cgattcgaattccgttgctgtcgcccacacagggcacatattccacgcaccccacacggggcaggcagctcacacagggcacagaccccacgcaccccacacagggcacagaccccacgcaccccacacagggcacagaccccacacaccccacacagggcaggcacctcacacagggcacagaccccatgcatcccacacagggcaggcaccccacacagggcacagaccccacacaccccacacagggcaggcaccccacacagggcacagaccccacgcaccccacacagggcagggatcccacgcagggcacagatcccacgcagggcagggccagcccaaggccaagccccttccctgtagatcttctcccaggcaggaccagagccacagtcactttcacactatct

SEQ ID NO: 14029 - DNA, 418 bp, Homo sapiens
cgttgctgtcggtttcccggaggaaatgacaattacctgacgatcacagggccttcgcagcccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggcgggctcctgagtgggggcttgaccatggacttggaccactctataggaactcagtatagtgccaacccacctgttacaattgatgtaccaatgacagacatgacatctggcttgatggggc

SEQ ID NO: 14030 - DNA, 405 bp, Homo sapiens
  misc_feature 235: n = A,T,C or G
cgttgctgtcggatcatttgaagcaaacctcagaaatcactttattcctaaatatttaagtatgcatctctaacttattaaaatttttttggttttgttttttgtttttctgagacggaatttcgctcttgttgcccaggctggagtgcaatggcgcaatcttggctcgctgcaacctctgtctcccaggttcaagtgattctcctgtctctactaaaaaaacaaaaaaaatcanctgggtgtggtggcgggggcctgtagtctcaactactcgggaggttgaggcaggagaattgcttgaacctgggaggtggagattgcagtgagctgaaatcacgccactgcactcgagcctgggcaactgagcgagactctgtctcaaaaaaaaaaggccaggcttggggg

SEQ ID NO: 14031 - DNA, 378 bp, Homo sapiens
tttggtattgccgttattattgttgttaaactgactaaaatcatacatggaataatagaaatcaggcctaacatcagatagacttttccattcagttaagttattgtgtagcaaaatttattttgtcagttcactacacaatgtgacagtatatagtttctctaatagagtaacattaaagaggacatataatataaccaaaaatttgagttccagataagtttggtgtctcactagcaagatgacgttaaataactcatttaatttttttgaaatcttaattttctgttctgtaaaaaaaaaagcaatctgtctcttgtccaaaagactatgtaggttttttaaaaattttttattatgtcatatacatgtgcatac

SEQ ID NO: 14032 - DNA, 353 bp, Homo sapiens
cgggaggctgaggcaggagaatcgcttgaacctgggaggcagaggttgcagtgagccgagattgcaccattgtgctccagcctgggcgacaagagcaaaacttcatctcatagaagaaaaaaccaaaactccagtttagcaaaaaaaaaaaaaaaagctcccccggcccggggggaggggtttatggctaaaatcccaaacctttgaaaggttgggggaaaaagatacctggaccccccgggtgggaaaccgccgggctataataggggatacccgtttttttaaaaagttaagaataagggggggggggggggggataccccttagaacccgagattttggaaggcccgggg

SEQ ID NO: 14033 - DNA, 405 bp, Homo sapiens
cgttgctgccgaatcgtgataaagacaaagaacttttaaaattaactcactacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccac

SEQ ID NO: 14034 - DNA, 409 bp, Homo sapiens
ggcacgagagagtccgtaggtttatcatattatcaaggaaaactgtgacccaaagaagtttaggaatcacatacagtgctgctggctttttgtgcttggcaaatgagtgacaatagaagaaataatttttcttacacattttaaaacgatttctcttccttgtgattgaagatgaaaggagtaagaaattaaggcatttgtttaatttatactggcaacttatttaggggggaggggacatgaaggtaggtaaataggtaggcctctaattgaaccacctctctaagatatgtacgtatatataagctgatattgtgtttgacattctgaagggtttctttttctttttccttttttttttttttgggggggggccgggggctaaaaacttttttttttgacccccggc

SEQ ID NO: 14035 - DNA, 381 bp, Homo sapiens
atcattctttgaaaactgacaggaaagatacaacttagaaaacattgtggatgaatacttcccccttttgcaaatgatattttggaagcacaaaagaaaaagctctaatacaaatattcataatgaaaatatgaacttaataataccaatggcaagacagaataattaggagaaatcgggtaacgagcatctctcctatttttagtttgtaagccttttttgctttttttttttttttttttgaaaaaaaagtttatttttttgccccagaaggccagggaattaatttggcttaatgggagcctcaccctccggggttaaaacatttttctggctaaaacttccaagatatttggaaatagggggcctcccccccccccg

SEQ ID NO: 14036 - DNA, 405 bp, Homo sapiens
cgttgctgtcggccccggcagccgatgagtgtgactaccgggatgaacagacatgcgcccaccagatgattgtttaaccgggagtttatcaatactgtggaaagagaacgccttggagagctgctgacagctatattaattgaatgaggctggaaggatcacgtgaaggcactctgtaaagataatgattataaatgatatgattcggtttttgcttttgcataagaggctgttagagagataggactataacacgttactgttgttgacttggtggctgaaatcactccaaaaggcagagccctggtacctgacagtgtaaagaaggagctcctacaaagaatatgaacattccttgctcagcatgccagcctttaagattgaattagattgggttgttgtggg

SEQ ID NO: 14037 - DNA, 381 bp, Homo sapiens
gcattttgatgtgtagaatcaggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagaca

SEQ ID NO: 14038 - DNA, 406 bp, Homo sapiens
cgttgctgtcggatggctccccctatgaaagttgtccagtgagcagggtcaaggtttatgtttggggtacggacatgagtgcaggagccttactctcctgtgtgttgtcagggatggataaaggggatgaagttggaggggtttagtgaatggttgggacagcaaatttcagagaagagcatttggaaataattttctcaaatatatatttttaaaatccatatttgatttttttccctcagggattcccaagcatagtagagctaaaatgaattaatttgggtaaaagtaaagttaaggctaagttaggaaacacttttaaaaacaggaacctgctgcgtgcggtggctcctgccttgtggtcccagcactttgggaggcaaaggcgggtggatcacctgagatg

SEQ ID NO: 14039 - DNA, 388 bp, Homo sapiens
agggtactgtttcttcctttccaaaggccacagggagaccttgtaatctgctttccagagcctttgggaaagtggtcaacaccctgccttcttaggaagagcccagagaaacagagggctatcccgggggttttgtttatctgcccttgtggagttggcagacgtgggcttctgtcttccctgctatggcctcagagctttagatcctgctggtttagggaatttgaatctttcctgttagggaaaaatgagtgcttactgtgctttgtagaaatattttcagaattcattttctttaaattattttcattgtctttaaattatatctaaacaagtataccatagctttcctgagagggaaaacaatctatccaacacattgtgcact

SEQ ID NO: 14040 - DNA, 382 bp, Homo sapiens
  misc_feature 382: n = A,T,C or G
cctactaggtcaagtgagtaccaaggacagcgtggcaggtgaccatacagacgcctgaataacaggaggcatgctgcattgaggcctacctttggaaaaagataccacgatgctttaacaaccgtggttaatagtgttcatgcctttgttaattgtactcatgaagtagtaataaaggttaatattctccattggcattatcaaatattaaagtactggccaggcgtggtagctcatgcctgtattgccagcaatttgggaggctgaggcaggtggatcactagaggttaggagttcgagaccagcctggccaacatggtgaaaccccgtctccattaaaaatacaaaaaaattaccgagatgtggccaggcacggtggctn

SEQ ID NO: 14041 - DNA, 411 bp, Homo sapiens
cgttgctgtcgggctggtcttgaactcctgacctcaggtgatctgcccgcctcagcctcccacagtgctgggattacagggatgagccaccacgcccggcccatttttttttttgacaacttttttttttggaaaaggggtttggtcccttggccaaaatgggagggcggggggtaaataaaacttaatggggcccagaattcttttggcctaaccccccaaggagttggaaacaacggggggaccccttaggccgggcaagtttttcattttttggaaaaaaaaggggttttttttttttaaaaaggagtttccttttggcccccaaaggggaggggggagaccggggccaacctaatggggagccccccccccaagggataccccatatttgggcgcaaaaattagggg

SEQ ID NO: 14042 - DNA, 410 bp, Homo sapiens
cgttgctgtcgcacagcccagccccctccagagccctgccccaccgcaccctgcttctccagggcctagcagaccagcatctgccccggtgaagggatggatcagctgtgggggtgggtgcagaaggttgccacctcctacctcagcgggagtcacctaggaaagatggagggattgacactattttctcaataaaatgggacttttttttttttggggggaaacttcctgttcccaattgcataaaaaaccctttttgggcccaaggttcccaaaaatttttaaaaaccccatttggtccttttttttggttggggggggccccaggccttctggaagggatttaaacggggctgacggcttgaattaaaggggggatgggaatcccggaacaaaaaaaccgggaaccg

SEQ ID NO: 14043 - DNA, 383 bp, Homo sapiens
ccgccctgcgcccggtcccggcctttccctgccctctggccggtcctcctcccgcggccgtcccgggacctgtgcccagacccctggggccacgatcacgccccagccgcccaagtcaccgcccctcccctcccttccagcgttcccgcccgggcggtgtatggtggctccggtgtatggcggttctcgcacgcacagccgcaggggtttcctctcctagactcgaggcggaggcgcacctgcaccctctaaaactcccccgtcggccctcgcggactatcgggaggcgcggagggccgagctgacgtgcgtgcgagcgggcgccatgaaagcgcggagccgtcctagggctaagcctttctttaacagggggaggcccacga

SEQ ID NO: 14044 - DNA, 410 bp, Homo sapiens
  misc_feature 402, 410: n = A,T,C or G
cgttgctgtcgcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaagggggccaccttgagtgggtggnccagaaan

SEQ ID NO: 14045 - DNA, 409 bp, Homo sapiens
  misc_feature 333, 409: n = A,T,C or G
cccatcgattcgaattccgttgctgtcggggggatcttgcaaaatgccgatttctggcaaggcatcaggtgatggtgaagaaagttttgagtaccaagaggtagagtagtggttcttagactttaaaagctggacacccccaccagtgcttttgattcacctcactgggtggggcctgcagatttcattttaaacaggttcctaggtgatgctaatgcacatgaagggcagggtgtgttctgagagccactgtggtggagtagaaacaaccgaggagaatcaagcccatccatctcatcctggcttcttgagcattatttcctttttctttgnttttgatttgagacaggggttcactctgtcactcaggctagagtgcaatggcatgatcctggctcactgcagtctn

SEQ ID NO: 14046 - DNA, 408 bp, Homo sapiens
  misc_feature 408: n = A,T,C or G
ggcacgaggttgactgcagagtgaaacatccttgcaatctcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctn

SEQ ID NO: 14047 - DNA, 408 bp, Homo sapiens
  misc_feature 408: n = A,T,C or G
cgttgctgtcggaacagcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaan

SEQ ID NO: 14048 - DNA, 405 bp, Homo sapiens
cgttgctgtcggctctgaggggctccttgccagggctgtggtccaggcggcctcggcccccctggggctgtggacaggagctctggctgtcctacgtagcttgtggagccgctggggctgcagccaccggatctgctcccgggtgcacctagctcagcccttttccctgcaggaatacatcgtcagtgccagaagctgctggggcggcagacagaccctggagcagctactgcagcccatcgtgctgggccaatgtactgctgtcccagacactgagaaggagcaggagtggacccccataactgggcctctcctggccctcaaggaagaggaccagctcctggtcaggagactgagctgtcatgtcctgagtgccagtgtagggagctctgcggtgatgagcac

SEQ ID NO: 14049 - DNA, 406 bp, Homo sapiens
ggcacgagagcaccggcggttgcatttttggccagtcgcctttgcccgcgccccccgggtgccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcacttggggccagtgaagcaggcgggctcttgcagatggacacggccttcgtgtgacgccaactaaaagcaac

SEQ ID NO: 14050 - DNA, 411 bp, Homo sapiens
cgttgctgtcgccgccgctaccgtttcgagggcgagggtgacatacagcgtttccagcgggactttgtgtcccgcctgtggcttcacataccgccgggacttcccgccccttcctgggggctgcctgacctcggactgcggctgggggtgcatgttactcagcggccagatgatgctggcacagggccttctgctgcatttcctgcccatagactggacatggtccgagggcatggtcctgggcccccctgagctgtcagggtcagcctctcccagccgtgaccatgggcctgcccgctggatgcccccacgctgggcccagggtgcccctgagctggagcacgaacgccggcaccggcagattgtgtcctggatcggcgaccacacacgggccacctttggcctactccc

SEQ ID NO: 14051 - DNA, 407 bp, Homo sapiens
  misc_feature 407: n = A,T,C or G
cgttgctgtcgcttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccacactcgttagan

SEQ ID NO: 14052 - DNA, 405 bp, Homo sapiens
ggcacgagaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaa

SEQ ID NO: 14053 - DNA, 406 bp, Homo sapiens
cgttgctgtcggggctgcagcggcgctgtctttatttgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagg

SEQ ID NO: 14054 - DNA, 408 bp, Homo sapiens
cgttgctgtcgaaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaag

SEQ ID NO: 14055 - DNA, 408 bp, Homo sapiens
cgttgctgtcggaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggtt

SEQ ID NO: 14056 - DNA, 409 bp, Homo sapiens
  misc_feature 409: n = A,T,C or G
cgttgctgtcggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcgggcttgcgagtggctggttccctgcagan

SEQ ID NO: 14057 - DNA, 410 bp, Homo sapiens
  misc_feature 410: n = A,T,C or G
cgttgctgtcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagan

SEQ ID NO: 14058 - DNA, 410 bp, Homo sapiens
cccatcgattcgaattccgttgctgtcgagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctgga

SEQ ID NO: 14059 - DNA, 406 bp, Homo sapiens
ctaggacgtcgctgctcttcagcacgaagaagaggaatttcttgttgaagtcgcagagcttccagaagagaactagcagctcctggtggaactggatcttcttggtggagttaggcaggtaggtctggagcagggggttggacagcagccgggctatacccttgaggatgaactggaagtcctcctcacgatggatgcgggacaggtagttcacaaacaggttctcagggcctggaggatcagcatcatccatggcggtgccagtggtggtgccgtccacagtggggctggcactgctggcactgtcgtggtccaaagtgacaatgagcacctgggcagcctcctccaccaggggttcccggtagtcagagaagagcaggtggttgtaggggatcccgtagcccat

SEQ ID NO: 14060 - DNA, 409 bp, Homo sapiens
attcgaattccgttgctgtcgggaggccgggggagacttggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcc

SEQ ID NO: 14061 - DNA, 412 bp, Homo sapiens
ggcacgagcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcacaatgccaacaccaagtgcaacgggctccttccggtctggggacctcatgtccctgaatcagcttttgccacttgcttggcaagacacaacacttacctccaggaatgtacaggccaacgggagcccacgtatcagctcaacatccatgacatcaaactgctcttcctgcgcttcgccatggagcagtcgctcatcgcatacactggcggtggcggccgggagagcaaca

SEQ ID NO: 14062 - DNA, 369 bp, Homo sapiens
tgagcaaggatggggctggggcgagagggagaacaggacggagctggcctccagctcctcatggtgcagatctgcgaggcacacatgacccgcagtgtccccaggtgacgcctcattaggaagtgggagatacatacaggttagcaaacctcggcctgcaggtcatgtccttttccgtgtgtcctgtgagtgaagaatggttttacattattttttattttagttttttgagacaaggtctcactccatcgcccaggctggggtgcagtggcatgatctcggctcactagagtctctgcctcctggtcccaagtgatcctcccgccttagcctccctagtagctggcactacaggtgcgtgccaccatg

SEQ ID NO: 14063 - DNA, 404 bp, Homo sapiens
cgttgctgtcggtgcagtggcgggatctcggctcactgcaagctctgcctccccctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtattcatgaacttttacatgaatgagtaaggacattgaaagatgcatgagatgatgcatacatctttgtggttgacttatcattgcatgatgcatgacgtacatgttcagagtaatattcttctgcattatagtgagagaaaaatcttggattttagtaat

SEQ ID NO: 14064 - DNA, 401 bp, Homo sapiens
tcgaattccgttgctgtcgagcacacttgcacctatttgacttaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttggatattcagtcatggagaaaaacatattaaaataatttcatggccctgatgttaattctagtctattagttttataaaagctaggattcttatttaggaacaccagaaatgactggtacgaaaaaatgaatttattgatgggaaggcacgagctcacaaattgataacttgcgcggactaggtgccaaacggtgaaatctggcca

SEQ ID NO: 14065 - DNA, 402 bp, Homo sapiens
cgttgctgtcgcagaagatcatgtgagcccaggagttacagactgcagtgagctatgattgcactgatgcactccagcatgggcaagagcaagaccttgtttctaaaaaataggtagtggtatattcatattctggaatagtgtaaaaaatgaaaaactgaagataaatatatgaagacaagtcctcaaaatacttctgaatgaaaaaaattgcaaacatgaatctcaaaaacatgctgagtgggccgggcatggtagctcatgccggtaatcccagcacttagggaggccgagttgggcagataacacttgaggtcaggagttcgagaccagaccagccaacatggtgaaacccaatctctactaaaaatacaagaaaaaaatcctaactactcgggacgg

SEQ ID NO: 14066 - DNA, 372 bp, Homo sapiens
ttcaccatgttgaccaggctggtctcaaactcctgacctcaggtgatccacccttctcggccttccagagtgctgggattacaggagtgagccaatatgcccatcttgtcttttctttataaaccacccagcctcaggtatttctttatagcaacgcaagaacagactaacacacttcccttccaggatctttcagagcacgtcaagcccctgttatagattcttgagctcccacatttctccttcaaagtaattattccaatcacactaaataaataataactgtgaattatttgcttgaagtctgtttccgatggactaggatgtgagctccatgaagaccagatcagagggccaggcgcggtggctcac

SEQ ID NO: 14067 - DNA, 372 bp, Homo sapiens
cccccacagaggctggagagggcagacgggcctagatgagcctagacgctgggtcccaccagtcccccaaagccagatgttcctgttctcacctgggtgtgtgagattttttgtttcattatgctccttacaaggcgaagctgtgtgaaccgtgagcgtgagctctgggccaggctccatggcccttctaaggaaaaggccccttaggacacctctgggctgtgaggcttccccggcttcccctctgggcttggaggaagtagggtaggtcctcagccactctgctgaggggcaaaggaaccagggtatgaacaggaaaacagaggcccaaagagtggctgcagattcaggtgattcctggggcttggggga

SEQ ID NO: 14068 - DNA, 350 bp, Homo sapiens
agggttacaggtacctgccaccacacccagctaatttttgtattttagtagagacggggtttcaccatgttggccaggctggtcttgaactcctgacctcaggtgatctgcccgcctcggcctcccaaagtgctggggttacaggtgttagcccaccgtgcccggcctcttttttttttcgtacaatggcccattctgttgccccggacgacattcgatgcccctgtttacagttctttgcctccactttctgctagtgttttgtttttgtcagcctcccccctgcccgagagaatataatatagtttgttccgcacccgcgaaaccataactcccttttatttggttgc

SEQ ID NO: 14069 - DNA, 402 bp, Homo sapiens
  misc_feature 386: n = A,T,C or G
ggcacgagccctgggccacatttgaagaagaattttcttgggccacataaaatacactaacgatagctgatgagctaaaaaaaaaaaaaagccggggaataattttggggatatctgcccccacaaataaacaaaaaagcccttgctttcaaagggtggaaaattgctgctttgagggctgggaacctggggggaacctactactccctgggccttagtctcccaaatccaccatgcttttgcccctttgagggggtcttcactttgtctctggcatctaacatggggcctggggcatagggagcatgcaataaatatttggcaggggaggggatggataaatggataggggaatgtagggggacaggggactggggggatgttgnggcctctgaaaaaccc

SEQ ID NO: 14070 - DNA, 236 bp, Homo sapiens
aaaaaacaataaaataaaaattataaagggggggcgtttttttcgtgataccaaaacgggaaaaaaccttttgggggttgggcgaccccccctctttaggggcggggaaaaaagggtttttttttgtgaattttgagcctcttcttcttttttgtgcccccttacgtggtggcgataaggatctgtgtctccacccgggcgtgcttcttttattgcgttgctctttgcgtgtgcct

SEQ ID NO: 14071 - DNA, 131 bp, Homo sapiens
gtccgacccgggcaagatggcatcggcgctgcgcgtgcgttgttgagtgttcgggacgccggcctgcaggcgccatggtcttcctcaccgcgcagctctggctgcggaatcgcgttaccgaccgctacttt

SEQ ID NO: 14072 - DNA, 398 bp, Homo sapiens
cgttgctgtcgtgaatttgtagctccatttacatggatccattgccccagctactggagtatagcctacaatgtttatttcagtcaatattcctttatctgggtgttctgtacaatgtttattacaggcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattatcagccccggggcctaaaggaatcagctgtcatcattttcatcattattattttggttaggatggcttgaaaatcacaacgtatcttggtttacgtaattgaagtcttacagaag

SEQ ID NO: 14073 - DNA, 370 bp, Homo sapiens
tatagaaatgctactggctgttcctgagttttagttttaaattactgtcaatcattcctcagtggtcccatgcacagtccccatgctgcagggaggccagctcctctgggcctcgtggagtaacggtgttgcttagcccatatcctcctggacaagtgctttggttcttccctttaccggtaaagtgttgcaaacgtagtctatcgagtttgttctatttcatctgttctgtttacgaaactgtaacttcatataggactgccttagggctgaagtaaataaactgtcaacctaactaaaacataaaacaggccgggcgcgggggctcacgcctgtaatcccaccctttgggaggacgaggcggtccaac

SEQ ID NO: 14074 - DNA, 374 bp, Homo sapiens
atgaaactctggatgaataagagaacagaaaatgcctgataaattcagattttcaaaggacatgtacagctttttagtcaaagaggcacagtttattcaagtaaataaaacttatattctcaggataactaagatttatttagttagactgagcattccaaattatttattccacttatgttaattcacacagggaagactgaggctcaggggtgctagatgactggttaagctttctcagtgacacagccatgacgacagccaagtttttctaatttttggtccaggcctctctctaacacatcagtgacttctaaacaatcatttgagaattccgaggtgatccttggtgcaccccattcctcaccatccaa

SEQ ID NO: 14075 - DNA, 370 bp, Homo sapiens
  misc_feature 365, 370: n = A,T,C or G
tgaccttttgatcccatcatgggactgttccccagccctaggccactggaatggggggaaatagaaccctcctttccttgttcccactcttgtttcttttgaacatgggttacctcccttcgcgtcttttggaacagaaggggatcataagctcttgagtctctgttttctgctgtcatctactcttcctgcctctggcacctcccagctcctgacttcctcctgcttccccctggagccagagacgtggctgggaagagcccctggcctttgaagccagtggtggtggtgaccaggggcaacaggccactgtgctcctggatgcgtggtctgccaggtctctctcccatcgccctttgggcctncgggn

SEQ ID NO: 14076 - DNA, 373 bp, Homo sapiens
aagaagctagtaatagtctagcttccactgctatctgcccgagcttcagcgattccaccccctcaggggccacacctccctgcaggtcccatttctgggaaaagccggcaatctatgtcttttggaaatactccctgagctcccaaaatgggtttggaaagagctatacatagctttctatacattggtctctatcatcttataggataataaaggagataattcatgcacacaaataactatatgtaatgttacatttagggaaatacaataatttcactgtccttgccttaggatttccatttaagtaggcagagatccctggggacaggaataatctgggttcacaaaagggtgacacctggccgggggg

SEQ ID NO: 14077 - DNA, 374 bp, Homo sapiens
tgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaactgcccaccactctctccaccccgccttggtcttccgagggtgacaggtgggacgctgaagagagctgccctcctggtcccggcctccatgtgaacagcctcctcccaaatc

SEQ ID NO: 14078 - DNA, 370 bp, Homo sapiens
ctggggccactgcaaacagcaaaatcaccaaaaagagcacaaaaacgcaaaccccgaggctctcgctagacagtaatgagggcgtggtccacctaggaggggaaacggggaggcggagcgtggcctgggctcagggaacgcacgtccatgactctaatttcttgtctctctctgcgtgtccaaggataagagggaaagtaccccaggcattgatttggggttcacaaatacacacctagccggcgaattcgcaaatacggactccgtgaatgacaaaggggactacagtacaaacccagcctgtccctcgcgcccctagtgtgctgagggcctggccgtggcaggaaggaaaaggaccgctcagacccct

SEQ ID NO: 14079 - DNA, 396 bp, Homo sapiens
cgttgctgtcggggagatggagctgttttactcagtgtgtgagtgtgtgtgcgcgtgcatgtgtgtgtgtgtgtgtgtgtgtgtgtgtgtgtctgtctgtctgtctctctcctcctggacccagggcacccaagggcagggataggcgcagtggtcatatgaagcagcgccagagaggggacctcccagctcttatttgcaccctccccacctcaccaactttggtccctctctgggggcatgaatggttaacacacaccagagcagtactccaatattggagagtctctgggggcacagggctttgaatcaggggagtatcctgccttccctcccctgaccccacatggtctcagggcccccttagggccccctacccactgatagctttctcct

SEQ ID NO: 14080 - DNA, 404 bp, Homo sapiens
  misc_feature 396: n = A,T,C or G
cgttgctgtcgctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcanagctggag

SEQ ID NO: 14081 - DNA, 401 bp, Homo sapiens
cgttgctgtcggaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcc

SEQ ID NO: 14082 - DNA, 372 bp, Homo sapiens
cagaaagcttcattaaaaccagtaaagacatcaagacaatgtaactactgattattacatgaagctaatctgaagtacaatcttagatacaaaataagacatagaagtaatgagtgcagaaggagtaaacagtgaacgtaggtgggggttgctaggtaacaaatatcaatactgactaatactggcatggtttatgtgtagttaaaaattttaagttaactatgttcataatcacccaaaccactggaaggggggaaaaaggaaaattagaaaacttcatctattcaacggacatggaaaatggaattttaaaaaatttcaaaattctggttaatgcaaactaggatgctaaatagaagcccccaattatct

SEQ ID NO: 14083 - DNA, 367 bp, Homo sapiens
agttcccaaacctaggcctcagtcctatccttcaaaaaaacaagccgaactttgttttctgtttgccaaggaaagggattagtgtgtctgcaccaagaaaagtaattcttttccatacaaaaaaggataggtactatattccaatcaaggtaacaaaccagtgggctaaaaaagaattgccttttaattgtgaaaacatttcctgatcttttaaaaaaagaaatctacgggaagtataaaggcaatcaggtaataaactcattgaaaatcagttatagtattagcaaaagtttacagtggttggctttgtcacatagtcatagtttgtgggagaatcttgaccttatttgatgctgtaaatacttgg

SEQ ID NO: 14084 - DNA, 404 bp, Homo sapiens
cgttgctgtcggggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtggtgcctttgactccgggggtggaaaagcgaccccacattcaaggacgccaatggcatgttgagctttcccaatctaaaccaggtgcgtggagggaagcaagtgcttactcccagcttgaaccctgagcagcgggtctctaactttagagcg

SEQ ID NO: 14085 - DNA, 396 bp, Homo sapiens
  misc_feature 262: n = A,T,C or G
cgttgctgtcgccgggatgggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtggngcctttgactccgggggtggaaaagcgaccccacattcaaggacgccaatggcatgttgagctttcccaatctaaaccaggtgcgtggagggaagcaagtgcttactcccagcttgaaccctgagcagcggttg

SEQ ID NO: 14086 - DNA, 399 bp, Homo sapiens
gagcatattatcaaggtcaaaggcagcgtgataagtacctgacaattctgaaagctgttaaagtgcttcaggccagttttagaggagtaagagttagacggactcttataaagaagcagactgcagcgacactcatttagtcaaactacagaagatacagacagcaaacatactttaataagttaaagaaaataacaaaaacagtacagcacagatactgggcaatgaaagaaagaaacatacaatttcaaaggtataacaaactgaggcattctgtaatatacattcaggctatttttaggggagagaaagctagaagacatttaaaaatgatgcatatagccgcaactctcattcagaggagatttagaactctaatgatgagaagaagattcctcg

SEQ ID NO: 14087 - DNA, 400 bp, Homo sapiens
ggcacgagggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggat

SEQ ID NO: 14088 - DNA, 404 bp, Homo sapiens
ggcacgaggttcgatgtgacggagcgctttgtcctccacagacaccagacaggccggacctgccacaagtgtgggacccagctgcgggacaccattgtgcactttggggagagggggacgttggggcagcctctgaactgggaagcggcgaccgaggctgccagcagagcagacaccatcctgtgtctagggtccagcctgaaggttctaaagaagtacccacgcctctggtgcatgaccaagccccctagccggcggccgaagctttacatcgcgaacctgcagtggaccccgaaggatgactgggctgccctgaagctacatgggaagtgtgatgacggcatgcggctcctcatggccgagctgggcttggagatccccgcctatagcagggggcaggatcc

SEQ ID NO: 14089 - DNA, 400 bp, Homo sapiens
ggcacgaggcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttg

SEQ ID NO: 14090 - DNA, 398 bp, Homo sapiens
ggcacgaggcatggctttccctgagccttagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacaggtatcctgtccggctctattg

SEQ ID NO: 14091 - DNA, 403 bp, Homo sapiens
ggcacgaggagccatgcgagcagctcgttcccttggagaaagaactgtgacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgtggtgcaactactgtatcgagcttcttgttttaaggttaccaaaagagatgaagactcttccctaatgcagctgaaggaggaatttcggagttatgaagcattacgcagagaacatgaa

SEQ ID NO: 14092 - DNA, 396 bp, Homo sapiens
cgttgctgtcggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctatag

SEQ ID NO: 14093 - DNA, 403 bp, Homo sapiens
cgttgctgtcgcgagaaggaaccgcccaagccatatcaagtcgagtcccggccgctcaccatgttccgggacattggccagcaactgcaggccacctgtacctccctggggtccagcattcaaggcctccccaccaatgtgaaggaccaggtgcatcatgcccgccgccaggtggaggacctccaggccacgttttccagcattcactccttccaagacctgtccagcagcatgctggcccatagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcg

SEQ ID NO: 14094 - DNA, 393 bp, Homo sapiens
cgttgctggcggtaaaatatcattttatctcatactgttagtaggagcttcttaactactacccattcttaactttaagaagcatagaatttaaaatatagaacgaccgcttgtatggcctggatctgggcacttaaccttactaagtttatctcgtgtaaactgaccttgctaactcacgtgaggcttaaataatacaatgtggaagacttcagggcacatttttggttttttggtttttgtttgtttcttgagacggtgtctcactctgtcgcccaggctggagtccagatgcacaatctcggctcactgcagcctcctcatcctgggttcaagcagttctgccttagcctccggagcagctggaattaggtcgcccaccaccacgcccgg

SEQ ID NO: 14095 - DNA, 229 bp, Homo sapiens
atgtcctctccacatgaagaatcaatctgaattcttcaccactgatgttttccatctctaacttgaagttacaaactaactttagcaggaatacttatggcttacttcggagcatctgttacaaggcaagaactatcatgtatgtttgctacattcatatttaatttctatttttcttcgagctggccactcgatttgctgttcagggtatgttccctctttcttgtct

SEQ ID NO: 14096 - DNA, 368 bp, Homo sapiens
aatataagtgacaagtacacacacacacacacacacacacacacacacacacacacacacaaaacacagaaattactgcatcatgagggtggaaaatcaattttgtccatagaggtcatcacaaatattcataatttttatagggcttaacagtgagtcctaacgtcaaatattcctgaatgctaatcctaaaactctctaatttatagacttttcttactcttaaccaatcagcgcgccatcatatctacatgatttttacaaagtgtttttaactaattctattcccaaaaagtatctgtgtacctgttgttctgggaagcatcaggagaggaagaaattaagggctatgccactgataacagttt

SEQ ID NO: 14097 - DNA, 225 bp, Homo sapiens
atgtacacataactgtcattgtttgcagacaacaggctaattcagtagaaaatccatgcaaattaactaaaaaccctttaggacaatagaattaataaagtggaagattaaaagattaacaaagaaaaataattgcttccctgtactgggaataactaattagtaaatgtaatagacaaagatcttatgctatcactttttcaatgttatttattttgtacctct

SEQ ID NO: 14098 - DNA, 362 bp, Homo sapiens
tgtagtggtttagagtatacactgaattaatgagctattgggccacggggagctgaaagcttatatatgtgtggagacactgttctgctttcaatctcatcatccttatctccaacatatgtatgtatattgaaataccaaccaagtagtgtattttgctagagcttatggttctcataattaatgataagactgtcagccgggcgtggtggctcacacctgtaatcccagcactttttgagtccgaggcaggcggatcccttgaggtcaggagttcaagaccagcctggccaacgtagtgaaaccccacatctactaaaaatacaaaaattagctgggtgtggtggcacacgcctgtaatc

SEQ ID NO: 14099 - DNA, 364 bp, Homo sapiens
atatgactataaaatctatcttcatctgtagggaaggtaatgaattaccataaatgccttcataatccagtctctctccctcccctcttttctaataaaaatgcagagagaacactgtgaagctcaagctgcctctaaagaaagtagagatttacagaacataacctcacaagatttgttgatgaattatgaaggaaggacatttattttgagaatcatgagcattataatatttattgaggattagaaatttgttatgaggaggtgcttctacctcctcatgagccacttatgcacttaatgcccactggaagaacatgattaattcggcaaaatccaactctcatgaatatccccctgttgt

SEQ ID NO: 14100 - DNA, 362 bp, Homo sapiens
  misc_feature 362: n = A,T,C or G
cttcctcagttcgggaggtttaatgatagatggagaattctgaaagttaggagctacaactatttgaaataaaactctagttacatagttgaaccgttcaaggtaggttgtttaaaagcagtttgttcacaaacaggtatatacacagtagagaaaatttgttattttagcaaacgcttatttagctcatgctgatttaatgagggttgctttcatgatacttaatagttataagaacattttttacgattctatagttaaacatttgttttgcataccttgttaaactccgtctctccgtatagcatatactacttgtttgacaggagattcacaaatgcatccaatccaaagaacagaan

SEQ ID NO: 14101 - DNA, 362 bp, Homo sapiens
  misc_feature 316: n = A,T,C or G
taactacattttacagaagatgaaaccagagctcaaggtcatgttttagtaaagtgaaggttgtggaattcagaaccagatttatctgactccaaggtccaagctttttaccctctaccatccacccagatgtatttcctgactcattcaggagtttaactttaattgtgatagtaatattctcccatcagctaagtgaaccagcttggaaataagtgtattaatgaatttcttcactaaaatttaaaaatgcctttgtatttatgcatagctaactcctgagtttccattattgataataattaagaaactggtngtatatgaaaatggtgttgtagcatacatttggcttcattatcttc

SEQ ID NO: 14102 - DNA, 362 bp, Homo sapiens
ctatcttagaacaagttagatagtatatgtacttgtaataacttgtgactagatatgttagttttgtctattaatttttctgttaaaaagaatatgcattgaaatgagatggaaaacaaaatgaaaagtgtttaaaaaattaaatattttagaaggatcaatatcctaagggttgtgggtaattttttcctactttctaaaacttcagattcctttcactcacttaaggttgtactaccattaatgcaatgttttctgggagtgcaagatttgcaaatgaattaataacagctagaagcctcactatttgcacttttataacattctttgctgttatcattacaaggtaaaattatatagta

SEQ ID NO: 14103 - DNA, 394 bp, Homo sapiens
cgttgctgtcgaaaaaaaccccacaaaaccttgtgggtgtctgagacaagaacatttcaggcaggaataacagtaagtccgaaggccccaaggtaggaactgcatgcatgatgccgtggagaacagtcaagaggtcattatagctggagtaaagtgagtgaaagagaatggtaagaaataaggttggagagaccgggtgcggtgggctcatgcctgtagtcccagcactttgggaggccgagatggatggatcacctgaggtcaggagttcaggaccagcctggccaacatggtgaaaccctgtctctgcaaagaatacggaaattagccaggtgtggtggcaggtgcctgtggtcccagctgcttgggaggctgaggcaggagagccgcttgg

SEQ ID NO: 14104 - DNA, 367 bp, Homo sapiens
cggaggctacggagcagccgggattcagaatactactacagagccagtctgagaggacactgctgcctccacctccgaacatgtatctggatgctccagcttgctctactgtcatctgggacactgaacactaggcaccggtgccacagtgctaccacatctgcccctgtgcacttcatactggtggtgcagctgtcttaactgcttctgctgaccaacaaaatgcattctccgtggctcctgcttcttcactgtgagaggtctcattgtctaacatccttgggaggatggactttaaattcatcccctaccaatgtactctatcctaactgtatgggaggcggtgaaatacctaatcgcattttct

SEQ ID NO: 14105 - DNA, 371 bp, Homo sapiens
  misc_feature 371: n = A,T,C or G
acagaaggggggcctctgccacactggatctcctcctcattctcgatcctgcccaaatgccatttctcagagagtggactctggtcccgggctgccttgattcaacagctgggcatgttacttacttttcctgtgtccctgtttcacctgtaaaatgtccgtaataacggtgcctacctcttatggttggcacaaggcttatgtaaaacaatcgacacagtgactggcacagtgtgcaaaggccatatatgattattacttaacgtgtccaattttcattttgtgtctatccctcagccctatctgacataatttagtcccgctttttgtgggactcctcaaccccccaaggctaggtatggccaggtacn

SEQ ID NO: 14106 - DNA, 392 bp, Homo sapiens
  misc_feature 358, 392: n = A,T,C or G
cgttgctgtcgggcaaggaaccactctaagctcttcagtcactctaatccagaaactgtgtctttatggctcaggcaaccagttcatggcagcctagaatgacagggaaaaagctgggaagggaccttagaaaatcactcttgcccaatactccagccaaagtggtcttttaaaaaccaagttcaggctgggcgcggtggctcatgcctgtaatctcagcactttgggaggccgaggtgggtggatcatcaggtcgggagttcaagaccagcctggctaaggtggtggaaaccccgtctctgctaaaaatacaaaaattagccgggtgtggtgcacgcctgtaatcccagctactcangaggctgaggcagaagaatcgcttgaacctgggn

SEQ ID NO: 14107 - DNA, 307 bp, Homo sapiens
cacctgtaataattgtgtggctattccgaatatgcaaagttgaataaaaatgcaaaactctacatgaatactcaattggattattctccagctggttgagaatacttacgtagtacttgcaggtattaattgatttaattcttataacacattttttaaagggtacaaacaggcattggaaaaaattttaaatacagatttaatacctgactcggaagaaaggtataataaggatggaggatatttgccttcccgacattttggagctcaatttttttttcttagcaaaagaaatgggtggacttcg

SEQ ID NO: 14108 - DNA, 361 bp, Homo sapiens
aaaagtaagatggagcacttgtcttcatggaagtaaattcatgataatcttgtttaagtatcctattcagtaattatgtattgttaggtagacattatttcacaggactattagagcatattgaacttagaaactttgaaagctctttggatgctagctggtacagaatgcccatctgctctatgattactgtgagaattgtgttaaaactcctggcttcttgttaatttccaagtatagtgcaatatgtggatttcaatatataaagatgaagaacctagatgttttgagcttttcatgtcagaggtagtctcagagttgactcatagttggccaggtcatcttcagctctcttgcttag

SEQ ID NO: 14109 - DNA, 392 bp, Homo sapiens
cgttgctgtcgtttgcatttaaacaagttggagttcgtaagggtgaattacttgaaatgtactaatagatagtagagaatatttacaacacatttttaaaaatatgacccataataataggtggcatttaagaaatataagcatggtatctatcttacatgcatattaggagtggacagttttctatgattagaagcacacagttgtcgagcaagggttctaatttttgtacgtgttgtgggaaagaaagataatacagggtgtcattgcaaagatatttaactactctagataatttaggcctacactactctaataaattgggttttccaaattattgatacaccttgagaactagtgcctgggtaggcctggagaaatgactccaggag

SEQ ID NO: 14110 - DNA, 391 bp, Homo sapiens
ggcacgaggcagcagctggggaggagccaaagcctcggcgctcacctaagccgcagggagatacacccaactgggagatgaggaaacagcaacccagagaggagaactaacccacacaggatcatttcgcgaaggagcaaggctgaagaaccagacctggactttcttaggcaagtaaattctgattatatcacggagacttgctttgagaaatctgccccttttcactgtgagatggcgtcattaacacatctagttctctcctaagcagccagcaaacatttattatacactagatattatattggcatttgagatgatacaaaggaataaaatggggcaattagctctagtaatttggaggtctcaacttacggatattccaagttcc

SEQ ID NO: 14111 - DNA, 389 bp, Homo sapiens
  misc_feature 389: n = A,T,C or G
cgttgctgtcgcttcagagatgttctgtccaagggctagtttgcacggaggagagcaggaatgcagggccagggcacggccacccagagcctcatgctgttcaaagcggctgagtgagtgctttagaccacacaaggcaggtcgagaggcacagtgcatgcttgggaggatggcacggggcagtgggtgaggatggcccaggtggctggggtcaagtgtccctaccagcccagcctctcccatatcatcatgggacatgaatgtgagggtgtggtgatggtggcagtgtgaggtttaagaaatacatctagaaggccaggtgtggtggctcacgcctgcaatcccagcactctgggaggctgaggtgagtggatcacgaggtcaggagn

SEQ ID NO: 14112 - DNA, 227 bp, Homo sapiens
gagcacctctgtgttcctaggtctgtgcagtgacttgggagtacagtgatgaatgggaccatatggtcccaccctcatgggcagtctctaattcctgccttatgaactgaagatctatttcttggcctgactttatattcttcatggttaaaagttttggggcctctgaagtgtgcatttgaactcaggcatggccttctggggctgtttatgccctatcaccctga

SEQ ID NO: 14113 - DNA, 361 bp, Homo sapiens
  misc_feature 306: n = A,T,C or G
aaattagataataaagtgcttttagtaacatgcctggcacagttcattgattcaaacattgaaaaaaaatttttttaattatcatagtagtgtgtacctttggaaaaattataacttaacagataaggctaagtttgagccttccagacctttccttctctgcatactcttcaggggtaactgggatcatgttctgggagcatgtcattccaagactgtttctttgcttttataaacacatctgtttccatagaaatgctgtagtggttgcagagggggcggtgcgtggtatcatcctggatttgntattctgcgcttttttgcttgacctaccttggatggctctctagtcgatacagct

SEQ ID NO: 14114 - DNA, 363 bp, Homo sapiens
cggggttcaagctggactcgccacgactagattgcaggggactaaccgcttaaattgcgcaactggtgatgctcttgctgtatttggagacatgataaacgagtatatgctgcatagacccgacaactgcattcattgtatgtgtcaggttcaccgggaggtgacagatgctacacttgcatttattgaatgagcttattggatatcttgggtgcaagcaggaagcaacctgctgacctgagctccctgtggccctggtcctctccactctgaaaacatccaggcagatcttacaactcctccagtcacacccagataccaactctaggccagaccaatgcaatctcttggcttgaattcaac

SEQ ID NO: 14115 - DNA, 388 bp, Homo sapiens
ggcacgagattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccga

SEQ ID NO: 14116 - DNA, 365 bp, Homo sapiens
cttgggaggctgaggcatgagaattgcttgaacccaggagacagaggttgcagtgagccatgatcccaccaccacactccagcctgggtgacagattgagactctgtctcaaaagagttattaccacaacaatagactataaaatctgtagtcttaatttgcatatcatggtagacaggaaaatacctttagcatcttaataaaagatgaatcaaactctctaataaataccctagaaaagacaaacaatacactaaatataagattaaagagtagtttctaatacatcattctaagacaaaatgagggaaaaaaccccatttcaaatttaagtcaaaagaaagggtgaaacataaaggagtctg

SEQ ID NO: 14117 - DNA, 391 bp, Homo sapiens
tctacccaagtgaattataattaactgcgtcacatttatcattatactgacctttgagcatttcccccaactcacagtattttgtttctcagatatgggatattcgcttgctttgtgaaaaacatgaaaatgttagcagagctcagtgctttgcccagcagatggcatttgtgtgagtttttcaggatcctttggaatctgtcacttgccaattacccaatttgttttgaatactctgtatttccagttaatattgcaccatttacataaagagaatgtgccaaaattgctgtaatctgttctgtaatcaaatctgactgctgtagatgtataacttacttttggtaagctggttactgcaaaatggtctcaagacaatccttttctattc

SEQ ID NO: 14118 - DNA, 389 bp, Homo sapiens
  misc_feature 12, 233, 389: n = A,T,C or G
cgttgctgtcgntattttatgccttcaggttttaaaaattataaacatttacattacagtaaaagtcactctggtatacagatctataaagctctgataaatgtgtagagttgtgtaaccaccaatgcaaccaaggtacagaacagtcctcttagcctctccctaccaaatttattcctgctactttgtagacaaaaccagtcccctacacccaaaccctggcagacactggnttttttcttcggtctctattttttttttttaggaaaaaaagattatttttttccccacgctggaagggggccaggggggggatttggaaaaagggcaccctccccctcaggggattaggggtttttctggcttggctccccaagggggtgggaaan

SEQ ID NO: 14119 - DNA, 395 bp, Homo sapiens
  misc_feature 380: n = A,T,C or G
cgttgctgtcgcttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttggnggtggaggtgatagg

SEQ ID NO: 14120 - DNA, 388 bp, Homo sapiens
gacaaagctgcatgcctggtctcaactccctagaatttgaacacacggctcaggggtattgagctgagatcttgagctcaagcaggagaggagccctcactctcagaccacagagaagactgaggtgtgggatcatgggatggcacagcagctgggtataccatgctctggaagaccaatctaggaagggtgtggcctatctgccatcctcagcctctgcctgagggagctccatgccctgcagcacctaacagacaagcaatcggagaacaaaaggcttgggacaaaactagctgggcaagctcagtactgggacagacactggaaggagacctgatcagtcgagcacaagctgggaagtccagacagcaatctctgggaaaaaaac

SEQ ID NO: 14121 - DNA, 367 bp, Homo sapiens
ggcctattcctaatggatagagaagaaagacgacagcgggaacacacaagaagaaaacttactcttcgtagaaaaatagaagaggacatacagcgaatgctgctcatcagcgtcaaaatagttcaaataattttacgaaaaaaaactcagcttctgttgtttatcaggcagatgtaccggataatggtataaatcaaaaggaggtataaatatttcaggccaagggtcaattatttcagcgcaggtatcacccacgagaaatttttccagagcttcacaagcatttttggatacttcacaagaagagaaggagaccaatgctgattgggatggaagaccaacccatagatcaagctatctctgcgag

SEQ ID NO: 14122 - DNA, 259 bp, Homo sapiens
cggaggagctcccaacccccaccgggtgcaccttgcagaacccctccctgagaatccggtcgggattcgcagcctggacccacacgtgctgctccccaaggcaggtccagcgagtgcacaggtgcagatcccttgctgccacctccactggccagtgcttccggagccaggcgtgcccagggctgcacagacgttagcaccacgctgcacctcccatttcacggagaaggaaaccgaggcacaaaggcgaagcttttcc

SEQ ID NO: 14123 - DNA, 393 bp, Homo sapiens
  misc_feature 123: n = A,T,C or G
cgttgctgtcgcggcgggagccgctgctctccggctgagggaatcagagacagctccgtccctagtggagcgcaggggaggcagaagtcatgacaggcgaggtgggttctgaggttcacctanaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaa

SEQ ID NO: 14124 - DNA, 391 bp, Homo sapiens
  misc_feature 391: n = A,T,C or G
cgttgctgtcgaaactcctgagctcaagtgatccactcgccttggactcccaaagtgctgagcttacaggcgtgagccagtgtgcctaacctcgggggttcttgactgaggcatagcccttggctttctgttttcctctgtctcctctccctgaggtggcttgtctggtcttaggattttgcttgtcacttccttgcttacaactccaaaaactctgcctgggcttctccagtggaactacagtcagatggctgaagcatcccggctcttgggtcccatcttgagctgccaggtgcctcaaatatggactggaggagtggctgtcactgtggttcgctcccatgttagatacagggctagtctcagctctgccactccccatgtgtgaccn

SEQ ID NO: 14125 - DNA, 393 bp, Homo sapiens
cgttgctgtcgccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccat

SEQ ID NO: 14126 - DNA, 394 bp, Homo sapiens
cgttgctgtcgccctcctgcttttttttgagcctctcctgaaactgatagatgctgaaaccactgcaggagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggggacggcgactgtggcaccacccacagccgtgcggccagagcaatccaggagtggctgaaggagggcccaccccctgtcagccctgcccagctgctatccaagttggctgttctgcttccggagaaa

SEQ ID NO: 14127 - DNA, 159 bp, Homo sapiens
  misc_feature 11, 14: n = A,T,C or G
tagtggtccanaanatgaaaaaataattgaacaaatagaggatatggtgactacagcttctacgtacctgtttgaagccacagaaaaaagattttttttcaaaaatgtatctatattaatttcctagaattggaaggaaaatcctcagtacaaaaggcc

SEQ ID NO: 14128 - DNA, 393 bp, Homo sapiens
ggcacgagggaacatgggctttgcagcaaaagcgaagaaatctgctcatgaaaacatggatctgaaccaaatatatgatttgatgcaagagatcacagagcaacaggatatcgcccaagaaatctcagaagcattttctcaacgggttggctttggtgatgactttgatgaggatgagttgatggcagaacttgaagaattggaacaagaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctacctaaac

SEQ ID NO: 14129 - DNA, 395 bp, Homo sapiens
ggcacgaggcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaa

SEQ ID NO: 14130 - DNA, 392 bp, Homo sapiens
cgttgctgtcgcttgaggaagcccagtacatttcaagttggtcgcggcttgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagag

SEQ ID NO: 14131 - DNA, 388 bp, Homo sapiens
cgttgctgtcggagataaggactgagtgcagaagataagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggctgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttctt

SEQ ID NO: 14132 - DNA, 303 bp, Homo sapiens
gctgctctaccctttaatggatatgtgtgcattgaagatgtctggatgaggagactaattctagaaggcagacgtgcctcaataaattaaggccttccctaagaaacccgagaaatatatagattttgtcttaaatgtttgtgtgagatatttgcttttcaggcacagatatatcaagtttttttttatttctatgtttatattgatatgccttccacatggttaattaaataaaaagaggggaaaaggagaaagaaaaagattcagagcatcatttgttaaaaagaaatgtatcattcaacc

SEQ ID NO: 14133 - DNA, 385 bp, Homo sapiens
cgttgctgtcggaaggtattctccggccttagaaagcccaggattaatgcaggattgcgatatttaaacagaacatttccatacagcatgagtataaatgactttcccaagtttacactgagagtaactgacacagcaaccccagcaaagtctgagctgagtcctgaataattgtataaaaaggggagagaaacagagtgaagaaagggtttcccagactctgtcccaggaaagaaaatgagctcgtggagaggaatagactttctctatgaaaacagagggaacaaagaggaagatgtctgggaaccgaggagtaatagagacctgagtttacatcactactctgccactccctaggtacctccctttacctgtttccctactg

SEQ ID NO: 14134 - DNA, 357 bp, Homo sapiens
gagacagagagattagacattgcaatgaacaaactggttttgaccattaattacattccctggatacttgctcaattcaccacacatttttttttttctgaatcaacatgaaaaagactggcttagtctgcatttaaagcatttcgtacattacaatgatcacatgctacaggatttgtaagtgctcaaggatgtgttcacagctagggaagtaaagccgacataaagaaatgaaatccagtttctgtcttcaagacacttacattcttgcataaagtcaagaaaatactattaggaaaacaatactttatattgggtgccttctttatctggaggatggcaaacaaccaaatcatg

SEQ ID NO: 14135 - DNA, 359 bp, Homo sapiens
caatgagcacaagggaatacattatagttgattttgctcaaacttaatttaaaagcctcattttcctagaactctaattattcagatattcatgacaatatttttttaacagtaagaaactctgagttggcttcttggagctgtaggtcttgaagcagcaacgtctttcaggggctggagacagaaacccattctgcaatctcagtagttttttcgaaaggctgagatcatttattgatcgagatatgacttgttactagggtactgaaaaaaatgtctaaggcctttacagaaacatttttagtactgaggatgagaactttttcaaatacaaaaatatattggcttaaagcatgagg

SEQ ID NO: 14136 - DNA, 142 bp, Homo sapiens
  misc_feature 129: n = A,T,C or G
tcctgcaccaaagaaatgtaaaacaaacccagagagtgacattgagcagctttaaagtgacgttgttttcctttcacctggtgaatttgagaacgcagtggcttttgagactgtcctgccaagtggcangtgaggcatggag

SEQ ID NO: 14137 - DNA, 360 bp, Homo sapiens
  misc_feature 360: n = A,T,C or G
tctcctttagctgctacagactccctgctctcttccctttccagcaaacactgtctgcttcctcttgtcccaccagctcttgaactcactcctttcaggctccatccccaccaccccactgcatccactaatgccaaggccacctccatgtggccacatccaatgaccatctctctgccctcaggtccctggttgaacatgtcagcagcatttgagtagctgacctcctttgctttcaagaaacttttcctgctcttggatctcttcctgtctccctagccagattttcctacttctcccttactgattcctcctaatttcctccatcatgaagcactggagtgtcccagggttcagtcn

SEQ ID NO: 14138 - DNA, 351 bp, Homo sapiens
attctctatagtgtggatatgaatctatccatctatctatatatatttatcttggaccaactatctttttatacagtgtggatgatcagatataccgcacaaatccctggccagtgggagaagttccccttactactttcagggccacttctcagtggaagtccattttcagctggtatcacacataacaaaatggcctattttcagcatgtgccacacagaccaagactggccttttctgtctccattatcaggtcaaaaggaaacacacatgatgccataggagtgagatgaggtgcaattttggtagctgacaatggggcctgggtcacctgcttgcaatgtacttgt

SEQ ID NO: 14139 - DNA, 357 bp, Homo sapiens
gagttccaagtagggaatccttctgagaagtcccacctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtg

SEQ ID NO: 14140 - DNA, 384 bp, Homo sapiens
tacggctgctataatacgacagaagggcacacacacacacctttttttacactgagagaatgagaaaaacattaacttttagttctccgtgggccttattttcttaaaggaggaaatcattacacagtaaagcattaatggccagtgtgtgcttaatttaacaacactacaaattcatgtagagatgtctgatcctctagagaggaaactgtcattccttagctgcagtcccctcttcaactgaagaattacatttcaccactaggtgtccacaggggaacaaaggatatcttacacttgcccattccaagtccctttcacacacactgcactccataaacaacttgtcctaggtcaatttataaaaaccttaaatcttatttt

SEQ ID NO: 14141 - DNA, 358 bp, Homo sapiens
tttgtgggaggaaccacttccactctcagccactcaaggtttatcaggatatactagttgagaagcatgaaaaataaaaactggtaatttcccataaccaaaacaaaaagtgttacaagatacttaaatgatccttggcaatacttttattctatttagtatatgattaggagtttagtagattaaaaaacccaccacataaaagacaactggtatatattctcctcagacatggtaatgtgatgtaagggagtaaaccttgaacttcatttttgtatgggtcataaaatcgcatgagtcatacttgggtagaacacacatgattttcaataacaagtttgtcttccacttcattacc

SEQ ID NO: 14142 - DNA, 330 bp, Homo sapiens
gggagcctgaggaggggcctcacccggcctgaggaaactcactgagaagtggaggccgagtcagagcctgtgaggcaggggagtggggacagtctcagcccaaaaaacaatgctggcgagaggcaggtgcaggggtaaggtcacaaggagggaagcgcagccctttcaaggcaggagagaaggcggcaggagagaaggcaccaggacaagggacagaactagagggagggtaggacctggcatttaggaaccagcatgtggctgggcctgggcgtgaggttaagaagggagagttggccgggcacggtggctcacgcctgtaatcacagc

SEQ ID NO: 14143 - DNA, 355 bp, Homo sapiens
ggtggcatgtacctgtattcccagctacctgggaggctgaggtgggaaaatcacctgagcctgggaggtcaaggctgcagtgagccatgatcacgccactccagcctgggcgacagagtgagaccctgtcttaaaaacaaaaaacaaaaaaaccccaaataagcagaaacaaaaatgcagaagacagaagtctaagaatatattaaaactgtattctaatatagatgttaaattctaaagtcagcagataagtagaaaatctgtaaatataaaactgagtttgaaaacttcaggacttaaagcaggcagtaagaggaagtttggtggagagacgatattgttagaatgtaaacct

SEQ ID NO: 14144 - DNA, 358 bp, Homo sapiens
  misc_feature 174, 235: n = A,T,C or G
gattttaggacttggtgtttctggcatttcataggaaataaataaatcaaagcctacagtaagcaaccttcttaatacatcttggaaggggggaaaaccccaagacccttatttaggatgaatatattaatacaatacaaagcacccaacttctttctgggaatgacttaaganatccatcagcagaaggagacagttgcacttattatgggatttctagggcatgggggcgcanagacaaaaaagagcttggtttactttttcaaaacatgaaatgctgattcccttcttttgctatgctattcaggccttaaagggaaaagcacaaaagggttcttgggcaatgaagaaaaataag

SEQ ID NO: 14145 - DNA, 357 bp, Homo sapiens
  misc_feature 357: n = A,T,C or G
taaactgaaaaatgagtctaaatgcagccactttgctattttagttcttcataagactggaagcaaagcaattttactgaaatgttatcagtgaaactactcactctacaatgaaacatttgtgtttacttttgtggttagatattttgtggttaatatgtgtcaaatctttatccaaacacaaatggtataaagagatgagtaagacagtctgtggctcagggctactttgttgtaaaaacccagcgacaccattctgactgtggtcctactggttattctctatctagcaccaagatctttggaagacatgttaagcaattatcttatcactctactggtcacaatcctccaaan

SEQ ID NO: 14146 - DNA, 326 bp, Homo sapiens
ctcttccactaacacagggaaattccagcccagtcctgaggaacatggtcaggtcgatgggtttaattaattcagtatgcaaatgggccatgaggtttcttaaaagagatgacttaaaagatccttttctaaatgatgaagtccctcagccccacagacaagaatgggccccaaggctgggcgcagtggctcatgcctgtaatcccaacaatttaggaaacggaggcaggaattcaagaccagcctgggcagcagagtgagactctatctctaccaaaaataaaaattagttggccgggcgcggtggctcaagcctgtaatcccaa

SEQ ID NO: 14147 - DNA, 357 bp, Homo sapiens
  misc_feature 217, 357: n = A,T,C or G
attacattttattgagctcttagtatagtcattctactaattatcaagaattgttaatcctttaaataccatatttagtcaatacattagcccccaaaacaagtaaactaaagctaagtgagactaaataatcagaagtcaaaataacttgcccaaggtcatatgtaaccaataagttggccacatcttagagtaagttcttagtcgctaacaaagntcacttagtttttttttgagacacagtctcactctgtcaaccaggctggagtacagaggggcgatctaggctgaatgcaacctccacctcccaggtgaaggagagttttctgcctcagcctccacaataactgggaatan

SEQ ID NO: 14148 - DNA, 360 bp, Homo sapiens
attgttatccgaaagagagaaataactcctgttaatcaagaaaaagacagaaacttcaatgggaaaaaaaggaccaatgaaagagacaaactaccatagatcagatttcttcccatagctaaacagtatacaaagaaacttcatatttataattatacaaatgcaaatcaaggcagtgagtcattactcttatcagaaagactctaatttaaaaggataaacacaacaattattagaaaatgtgcatagtgttaactttcactcacttgtagtgaaaagtagtctggaaatattttatacatcatagagaaattccgagaatcatatacaggtagatgatgataaggattatggtattgg

SEQ ID NO: 14149 - DNA, 225 bp, Homo sapiens
ttccgttcaaattctgactatgtagtattttagcaaacctatgctagtaacattagaaaaaaaataaatttactatccatagactttatgaaggtcatacatgaagaaatgggtgttttagtaagaaacagaaatttcttaagcttctcattagatttctttagattttagttcaaaatagatttgagtgagtttatttctgatgcggtgctttaccctgattac

SEQ ID NO: 14150 - DNA, 353 bp, Homo sapiens
cagataatttttttaaatctattattaacatgttcaataaaaagatgaaaagatggagaattttattagagaaatggaatatctaaaaatgaattacttgaagagttgctaaatgaaatgcagaataactgtaagtgaaaacacagttggtgtaacagcggattagccaaagcagaaaacaggtttgctggaaataaccatattaaaacatgaagaccagaaagaattgcaaatgcacaaaacagcattagaccacagggagcatgattttataaaggtctaggccgggcgcggtggctcacgcatgtaatcccagcactttgggaggccgaggcgggcagatcacgaggtca

SEQ ID NO: 14151 - DNA, 360 bp, Homo sapiens
gttagaagggtcatacaaggctttatagaaaggatttttaagatgagcttctatatatcaattaaaagaacatttcagtagaaacatgggcgtatggtatgataattaccagaagacaaatgcaaataagtgctgaacacaggaaaaaaataatcaacctctccaataatcagaaaaattgaagttaatcatcattaactgttgggggagtagctaccaaatttgataaaaactcaaaaattcgtaataattcagaaattgagaatagcggccgggcgtggtggctcacacctgtaattctagcactttgggaggctgaggcgggcagattacgtgaactcaaaagttcgagaccaaccg

SEQ ID NO: 14152 - DNA, 385 bp, Homo sapiens
cgttgctgtcgggcaccgagcctattctgtcgcgttgttcttatatacatacacggatgacgaccatgaggacagtgggcatcaaacattttggattatgcgttattaatcccttatatcactaaaatgcaacactgctgtggatgctatccttaatatatactgacttatagatgcagcccactcgaagttttgtgccagccttcttacctatattagacaacgacttcaacagcgcggttgctaatgccacgcaaccaccatgtgttatgttagcctgcttggatcaattgtaattattactggaattgaattaattaatatgattttgaacagatcatgttcaaactaacatcctgtaaagtagacactgtaaggagttact

SEQ ID NO: 14153 - DNA, 383 bp, Homo sapiens
  misc_feature 383: n = A,T,C or G
tacggttgcgagaatacgacagaagggatgtcaatgcaaagcccagggctggaagccaagcgtgggcggcctctgttcgccatcggggtgaagcctcctgtgttcgttcactgccgtcggggtgaacgccatatgggcaggtgactgggtgctctcgaacctccccgccaagcccaaaaagccacataattaaatgcaatgtcggggccgggcacggtggctcacacctgtgatcccagcgctttgggaggatcacctgaggtcaggagttcaagaccagcctgggcaacatggtggaaccccgtctctacttaaaatacaaaaattagctgggcgtggtggctcacatctgtaatcccagcactttgggaggccgaggtggn

SEQ ID NO: 14154 - DNA, 357 bp, Homo sapiens
attccccagcaagatagagataatagcttccacttgccttctcaaaacacacaaataacattcagtatgtgacagtattattaaacccattatggtccaatataatgacacattaacgtacctatttctcaggcagattatgggatatttggagcatggaactaagtactaatcatattttggggtttctctgtattctccccaacacttgagttggcacataagatgtgttacatagacatttgttacgtgaatgatttgatccttaactaggggtgggacacaaaatattccaataaagattatcgcaaaattctcttaattcagtgctgatttcctcttcagatggcattgtta

SEQ ID NO: 14155 - DNA, 356 bp, Homo sapiens
aaattatagacaagcacaaagaaaatagatatcgcctttaattccaccacacagagataatctctgttaatatttcagtatgttgttggtaatcaatatcccatcttttgtgcatatgcagattcttattttgtaaacatgagacactattatgctttctgtgttgtaacctcctttttcacttaatatatcatgaactattttccaggttattaaatatgtgacaaaaatgtctttgattcctttataattttctgtcacatactataaagctcctctgtgattttgcaataaattaacttgttttgtcactatacagacgtaagctttttaaaaaaaaatcaactcctaatatg

SEQ ID NO: 14156 - DNA, 357 bp, Homo sapiens
cataataggtgctcagtatttattgaaggaaggaatgggaaaaggaaaattcattctgcaagaacagtagaatcctactttggccccaccttattttatttgtcacttgacctcagttatcacatctttctgaccttgggttgctgttaggtttattgttaaaacatacactaaatagtttatattttaacttgtaattgttgtctagctctggacaattggagggccgggggggtgctctcctatttagagaacacgggaatacgccgggcgcgttggctcacgcctgtaatcccagcactttgggaggccgaggcgggcggatcacgaggtcaggagatcgagaccatcccggct

SEQ ID NO: 14157 - DNA, 357 bp, Homo sapiens
aggagaatcacttgaacccgggaggtggaggctgcagtgagctgagatcgtgccactgcactccagcctgggcaacagagcaggactccgtctcaaataataataataaaacgtatatcactaataacaaatagatgagatttaatctctttagatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctatgctgggcgtggtggctcacacctgtg

SEQ ID NO: 14158 - DNA, 357 bp, Homo sapiens
  misc_feature 357: n = A,T,C or G
ggggtttcaccatgctggccagggtagtctcaaacttctgacctcaagtgatccacccgcctcagcctcccaacgtgctgggattacaggcatgagccaccacgcccagcccctccctctattttatagacatggaaacagaggcatgggggaagttaagtgattttggatacactgctaaaaaccagtgtatctcaaatgcagtggaaacatggccttgcctcacaggattaggactaaatgaagtgaaggatgtaaagaggctagctcaggcccagcacatattaggcactcaagaagggcaggtcctccctccttctggcataggggaatgaaagatgaggtgaggcagggacn

SEQ ID NO: 14159 - DNA, 326 bp, Homo sapiens
  misc_feature 206: n = A,T,C or G
ctgggaatacaactgttccagcaaaagggcccctgtcttgggaaggcccaggctgaggaggggaggatggcccgaccttatgggacatagtcagagactatgctttcaagcctccatggcctcccttgcacggcagagaagtgggtatagaaagtatggtcagggagcccagtggagacggagctggccagccaggaaggacctangtattctgggcaggagggtgagaagggctccctcctccaggcctgcccaggccgcctcctgctccaagctccgctagctgccccgggctccgctagctgccctgttccccgcaccaccac

SEQ ID NO: 14160 - DNA, 360 bp, Homo sapiens
atagatgagatttaatctctttagatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctaggctgggcgtggtggctcacacctgtaattccaacactttggggggccaaagggggtggatcacctgaggtcaggagtttgagatcagcctgggcaacacagtgaaaccctgtctctacaaaaaatacaaatattagccacgtgtggtgacacacgcctg

SEQ ID NO: 14161 - DNA, 384 bp, Homo sapiens
tacgctgttatattacaacacaaggggaactggctttctttgattagataactccatgccatatctaatttttaaatgccttgcatccacacttatcacaccaaaatactttaacattctttaagtcttaattcttatctcctcaaggttttgcgggaaagagggacaggaataacctttcacctttgtctctgatgacagtcagcgcaaaactactttatcatcccagcagggaaggccaatacattcccagcaagtataatttctaccagaacaactcatgaaatgtggtaagaaatagtgtgcgggcgacttaagataatactttttaaaaaaaaatagagaacacagttttaaaaatctttctttttaaaacgagatctg

SEQ ID NO: 14162 - DNA, 355 bp, Homo sapiens
attcctaccaagtgacaaaaaaatctcaagagagttatcaagagagggaaaaagagagaaaacactaatcagcagtgaaccaattcctctcatatgtatgtaaatagataaatcagtgtataatgttaaataatgatgcagcaattaaaaaatttaaaaatagtctgggaccaaaagaagtaggggattttgtcaaattcaataaattgaggtaggaaaaggaataaaaaagtaaaaaccttttccaaaggtaatttagagtgaagcagtaaagatattttacaagtttcatcttttgggcctgagggaaggcacatttgtggaggagaaatggtggcttgtgttgtttcatgta

SEQ ID NO: 14163 - DNA, 358 bp, Homo sapiens
tagaagcatttgtgccttgaaataaatctctctttggggaatgagttatatatacatccgtgtggggggacctatgcacacatactcacacgcgcatatatattatgcattacagacaaaatacatgggcaaatccccaagcaggcagccccgagcttctgggagggaaggtgatccgcctgttagcttcaaaggacatttaaagaatagtgggaaggccatgcgcggtcgttttttttgacctgggcccatttgtgagcgcgaagcgtgatttattcttcttacgtatgaggtggtcttcgcaccttggggccaaccgtcttatgtttctgccgtttcgctttcccgtgtatcttcg

SEQ ID NO: 14164 - DNA, 355 bp, Homo sapiens
ggtgcacattattgaactcctactgtatactaggatgaacaggagccagtccttgcctttgggaggcccaggaggtgatgaggaggacagacgagaaacatgtatttttttttaaccttaaaatcttttatcacttcaacatgtagatttcaacattaaaagcgtccctgctgggcaacaagcagagtgcacaggttcctggcagggctaagttcttggcgcatagcctacagggttgtaggtcagaggctgctgggagtcagcaagcacttgtaattcgcagtgcctcccctgcccactcagggaggtgatgctggctggctttagggacccttcaggtggggcagaacccagg

SEQ ID NO: 14165 - DNA, 331 bp, Homo sapiens
gacatgatgaaggcaggggcccaagggaggaggctgtgaggctgtgaggctcaagctggagtcttgtttcctgcggtgcctcaaccaggacccctgctcctctcctccggctccagcacaacgaagcctccttcattaagtaaacagttccttaatgaataaaggaaatgggataaggaaaaagaaacaagaagaaaaacagacagaggtgcttttgccaggcatttagactgattttcccgtttaattctcccaacctccagaaatgaaggttattccagtctttgtcagagaggtggagcatcttgctgcagatcccacagcttgaaaa

SEQ ID NO: 14166 - DNA, 381 bp, Homo sapiens
cgttgctgtcgggacaaccttcatttaaaggcactttggcctttggccagagttcagcgggccacactcaggctggatgggctgcagggctgcaaatttgaaacagcaacaggtgctgacaggccgagcagctggggagagactggcacaaaggagtgcacatgccctggcccaaaggcgcacccacctcccagctacaggggactgtggaccctaagttaagggcgcctttaaatattcattctcggacctcattttggattcattattttatattcatttccttaaccagggcctcacaaatggtatcagtttaggccctagaaagcctgggccctggggctgggcgcggtggctcatgcctgtggtcccagcactttg

SEQ ID NO: 14167 - DNA, 353 bp, Homo sapiens
tgggagagagccatggtagaagtggatctttcagccccgtcaagtctttacatgactgcatccctggtcaacatcttgacagcaacctcaaagaccttgagcctgaaccacctagccaagttactctacaattcctaaaccacaaaaacgatgagatagtaaatgtttactgctttaagttgctaattttggggataatgtgttacacaacaataaataatacattaacctgttatggggttgaattgtctccccaaaatgtgtggtgaattcctatacccaagtacctcagaatgtgaccttatttggaaataggatcgatgcacatgcaatgatttaagatgcagtcatag

SEQ ID NO: 14168 - DNA, 359 bp, Homo sapiens
caggcccacaggcacccacccccctgcctgacagttggcctaaagtcagcccaccccaccagagagagctgcgtatagcctctggcctgcaagcacctgccccaggattgacaactggtaaggtggcaccaccccaccatagaaggttaccagcagcagctacccacatgtgcctgcccttggccttatagccagccccacctcaccagagagagttgtgcacaactgttggacatttacccaaccctggtttgacagccagcttggagatggccctgcaccacaggaagggatcttgtgcagcaaccaagccatttatgtcttccctggcctgagagcaagcctggaggggaccctac

SEQ ID NO: 14169 - DNA, 327 bp, Homo sapiens
atgactctcttcttttttcactgctggttattatttgtaactcacagggcagaataacagctctagagctcaatttatctggaggagattcagcacacctgcttctctttttccactggcatggctcttggtgcaaatttgtatttatgtaatagttagaaattaaacatcagcaccaacagaaaaatattcaacgccctttattaaacatcaaacaactttgtcaatgggaaaagctgccccaactgttttagatcttacctctcaacattgttgtcaaagtacctttccactctctggtagtgtctttgagagggtttgtctatt

SEQ ID NO: 14170 - DNA, 381 bp, Homo sapiens
cgttgctgtcggagacttcccaggaaggtccagcgccctctcagccttcgtactcagaacaggcgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggggacagaagtcagaatcgattccgatgtgaatgtcgatactgccagagccacaggcccgaatctttctgggatccctgggggg

SEQ ID NO: 14171 - DNA, 351 bp, Homo sapiens
aacacattaaaagccacagttcagggatatcagagctagagaaaaactgtcaaaaagcaaatgcagagagccttgaggttatgtgtggaatacccacgaggaggaagtccttaatcagttatcttgcaaagactcaacagaacctgggcataaacccagacttgagcaaacactaagacaatggctcctgcaagaactgtctcctctcaatatttggagtatgtcagatacagcagtgcctttcagaatgtgcctaacatccctaaagaatttgaatatgccactctttttttctgatttaaaattttcttactgttgcaaattaagaaattaaaaagatgtttaagattt

SEQ ID NO: 14172 - DNA, 273 bp, Homo sapiens
  misc_feature 273: n = A,T,C or G
tatctctaacaccactattaaggtacaccagtgttaaggtacattaataactacacaaaattttatttaaagagaacacttagcagcctatgatagttttcaataaaatgttgcctctctttcggattctcactaacttttgttactattctaaaagtttgaatttgctggggtgtttattctgaggattatttaaccattgttctatttggcataaccctatttaatggtgcttagagctgaattacctacagaaactgtttctggtttaan

SEQ ID NO: 14173 - DNA, 386 bp, Homo sapiens
cgttgctgtcgggtcttgactgtagcccagctcaggctggaactgctccctgtccccaagccagcctccctgtctctcttcaaagagtgtgagtccctttaggtcctggtgtgtggggacacacctccttcctcctctggcccggaggcttcggagcaggagagcctggagaagtgggggcactgtcggggctcctcggtacacagaccacgggacagatgcgtggcctggccctggcatccatgggcaaaggagagactgagacacaccgatgtgtcaccatggcccggtgcccagccttgccccagccccagctgggggcagcacggagtcctcgcacggggaagtcagtgtggggcgtatgaggaccaacagctgggtcctgg

SEQ ID NO: 14174 - DNA, 357 bp, Homo sapiens
ggtgggcagccaggcacccagcctgagccgtgaccagaggtccgagccatagatgcagccttggaatctcagcctgcggcgctggccctggtgccacacttagcatgggggacgccaggctggagcagacgccatcccaaacaggcgctctgcccccggggactttggcaaggctgctgcctacgtgaaatgatggaaaggtctaggctggccccaggtcctttctggcatggcctcaggatcttggcaggaggataacaatgccaggagggggtgggctgagtcatgtgcctcctctcatgggcctggctgcagtggtcaggggcagggtggctcattgtgcgggcaccggtgccc

SEQ ID NO: 14175 - DNA, 358 bp, Homo sapiens
aagcagtcatgtgattctaaattcaccattacacccagtgaccactgagtctggaaacagaatatatatagcaatatccatgtataatatacatttgcctgtgcttctcaacttcgtggccacccttttcatacaaacagaaaagctcaaagttggacaactcttaccttccaacaattcctcaaaatcatccacaaagaactccttcagtggagggcgctttggcctcttcagggtgttcagaaactggtggaatttggaggacactctgctgttcacagggacacctgtcacgggaaggacagaggaacactgaggccaggacacatctgaaaaaatggacacatggggaatggcc

SEQ ID NO: 14176 - DNA, 360 bp, Homo sapiens
agggtggtcagcgatgctggggagatgtaacctcagaaaagcaagattaagttatagctatcccacagggcaccttcatgcaattagaagaaagtgtccctccagaagatgcagccccctccaagggccatgtcttggcaaattcatcagcccttgtataaattataaaaagtcaacttccctgggtagatgcagccccagaggtatatggctttgtgaagagccagatttcagcaccaactggcctacagaactatatgcggtggccctggttgtttttttgttaccagatacatagcaacttatcttgtgtactttgtcggctctctgtagtgaaacatgggatttattcctaattta

SEQ ID NO: 14177 - DNA, 382 bp, Homo sapiens
  misc_feature 382: n = A,T,C or G
cgttgctgtcgggggctgcgggcgctcgctggtggcggacccggaggctgctgcggcgccggggctccgtggcctggattgaatccgatcgggagccatgagcgtggacaaagctgagctatgcgggtctctgctcacctgggtaggtcgtggggcggggctaggggaaggtgagcgcccgctcctcttgcccgggatccctggccctggttcggtcagtctcttggtgctggggctgggaggtgcggggtcgtcgacttgctggaccgttggactctggcccgagcacccgcccccgtcacgtggcaagtctgcgtggaaaggacaggtgaggccccgcccctctgtggttggttcaccgtgggcgaggacacaggtgaan

SEQ ID NO: 14178 - DNA, 381 bp, Homo sapiens
cgttgctgtcgggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagt

SEQ ID NO: 14179 - DNA, 380 bp, Homo sapiens
cgttgctgtcggacaagaatcccacccttggccctgacactggcccttggggccttactgaatcaccgcaagaacaagattcattgtggctttggactcaccatcggctgagccctcctggtccccgccttgcaaacccttccgattgcaactccatctccacctccccctgccacagaggggagacctgagcccccctcccttccctccccccttgtgggtcggtgggggacattagaaaggagggacccccccaccccaacatctgaggaggggattctggaactgaatggggcttcgggagtatgagtaccaggggcttcatgcccagcgggcctggggtcccgggagggattgcacaattgagagtgacgcacgag

SEQ ID NO: 14180 - DNA, 354 bp, Homo sapiens
gaggagagtcactacagacaccaagaatccattcaggcatgtctttaacttctacttcccggtactgcctgccacaattttatcccttagaacccagaacagctgggagcagataaaatcttcttgggttatgagttcccagatgatgctgctggcctgcggactgtactttgtgaacttatgctggagcagatggatcagaaaccccggccagaggatgctcaggacccatcaagcccccgcgaggaaggactcagacccccaaccccaccaaattaaagcaggcaatggagaattatactgaagggattcttcggctgggcaaaaacatgattagatctgcattctaaagaa

SEQ ID NO: 14181 - DNA, 333 bp, Homo sapiens
  misc_feature 333: n = A,T,C or G
cctcatttagtgaacatccaattcagaagaaaaacaacagtgaagacattatgtatttatgcagactacaaatctgatgaaagctatactccaagcaagacctcagtcagagtaggaaataattttcacaaccttcaagaaattcggcaacttgagttggtggaaccaagtggctggattcatgttcccttaactgacaatcataagaagccaactcgtacattcatgatacagaatgctgttctagccaatcaccagaatggaagagacacccatatgagacaaatttaaatatacacaccaggtagaagagagctccattggtaaatttcn

SEQ ID NO: 14182 - DNA, 386 bp, Homo sapiens
cgttgctgtcgcccccacctccccgttctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacgggagcaacagccctcacg

SEQ ID NO: 14183 - DNA, 245 bp, Homo sapiens
acagaaccacttcaactccttctttctctccaagtgtacacaatgtgacagggactgtttctcagaagacatctccttcaggtgaaacagctacctcatccctctgtagtggcacaaacacatccatgatgacatcagagaagataacagtgacaacctccacaggctccactcttggaaacccaggggagacatcatcagtacctgttactggaagtcttatgccagtcacctcagcagcctta

SEQ ID NO: 14184 - DNA, 380 bp, Homo sapiens
  misc_feature 380: n = A,T,C or G
cgttgctgtcgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggan

SEQ ID NO: 14185 - DNA, 164 bp, Homo sapiens
cactgctttgtaagtcttttcttattttttcatatgtacatttgacttttccagctaggctgtaagttccctaagggcagggtgcatattttccatatgttttggcacctatactaggcctgggtatataggaagcaattaataatatttgttaaggctggggg

SEQ ID NO: 14186 - DNA, 344 bp, Homo sapiens
agctgggactacaggcgcccaccaccacgcctggctaatttttttgtgtttttagtagggacggggtttcactgtgttgaccaggatgatctccatcttctgacctcgtgatccacccacctcggcctcccaaagtgctgggattacaggcataaaccataaaccactgtgcccggcctcttttttttttttttattccatggagggacctctctttttaccaaaaattccccccactgttgtcctgttctatttttgtgacactccctgatctcgtgtcgctcgcgttatcccccgccccctgtttttaattttttttgtagactccgcctcacccctccccg

SEQ ID NO: 14187 - DNA, 346 bp, Homo sapiens
  misc_feature 324, 346: n = A,T,C or G
catagaggagtaattgggtaattcctgtgtcttagggaagtctctctggctcccgaggacagcatactagacacagaggaccaagtagtgggctcctagtatccttctggtggccaaagccttcacagtgaaaatagataggaagagccacctcgcctggcccgatatttgtttttaaaaggctgggcatggcttatgcctgtaatggtagcacttcgggaggccgaagtaggaggatcacttgagacaaggagtttgagactagactgggcaacatagtgagagcccatctctacagaaaaattttgtagggccgggcgcggnggctcatgcctgtaatcttagn

SEQ ID NO: 14188 - DNA, 345 bp, Homo sapiens
gacaactgactgaaatttaaaaatacttcccaagtccacatacagacccatgagccgaggaggaagaattataggctcaaagtgtctgagtacaatctctaacaaatcatcagctgaccactaagctatatagatatagatgttacccctgagaaccctggatgaaaaaataacaataactgagcagagacatcagcagccacaaatcacaggaaagaaagtttctaaagggctaaatcatccaagcagacaaaatattaccatcaacaaccagcagggaaaaaaaatcatcataatccagcgtagttaaaatattatttatcgtgtccagtgttcaggtaaaat

SEQ ID NO: 14189 - DNA, 294 bp, Homo sapiens
gctccccacccattcttcactgaacctcctgctccagcctctgcctcctccattttgatgtctagaatcaggggatccaggatcatcaccaaggtcattttcccagacagatgtgctgaggctgtagaaagtgctttttatttggttgggagcttgtgcataaatgcgagaggggctgcacatctgacggactataggtgactcatggctgaaccggaacaggacatcggggagaagccagcagtcagaattcagaaccccaaagaaaatgacttcattgaaattgaactgaag

SEQ ID NO: 14190 - DNA, 375 bp, Homo sapiens
tacggttgctagaattcgacagaaagggctacaaaataatcaaaacaaatcataataaaaacggaagaaaaaaatatttcagcgttccttagactcttacaatgtaattcaaactgagttgtaatttcaatacacttcttctgttaatgaatgtgcagataactggtttaattttccattcaataaatttttcttataaagatgaaggaaggccatgcgtggtggctcacacctgtaatcccagcactttgggaggccgaggcgggtggatcacgaggtcaagagttcgagaccagcctggccaatatggtgaaaccccgtctctactaaaaatacaaaaattagcttggcgtggtggcgtgcgcctgtagtccc

SEQ ID NO: 14191 - DNA, 351 bp, Homo sapiens
cagcacacaaacagtggcttatccaggtccatcatattattacaaaattactattatcactattatgtaataactgtttgcttaaaactattttgctttcaatgtatttgaaacactttgcttatctaacacattaaagctataaagtcatataactttcctctccatttcacaagacagaagataagctcagaagactggacctatgttgaatggtttggctaggatgacagagtcagtatgaggaagatcttggacctaagtcttctctttatgtcactcttttatcactctgcattgtcagttgtacatacacattaaattgagtggtgacaatttgttaggagataa

SEQ ID NO: 14192 - DNA, 322 bp, Homo sapiens
agctatatatatacaacctgcaacaggagggtcgtagaacccagaagcattagtcctggaggacttcctgaaagaggtgagttttggctaagatcctgtcaatgatgctggcatagactataagagaggaggctgggcacagtggctcatgcctgtaatcccagcactttgagaggccaaggcaggcggatcacctgaggtcaggagttcgagaccaggctggccaacatgaggaaacgctatctctactaaaaataaaaaaattagccaggcgtggtggtggacacttataatcccagatactcgggaggctgaggtagga

SEQ ID NO: 14193 - DNA, 349 bp, Homo sapiens
gggacaaagagctacctggcctgtaatgtcgatctttggtgattgagagacccctgcgcccaaagacatccctaaccttcaggatttaatcctcttcagtcaaacgtttccttaaccctatcagcccatgtttttcttttcttggtgaaagctgagcacttcataggctgtttacaggtccttctccacaggaaaatacttcctccaggacaagaaccctgtcttggttccaaactttcccaattataagagtcacctttgcgcttgttaaacctgcttccaggtgcttctcctgagggtttctgattcagctagactggagggggggaactgacgaggtgggtgggtt

SEQ ID NO: 14194 - DNA, 323 bp, Homo sapiens
aagacttcctctaaagtggaactagcccaacctcggtgtacccacctcgaagtctcttttatatgttgagtttctaattattgatgctagtaccataaaatgaggatacaattatcatggcagccatgagtgaaatttttgtagaacaggatttattaatcatctgttttactgttcaaaaatctattagctaggactttctgccatgtgtataagcctgatttgtggaataagagaagtttggaagagtcactatataggaatcttccttttaagagggcatatgtttctaatacagggattttagctgtattattttggtc

SEQ ID NO: 14195 - DNA, 349 bp, Homo sapiens
catcatgtttgccaggctggtctggaactactgacctcagatgatccacctgcctctgcctcccaaagtgctgggattacaggcgtgagccattgcgcccggccttcctgaagtaactcatatctgctttgttttttattcagtgacagctacgttgaaaaaagtagttactttctgatagattccagtattcacaggatttaagcaataaaaaattagcaatattttaattgaatgctgtcattttacaaaataagacattgaggtgcacattatgggctagtttgggggaaaacgggacttaaacaaaataagaagggctggactggtcattgggaataataaaaaa

SEQ ID NO: 14196 - DNA, 293 bp, Homo sapiens
  misc_feature 244, 247, 248, 249, 250, 257, 264: n = A,T,C or G
aaaaaaaaaaaaaaaaaaaaaaaaaaagggggcccgttttttacaaaaacccaaacttgaaaaaaaccttggaggggttggaaaaacccaaacaaaaaaggcgggaaaaaaaacccttaatttgaaaaattgggaagccaatggtttaattggaaccaataaaaaccggaaaaaaacaggtaaaaaccaccattggcttttttttaattttaaaggtcaagggggggggggggagggttttaancannnncaaccanaaaaatngaggttctcattagccgtgattttatttt

SEQ ID NO: 14197 - DNA, 344 bp, Homo sapiens
attatatttttaatttactgtggatgactaacacttattagtattcttttctgctgccacgaacactgaaagcttctttctgtctgggtcttggcaaagtatgaaagtaaataattctttaaaatatacatagtcagtccaagaaaatcgggagacctcaattgagtttggagtcactgatgtacttcacatttaccttagaaaactgatctagagtatcaaagaaattaaaaataattaatttttagaatcacaatgcagtataaatcattcaaccaaactccacactctagatggccattaatttgcaagtgaagtaggtcactgggactcttaatatatag

SEQ ID NO: 14198 - DNA, 346 bp, Homo sapiens
gttgcagtgagccgagatcatgtcactgcactccagcctgggcaacagagcaagacactgtctgcaaaaaaaaagaaagaaaaaaaagaaaacttgtaaaagtaacaaatgcattccactggattgctggtcattgttcaatgctcttataaaccaaagttatctacattccttaaattaacatttggatagaaactgagcaaataaaaggaattactgtcattgtcatcaatttcacattttaaaaaagaaatttgacaattactatattctctatatttttcaagaataatgaatttggagccgggcatggtggctcatgcctgtaatcccaacactttgggag

SEQ ID NO: 14199 - DNA, 291 bp, Homo sapiens
  misc_feature 253, 254, 255, 256, 257, 258, 262, 263, 265, 269: n = A,T,C or G
ccctattcggaaaaaaacccaaactggaaaaaaaccttggggggggtttgtccccccccccccaaaatggggggaaaaaattgctttttttggaaaacccccaatgaaatgggtttaaaaaaaacccttttttggggaaattagaaaggttaccccttattttggcccctttttattttgcaaaaaacaggggggggggggggtgcttttttttttttttttaggtttcgggggggggggggggagttttttnnnnnnaganncnccgngacatttctatctatactattg

SEQ ID NO: 14200 - DNA, 374 bp, Homo sapiens
tacggctgctagaatacgacagaagggtgtcaatggaaacagagcgaaccagtattggtgttgggttagatgaggccctaacaagaagtgtaaaggggtaggctgtcatcatcttaaagacatttggttcttactctgtctccactgaagcttgcgaaggactgatgttggcaaaacaaatctggtcaggcaagcaaggttatatataacaattagaagaggtcaaccagggttttatttcaaaaacaaatatttactgcacacccacatcatgtcagacatggtactaaacagataaaacacataagcagacatggtccctgctcttatagagcttccaggaagcttatgaatttaatcaaagactcaagccc

SEQ ID NO: 14201 - DNA, 347 bp, Homo sapiens
cggggctcactgtgaacgaaccactcatcccaagcgccgtgaagaacactgatatctgagaacctctgtgatgctctggctttatctggtccccttatcatctgaaatgcttatgttacccgctccagttgccttcatactatgtatgcagggcagggtcaacatacgcaaagtcaataaatgtaacccatcacataaacagagccaatgaccaaaaccacatgattatctccatagatgcagaaaaggcctttgataaaattcaacacaacttcatgctaaaaactctcaataaactaggtattgatggaatgcacctcaaaataataagaggtattcatgacaaa

SEQ ID NO: 14202 - DNA, 351 bp, Homo sapiens
  misc_feature 351: n = A,T,C or G
cgggtgcgtctcttgttatcctctgtgaagcgagccagatccaactttgcctttgtgcttatgtgtcagtctctgctctttgatggtcacgcctatattgtgtccagactctgttttatttaatctgtgagttttctttctaaaaacatattctatattcccgttcaagagtggagctaacttcacaggatttgggaaaattctgattattctagcccatacacagaatgcccaggacaaggaagacaccacttctctgaggaattgtgccaagaatacaagtcggtgaagtcagcatgcacatgttgaatgtttacaatgtgccaggtactttcatatactattctattn

SEQ ID NO: 14203 - DNA, 374 bp, Homo sapiens
  misc_feature 280, 320: n = A,T,C or G
tacggctgttagaatacgacagaagggcttagcacaacagagaaaagctttaaacactcttacctttgactggaattacacacacacacacacacacacacatacatacacacacacacatacacacacacacactatggctttcccacaaagccatgatgcatccttaaaaataacacacagctctgaaaagtgaatgtcgggggtgaagagagccctcctacactccttttcctagtgatgacaaggttgtgggggcatggctgactgtgaggagcanaagatgagagggagatatcattttacttctttgcactgcnataataaaaagaacagatataatggaaggaagaggccaggggcagtggcttata

SEQ ID NO: 14204 - DNA, 344 bp, Homo sapiens
tatattaatctagtctatcttagaacaagttaaatagtatatgtacttgtaataacttgtgcctacatatgttagttttgtctattaatttttctgttaaaaagaatatgcattgaaatgagatggaaaacaaaatgaagagtgcttaaaaaattaaatattttagaaggatcaatatcctaagggttgtgggtaattttttcctactttctaaaacttcagattcctttcactcacttaaggttgtactaccattaatgcaatgttttctgggagtgcaagatttgcaaatgaattaataacagctagaagcctcactatttgcacttttataacattctttg

SEQ ID NO: 14205 - DNA, 351 bp, Homo sapiens
tagcagtagtagtagctacctcaaaggactgtagtgaggagtaaagttacatacaaagcacacagaactgcacctagctcagagtatgtataataaaagtattagctaatattactgtagtggaaaactcccttaattcaagtgattgtaccttttttactcaaatacctcctcctcaccctgcatctcctgtggctccatgaaatcaaggccctgcccagaacagtctctgtgccaagacagcttttagctcacccacaccactttatttacagataaattctgacatacagatgtgggtttcaaccttggttcctgtgtcctcaaccaaaagataagcttttcaggggg

SEQ ID NO: 14206 - DNA, 345 bp, Homo sapiens
  misc_feature 184, 185, 187, 203, 205, 206, 207, 213, 215: n = A,T,C or G
ctgtcgcccaggctggagtatagttgcgccatctcagctcactgcaacctccacctcctgggttcaagcaattgtcctgcctcagcctcccaagtagctgggactataggcatgtgccaccatacctggctaattttttttatttttagtagagacaggatttcactatgttggccaggctggnntncaactcctgacctcangnnnatcctntnacccccctccctctctttttttcaccacaatttactctcaccattcccctccttttaaatatacaaaacaaaaatctcaactccccttaaccaatccatttcctttcaattaataaattgccaacaaccc

SEQ ID NO: 14207 - DNA, 273 bp, Homo sapiens
agaagggtttcatatggggatgaggagatgtagtttttatcttttttctgtaagaaattggtggccttcaggttttttcttacttcttaatgtggagtggtcttatcgtggtctttttctctggtcacatatttatactttttgtgtgtgtgtgtgtgtgtgtgtgtgtgtgtgtgtgtgtgtgtgagacaagggtctctctctgttccccaggctggagcgcaggggtgtgatctcatattgtgcaacctctgactcccaggttcagagtgg

SEQ ID NO: 14208 - DNA, 345 bp, Homo sapiens
actgcgcgcggcctagctggaaactttcctgcccagtatatcagtcatatttctcagcctcactagcatcaggatgtggccatgtttctggctaatgggatgtcaacggatatgttcagtgggacttcctagaagcttccttaaagggaagcagacaggccagaggaggtgcctcatgactagaatcccagcactttgggaggctgagctgggaggatcacttgaggccaggagtttgagaccagcctgggcaacatagtaagacaccatctttacaaaatataaattttttcttttttttttttggaaataaagtctcgttttgccccccaggctgaagggcag

SEQ ID NO: 14209 - DNA, 325 bp, Homo sapiens
gcaacatagtgagacctcatctctacaaaaatagtaaaaattaaccagttgtgatggccagtgcctgtagtcccagcgactcaggaggctgaggtggttggattgcttgagcctggaaggtcaaggctgcagtgagccatgattgtgccactgcactgtagcctgggcgacagagtgagaccccgtctcaaaaaataaaaaaaaattgtgttttcaattcattgggagctgaactagcatgccaaatataccttagtaattgttttatcacgataattatgataataaattttgttttacagaggcaacggttcagaatattcct

SEQ ID NO: 14210 - DNA, 352 bp, Homo sapiens
  misc_feature 352: n = A,T,C or G
ataatatctgagcaaaatttcataaaatcaagacacccataagtcaggggaaaagatttctctcctccattaaagaagactataaaagtactacaaaaggttttggtaaacgattccttaggaagagttctttgtttcttttcttctctttcaagtgtacaacaggatggtcagcaagtctaatcctgctgatcgtaaggcctttaatgagacatagggcagcaggtagtctagatttcaaaaggtacatactatttagggcttcatagactcagagtcaaacctagaatttgattgtctaatgtatgagtatctagggtaattcataaaaagtggacaattctcccaggan

SEQ ID NO: 14211 - DNA, 349 bp, Homo sapiens
aggacaataaatgaaaactaggactctcccaggctaactaaaacataacagttagtttacagatagctacataggaattccaagaaaaactcagtttgggttgtcagagaatggtttggaggaaatcaaagggctacaatttataaatgggaaagttacaagtaaatgtagaggcaagaatcctgaaatgaacatgtgaaaatacacctagaaggaatatgttagaatgggaataaatgtggctaacatctaaaactgggctttagaactaaaggagttaagacatttttatagaattcagtcttttggtctccataaaaaatgaggccggccgggtacagtggctcac

SEQ ID NO: 14212 - DNA, 347 bp, Homo sapiens
aactgacttccaagaacaaattgttaaaactttaacagaaaaaccagttaaaggcgctcatcaagagagtccttttcatttggtataaatccaaaactatgaaaataccttttgtattatgtgcatgcagaaaattaagaatttattcaatttgcagaaataaatcagtgatataatggaaacatttaaaattttatctctggaaaataatccaaaatcatctatcaaaaattataggccgggcgcagtggctcacgcctctaatcccagcactttgggaggccgaggtggatggatcacctgaggtcaggagttcgagaccagcctgaccaacgtggagaaacccc

SEQ ID NO: 14213 - DNA, 345 bp, Homo sapiens
aacaatataattacattgtagtgtcttctaaatcccttattatacaataaatcttctgcttccaaatcatttttatatagtatgctattttaatgaaatacttttagagaatcaaagaacactggagctagataggactttaaagattatcgaacaaaaccattcattttaaggtatattggaaacttcatctcacaaaatcacgaaaaaccccaattcagcaagtcaagtttcagttatcctttagataccttctaatggagaaagaacctgcagcagatgacagaaattgtagaatactacctcacatctgaataagaattttaaaaatttccaagcactttt

SEQ ID NO: 14214 - DNA, 352 bp, Homo sapiens
atagatgagaggtaatgtctttacatgggaacaatccaataaagtcctacaataatatagggcaataaattttggagagctttaattactgtgcaagaaaaatattctagttgaaatgaagagtctccttggcctgtttccgcacagcagagcaaaccgtcttctccattcacatttcttggagttaagagcctggcctaggctgggcgtggtggctcacacctgtaattccaacactttggggggccaaagtgggtggatcacctgaagtcaggagtttgatatatcactgggcaatacaatgaaacactgtgtctacaatatattcaagaattatccacgtgtgggtacg

SEQ ID NO: 14215 - DNA, 353 bp, Homo sapiens
cgggtaactcacagggcagactaccagctctagagctcaatttatctggaggagattcaacacacctgcttctctttttccactggcatggctcttggtgcgaatttgtatttatgtaagaggtagaaagtacacatcatcaccaccagaaaaatattcgacgccctttattaaacatcacacaactttgtcaatgggaaaagctgccccaactgttttagatcttacctctcaacattgttgtcaaagtacctttccactctctggtagtgtctttgagagggtttgtctattggacttaaaactacatacacaaaggtaagataaaggttatttacacagccaatcttaga

SEQ ID NO: 14216 - DNA, 347 bp, Homo sapiens
tctgagaattttctataacacaaactccttaacttcctggtgggtaatgttttctgggtgttttttctgttttctgttttttttgttgccatttcttctttagtaaaatgaaaattgcaagtagaaaagaaactaaaaatggatttagtgtgaggacaggttccttttcctggcaggattgtagaacactggtattcagttgactgtttacaatgaatatatcttctggttggtcatggccagaagagaaaatgtcattggtttgtgcccaagcaaattgattattaaaatacgttgaatatgaccccatggttgcaaacatcccttttcttagtaattcttagaga

SEQ ID NO: 14217 - DNA, 345 bp, Homo sapiens
tttggtattgccgttattattgttgttaaactgactaaaatcatacatggaataatagaaatcaggcctaacatcagatagacttttccattcagttaagttattgtgtagcaaaatttattttgtcagttcactacacaatgtgacagtatatagtttctctaatagagtaacattaaagaggacatataatataaccaaaaatttgagttccagataagtttggtgtctcactagcaagatgacgttaaataactcatttaatttttttgaaatcttaattttctgttctgtaaaataaaaagcaatctgtctcttgtccaaaagactatgtaggttttttaa

SEQ ID NO: 14218 - DNA, 348 bp, Homo sapiens
  misc_feature 207, 348: n = A,T,C or G
ggaaacgtggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggntcttattcatatatttttatagcacctttttttggaacctatatttgtgcttgaaggtgtttttgatatttggaaacagtataagccatttggagtcatgattggtgggcaagtggattcaagctaaaatactaagaccan

SEQ ID NO: 14219 - DNA, 318 bp, Homo sapiens
gtcatcaacatcctcattgtcatggcaaattgtgagtttatctttgccagcgtcagatagttcatcaacttccttttagccagattgcaaaaagtcccatgactctatttccaactccaatgccatctgacatgagacaaaatcagagtagattaagatagtggtcttaactgaatgtagataaagtatgctacttgtgcaaatttttcagaaatatatgaccatatgaacatgttgctgaggccttgccaggccttgaaaggggcctgtgcaagtgaggggcacagagattaagttttattagcttctcagagattc

SEQ ID NO: 14220 - DNA, 351 bp, Homo sapiens
  misc_feature 351: n = A,T,C or G
cggggagccactttgacaacgctcctgtgccatgcgtgaccatgacctgctgataaggatggacatcctgcctagtactcaacctgctgcctttactgctggtaggagtcgttctcactgcgacacctgctaattgtcatattatttagaggaagaccaattgtctcaaaagcccatctcttgctttgagtggtggttcccacgaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgcn

SEQ ID NO: 14221 - DNA, 348 bp, Homo sapiens
tgatactgagaaacaagtaatgaagcttaaaagtgctgcttgtgctctgtgccaaaggcagcagagcacttgtctctggtctccatatacacttgacatatttaccttcagtattctgaggaagattttgattcatttcacacggaataacactcacctaccatgcttaaattaccgtacatattgtgagactttattgatcataaataagttactctcaaccttgagatctggcttcaattttctggattctcattctttctcctttatatcagaagcttcataatagacaatgggggcaaatatggtgtggagaaataatcagtttatatttagatatttttaatg

SEQ ID NO: 14222 - DNA, 324 bp, Homo sapiens
ggacctgtcccctggggctgggtcctcactgcttccctgggactggctgtgtaggggttgatgtgggcagtcagagggggtagggagagaagggtttggtgtattgcacacacaccaacactcactcagacatgatccatgcacacacacacacttgagcatgatgcgcacatatataccacacaaatatacaccatgtgcacacacaccacacacacatataccatgcacacacaaacacaaagacacatcatgtacacagacactcaaacatatgccgtgcatacacatacacatcacacactcaaatatacaccatgttca

SEQ ID NO: 14223 - DNA, 373 bp, Homo sapiens
cgttgctgtcggccgggatgggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggagggtaatggggtggtgcctttgactccgggggtggaaaagcgaccccacattcaaggacgccaatggcatgttgagctttcccaatctaaaccaggtgcgtggagggaagcaagtgcttactccc

SEQ ID NO: 14224 - DNA, 379 bp, Homo sapiens
cgttgctgtcgaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgg

SEQ ID NO: 14225 - DNA, 347 bp, Homo sapiens
ggtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctttcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaat

SEQ ID NO: 14226 - DNA, 337 bp, Homo sapiens
  misc_feature 271: n = A,T,C or G
cctgcctttttataaaatatgacaaattggccatttgtaggacatttcttcggtttctaacaaactaacagaaaaattaatcttgactgcaatagtaaattcctcttataatttagtgccaagaaaaagaaacttttcagaaaacgtgaaaaccacctctgcttcctgggttcaagtgattctcctgcttcagcctcccaagtagctgggattacaggcacgtgccaccacgcccagctaatttttgtatttttagaagaggacgggtttnaccatgttggccaggctgggttcgaattgctgacctcaagtgatccacccgcctcggcctcccaaa

SEQ ID NO: 14227 - DNA, 339 bp, Homo sapiens
  misc_feature 339: n = A,T,C or G
ggaaagctgacatcagttgtttccttactctatttcaagctttttttttttttaacacaattaacgggggccatggaaccctggccagggcccttggaggccgagggtcttcagtggaaaccgagaaaactaaggtttgcaggcaggcgggggcctttccgaaggcccgggttggttttgccaaccaaatggggtttcaaaagaattgggggggaaggaaagaaaacataggccttggaccccaaatcaaacaaaccgccaaatggaaaaaggtttgggggccccccagacccttaaaaaccaattcaaaaggttctaacatggaattttaataacaan

SEQ ID NO: 14228 - DNA, 206 bp, Homo sapiens
cccagggaccacagtttggatatgcttggcatagttgctaaaaatgtattgagtgatacagttagcatttgtgcgctttatctagccaggctctctagcttttgtttttgaaacacgtatgcagtggtttgtaacacacattgggatttttcaaggacaatttttaaaaattactgtttgttggacaggcgcggtggctcatgcct

SEQ ID NO: 14229 - DNA, 338 bp, Homo sapiens
  misc_feature 338: n = A,T,C or G
gctgggcaggggtaaagtaaggtaaaatagagatcaggcctgcagaatccctgcgaagacaaaaccacttagtgaactcaacctttcttgatttgcaaacctaaggaaaacttaacttgagctaactcttacaaatgcctgtattacagaaaaacagagcttaagctcaaccaatcagaggtagccaacaaactttcataattaggaaccttcataggagatcaatcaaataaggcaattgtgtaattatatccaatcaaatgtttgctttgctttacctctgtttctgtcttataaaggcctccccatagattcccttggtggagttcctgaaccan

SEQ ID NO: 14230 - DNA, 343 bp, Homo sapiens
tctccaatgaaggtacttttgctaaggtgtgtgaagatacctgttgctgggatcaggagacatgaaaaaactaagaaaaaaaatactgagaaaagttttcaatagctttgtaagccttcagaatgtaaagtacattaagaaataaaaacttaaatgcagtgggtacaaacatggcaaatctgaaagctaaacctgactaaggctatcaacctgccatgtgctaaaaacaaatgtactcactcagaaaaactgaaagaggtactacatacctattaaaacagctaaatttaaacagtgataatactaaatgccgacaagtatgcaaagaaactggacttctcat

SEQ ID NO: 14231 - DNA, 341 bp, Homo sapiens
tgcatccggaaggtggaggttgcagtgagctgaaatcacaccattgcactccagcctgggtgacagagtgagactctatctaacaaaaaaaagaaaagaaaaagaaaatttcttttcctagtttattggaaattattttattaaaaggggatggagaattaattgtatcatcaaaaaaatatcttttaaaaaaaaaggtatcacaggagccatccatctcaaaaaagcagggaaaaaaaatatgagactttcaatattaaaaatgaccaaatattaagattggcttctctctctttcttttcattaactgacgctaaccattagaggagaggtgactctag

SEQ ID NO: 14232 - DNA, 202 bp, Homo sapiens
ttagatgatggatatctagaggtgtattatatcattggctctattttgtatgtttgaagtttccatagtataaaacttaggaaagttaatttaaacagacaaataccccatcatgaaaatggataatcaaaaggaactcttgataatgaaagaactaaaagtggccagatgttttcaaatgcttagctttactactaattct

SEQ ID NO: 14233 - DNA, 339 bp, Homo sapiens
cctggatgacagagcaagactctgtctcaaaaaaaaaaaaaaatttttttttagcccctttgtggtgaaccttcaaaccccctaaaaaaaagagaagatttttttgttggttggtttctgaaacagagcctaactttgccgttcaggctgaaggactttgaacacttctggttttttttaaactgttaccaccaggtgtctacaactgctgaccccactgtggtttaaattctattcaaaacagacatcggaggctctgaggctgatctcatgtgccccgtgagaacatttggaatttgaggaagaggagactggccttggtatgccttgccatcacct

SEQ ID NO: 14234 - DNA, 342 bp, Homo sapiens
acatggtacctaagatactagaatacatttataaatatttgttgaggaactaattataaagactattccaggtgctttagggttcagccacaacctattataagtaatacctattataagtgggtgcttgtaatagatattaccatattatctaagcactcactttaatactcattgttctgggctccacctgatgttatgatatgaatctttttagctatactctgatccagaagatcacatgattagcatcaatttctaaggacagtaataaacttgatagttctgagcaaatacatacactacagaataggcattcaacaaatatttattggctgccta

SEQ ID NO: 14235 - DNA, 309 bp, Homo sapiens
gtgggagctgagggcagggatcaggcctggagggaagcaggcccagaggtgggcaccaaggaggagatggagggagctttgtcccatttctctctgagtcttggccccatcttggaaacctggccccagactgccattcttgaatatgtgataattactgctataattggtggagcccctgcaaggggcttcatactttgcctcacttaactttcacaactactagaagagcgaggccctcttatctctgctttcagattaaggaagggagatgcagggtgatgaaatcacttgtccaggctgggggca

SEQ ID NO: 14236 - DNA, 336 bp, Homo sapiens
  misc_feature 336: n = A,T,C or G
tttgtatttttaatagagataggttttcgccatgttggtcaggctggtctcgaacccctgaccttgtgatctgcctgcctcggcctcccaacagagcagtcctgatgagccctccccgtaagaaactgctgaaatgttggggcggctgtatgtttttgttataaggaaaaggtaacatttgtggaaggcagtacttcacagtgatacatttaatggttgcatattcaaatctcaaatgagattactagtaatctagagcaggtgtttcttatcccagaaagttcttaaagttctcagaattagttctcttgagacaagagccatattttcctgtan

SEQ ID NO: 14237 - DNA, 339 bp, Homo sapiens
ttttgcagtatgtgcatgcattttctattcacaaaaatgaaattttttaaaaaagggggcagtacttagcacaatgcctagcagtggtggcggtggtggtgatagcctttctgcagctctgggcagatgattcactgcagaaatgcagcccagagatatctagaggctggccatagcctccagactgtcctcctagcctctcggtctcccttcttcattctatatgatccatgtttccccatcggagaatctttgcattttagagatgtaaaggggcttcagattttctagtgcaactgttttaacggtgaagaaactaagcccccaaaagatgccatt

SEQ ID NO: 14238 - DNA, 340 bp, Homo sapiens
ggacactggaccaaatgtctgatcagctcatcacattgtccacatgaaatggaccgtcttcctcagttcaaaataatcaaatgatagatggagaattctgaaagttaggagctacaactatttgaaataaaactctagttacatatttgaaccgttcaaggtaggttgtttaaaagcagtttgttcacaaacaggtatatacacagtagagtaaatttgttattttagcaaacgcttatttagctcatgctgatttaatgagggttcctttcatgatacttaatagttataagaacattttttacgattttatagttaaacatttcttttgcataccttg

SEQ ID NO: 14239 - DNA, 337 bp, Homo sapiens
cgattctcctgcctcagcctcccaagtagctgggactatttttgtatttttgtatttttctaattttgtatttttagtagagatgggggttcaccatgttggccaggctgttctcaaactcctgacctcaggtgatccacccatctcgacctcccaaagtgttgggcttataggtgtgagccactgcacccgaccgcctccatcattttatattaccttcagcaacgtgtgggggatgccctgtttgcacttgcttatcaacactagatacttgcttattttattaacgctatatgagagggtcaggtggaccggcatttttacccgcctaagatcc

SEQ ID NO: 14240 - DNA, 338 bp, Homo sapiens
  misc_feature 338: n = A,T,C or G
tgaccttttgatcccatcatgggactgttccccagccctaggccactggaatggggggaaatagaaccctcctttccttgttcccactcttgtttcttttgaacatgggttacctcccttcgcgtcttttggaacagaaggggatcataagctcttgagtctctgttttctgctgtcatctactcttcctgcctctggcacctcccagctcctgacttcctcctgcttccccctggagccagagacgtggctgggaagagcccctggcctttgaagccagtggtggtggtgaccaggggcaacaggccactgtgctcctggatgcgtggtctgccagn

SEQ ID NO: 14241 - DNA, 340 bp, Homo sapiens
gaataaatcaacatcagagttttataaatcagagtgtctttgtactctacaaattagtatgcttaatatacaacttgaagtccttcagagaaaatattaaacagaaatgccttctacccagagatatgaatgtgcctttgcaataataaagaagagactaaaaattgtatagcaatacctagtatctgaccaatacattatttcacaaaaataataaagtatcttgcatcatacatggaagacagtgacttattcctgaatctactatatctacagactttcttgtaccaaatatttactataagtacatacaactatggaaaatgctatgctatgcctt

SEQ ID NO: 14242 - DNA, 341 bp, Homo sapiens
atttaccgataggtgtgggagggcaaccaacattttattctatacccttttatgctttttgttgtttgaactatgtccaggtgttatatctattaaaatagtatgaattcaatggcttactctaaggaagaccatgatcaccagcatatgagaggcagacgaaacgctatccacagcaagatgaacacctacacagcagggagaacatgggaggattcaaggtggtaagaaaatttaatacaagtctaggcctggtgtggcggctcacgcctgtaatcccagcactttgggaggctggggcgggtaggtgacctgaggtcaggagccaagaccagcctggc

SEQ ID NO: 14243 - DNA, 342 bp, Homo sapiens
ttttcttgatgtctcataacttctcctttctcttcccacattccgaaaatcctcctatcctaaccttgctacatgaatggtaactgcttgaacacttgtgattggaatgactgatttaaaaagcccagttttgaggtagggcgcagtggctcacgcctataatcccagcactttgggaggccaaggcgggcagaacacgaggtcaggagatcgagaccaacctggctaacatggtgaaaccccgtctctactaaaaatacaaaaaattaacctggcgtggtggcgggcgcctgtagtcccagctacttgggaggctgaggtgggagaatggcgtgaacccag

SEQ ID NO: 14244 - DNA, 339 bp, Homo sapiens
  misc_feature 339: n = A,T,C or G
actaagcacaattagaaatgtcttggtttatatatttcttcccatgctttctgtctctacaaccagaatataagcttcagaacaagagtattcaaatctggtgtgtttatccccagactcacaacactgggtccagagcaggtcctcagtagatgtttataaatatcaggatgtattacatatattaactttttatgagtagttattatttattatattccacttagatatggaattattacttcaggtggtagctgacttgtactggaaaagtgactgagcccaactctaatgctaatgttaattggatttatatgaagtttctttggtttaattgcn

SEQ ID NO: 14245 - DNA, 341 bp, Homo sapiens
cctatcacacccattcataaagatcttgcgtaggtgatttgggtttaccatttttgtctaaacttttcctcatgtgagttctggataatggactccgatttttttaaaaatggtaaaactaattgaacatatcagtcatttgtagttggagaaaaaattgacttgctttctatatgttaagtctagaccattttgccctctttgtaaaatgtgatttgtttttgtatatgtttagtaattttatgagctatttataacttactgggaatgatcagagaacagggttcttttttttttttttaaaaggtttttggcctggcgcacaagtctcacaccttaat

SEQ ID NO: 14246 - DNA, 310 bp, Homo sapiens
tgcacatcatttctaggaagacagttgtctatgtatggtgatttcactgctcaccattatagaaatgaaactaactgcagaaggtagacagcctaaatgggagtagctctgccaagtgtgtgagcttttaaaaaaatgtatacaatttttttggcttttctaattcatactaatgattctaaattacaaagagaagccattctgcttcagattttggaaatgagtctaatgttaactaaaaacctgtgacctgatgaggattttgataactcctctaccatatttgtttacctggctctatttcgaataa

SEQ ID NO: 14247 - DNA, 342 bp, Homo sapiens
tacaacaaagcaataatgccaggctagtctcatgccctgtgaactaattacagaggttgccaacctcaatgaaccacagtgaacaactttagatccacagagagtctcaacttataaaattcattaaatagaaatagattcagaacttttcacttttcagtttggcagtacgtgttgatacagattaggaaatgtttcattttatggccctatataaaattaagtgtttttttcaactttattgaggtatcggtcacatactatacaattcaccctttaaaaatatataattcagggccgggtgcagaggctcatgcctgtaatcccaggactttgggaggg

SEQ ID NO: 14248 - DNA, 339 bp, Homo sapiens
caaatcctggatagtttaatctcttcaaagaggaaacatgtggttttctgctagggcatagaaggagatcaggggcttagctgtttcttttaaagactttgaaccaattctcctactttcagttttatgccttactattttcttaaagatacctgatacctgcaattcttgggcatttgcatattgctgtttgatgcctcctgtccccaaacagcacttagctttttgtgtttattttttaggtcaattgcctcttactgatttgttttccagttcctaaaacttgctgtattatgggagagagttgagataaatgcaaatactcagaagtattttgtg

SEQ ID NO: 14249 - DNA, 231 bp, Homo sapiens
tcattcagcgtagagcatgtggaacacagtggcttcctagctaatgtttgctgaatggaatagaattttgaatacaatgagccaaatttctttactattagaggattttgctgaatggttaaaatcaatgcaaaatgaggaatcaaagtttttgattaggtattacacatgaaaccaggaagagggagaagtacctcctttaatgtgcatacagagaaggtaacccatgag

SEQ ID NO: 14250 - DNA, 341 bp, Homo sapiens
agtatctacataaatcatttggaattcttctaaacagacttgtctgtcctctgccatttatttatgtggaattattattattattattatcattattattcagaggtagatatattcttgaaggaattattatttaaaaaatcacagcatcccaatactttgtttcccaaagaaatagatatgttcacattatgagtaaagactgtttttgaacttgctctaaaaaatatctggtttctacattgcagagctgagatttgtgaagaatgaggcagaattaaagttttggggttgagtgctttttaaaaattgggtatttattttacttatttatttttgag

SEQ ID NO: 14251 - DNA, 337 bp, Homo sapiens
tctgagaattttctataacacaaactccttaacttcctggtgggtaatgttttctgggtgttttttctgttttctgttttttttgttggcatttcttctttagtaaaatgaaaattgcaagtagaaaagaaactaaaaatggatttagtgtgaggacaggttccttttcctggcaggattgtagaacactggtattcagttgactgtttacaatgaatatatcttctggttggtcatggccagaagagaaaatgtcattggtttgtgcccaagcaaattgattattaaaatacgttgaatatgaccccatggttgcaaacatcccttttcttagtaa

SEQ ID NO: 14252 - DNA, 339 bp, Homo sapiens
tttgcctgaaattgcacgtcagcttcatttcctcaccccctccccaatcattcttaaacaccttcgaactgaaaattttaattctgattagtttatcttaacaaacaatttagagaaggattggtgtccaaataaactgtatgatgtggaacttgccccaaatgaagaggaagttggcattccatagctagacagtagcatttccagctgtgggggtgccagagctgagccaagcaggcctgctcagcagagacttgggattcaggctttgtaagaactcgtgttggcaacccgttccctgtgttgcaggcataaacccaagagggttttaaagatcaa

SEQ ID NO: 14253 - DNA, 339 bp, Homo sapiens
gtttcaccatgttggccaggctggtcttgaactcctgacctcaggtgatccacctgcctgggcctcccaaagtgctgggattacaggcgtaagccaccgcgcccagccaagtaaaattaaatattcttgtattctttttatatctctggaaaagtattaaatacattcttccagaaaaaccttcgctgaagggcttggctggactagtttcccacagcttatccctaggcctctgggtagaattggttttctttaatggggggatagatcaaacatcatacggagaccaacaaggttttttggttcttcttaaaagccactgggaatcttcagaacaag

SEQ ID NO: 14254 - DNA, 342 bp, Homo sapiens
ctgttttgtcctcattaacctgtaatgcttgactttcatatttctttactgccatatgatatagcagaatagagttattgatttcaatggtgcacaatattttgattactaaaaaataccattttcccctgatgaattgactgatgttttaaaaatccatccaacaagtaactgttgaatcctataatatacaatgctttgttaaggcaaatggtgaatgcaaaatagtgaacactataatctctggaaaccaaataaaaagacttcgggtctcagaagtatacagcaactacatattttaccaccaaccacatgcccaaccaatggtatatacaaattaac

SEQ ID NO: 14255 - DNA, 340 bp, Homo sapiens
gtctcacaatgtcaccatctacaatgcatgccagctgtaaacaatcacttgcaattccacaaacgtaccatgcttttctcatctcccatcttaacaataacagttctaacatataatactggttacagtgtgcctggtactatgctaagcatattacgtgatgatctcatataatcgtcacagcaatcctgtttccttttcctggaatgacctgccccacctattaattctctcactccccacacacatttagccagcaaactcctattgagctaacagccatcatccatcccaccacttattccaagcaccctttcctgcctcccactgccacccttct

SEQ ID NO: 14256 - DNA, 337 bp, Homo sapiens
ggaaaatggacgacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagcgggactttctctgtcccggcttactatctgagctcctcacaaaatacaattatcaa

SEQ ID NO: 14257 - DNA, 311 bp, Homo sapiens
gttcttatgaaccttgaaggttgttgtaaaccgtccaaatttcagaaaaataccgattatttctgaatagaaatccaaatatagatgcttacggttagattgagcctggattgccctcaattaagaacaattgagtttttttgttgctcgttcattttacatgtcgtattggtacatggtacatgtactagtggttttccaaagtccatgattttagtatcttatataagaaattaattgtcagccgggcgcagaggctcacgcctgtaatcccagcactttgagaggccgagacaggcggatcacaaggg

SEQ ID NO: 14258 - DNA, 341 bp, Homo sapiens
aaggtagagaatgctattcagttagtcagtttaacatacgagattgtcaactcaatagctcagaggggccagaaatacagatttgctggcttctggcttgggtggtagttgaagtgcatgggagagggtgagtttgcccaatcaggccgcgtacagtgagaagggaagaaggctaaagatgcaggcctaaggaaaatcagcacttaagtaggaggaggaacagccaataagagatcaaaggggaaagttttattttatgttggatttttccccccttaagatgagctaggacaggtgtgggggcacatgcctgtaatcccagcactttgggaggctgcggt

SEQ ID NO: 14259 - DNA, 370 bp, Homo sapiens
actacgattcctacataacaacaaacggagccgggtggggacgcaccacaaatacactgcgatgaccctacagctgaattcgtgaagcctgggatgctaccgctataccttacaccatgataaaccgcagaacacggctgacctgctacacccgccttcatagcacactctaggtccaaatacaggagtgataggttcacactggctagccccagagtgccacccgagggcaggcctggctgcccacaaagaagaggtagatttggggggctgtgtggagccagcatgaggcaaggcatagccaggaccagaggcccagggaggccacagctgacttgctgggtgctgcagggctgttggaggctcccac

SEQ ID NO: 14260 - DNA, 337 bp, Homo sapiens
atgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaag

SEQ ID NO: 14261 - DNA, 343 bp, Homo sapiens
  misc_feature 343: n = A,T,C or G
gaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccan

SEQ ID NO: 14262 - DNA, 332 bp, Homo sapiens
aaacattcatcaatttggcccagacaaaagtattcttgcttgctttaggatttactcaacttgttctaattttaaccttctgttgctttaaaatatggtaatggatttgttggttgttgaaggaattgaatgtgattgtggtgttacatcttttcttatattaaaatctttaattctaaaatcagtatgtcacatacattaccacattaacacatcaagactggaaactgatgattggaacagagacaaatgtgttggtgagttgtggtgagctgtcaagggacttatggactatagctgtcctatagtctataacgagccagctgaagatg

SEQ ID NO: 14263 - DNA, 332 bp, Homo sapiens
taaatgggatacacgtcttcttaagtaattcaaagtctagtaggggaagcagaaaggtaacaaacaattaagatacaaaagtaaaacaaaagccctctgtagagtgctccaacatcttttattccttatcatctccccaaattccaatttgctgcccctatatgccctttaaaaaaacccaggccgggcacaacggctcacacctgtaatcccagcactttgggaggctgaggcaggaggatcacttgaggccaagagttggagaccagcctggctaacacggtgaaacttcgtctctactaaaaatacaaaaattagctgggcgtggtggt

SEQ ID NO: 14264 - DNA, 327 bp, Homo sapiens
  misc_feature 327: n = A,T,C or G
gtagacagtccaaagcagcatcagacacatcatgagtgctcaaactgtacatctgcttccctggtgatttttctttcaatggccaaaggatagaggcagcggcaattccaggtgtgctgtgagccaactgtgtgagcctgggcgcctacttaacctccctgagtcctcttctataagtgagcattctaatagtacctagttcacaagttgtcctgaagcttaaacaaaatagcaaaatgatgctttttaaaatgacaatacaatcaagaggacagaacaggtaaagactttgtttattcacaaattgctggtattgattgaattggn

SEQ ID NO: 14265 - DNA, 335 bp, Homo sapiens
tgctgatgcggtggtactacagaaagagacgcctgacttacatattccactcgtaactgcatctgtaagaactcaaatcacctttgacattaatttacgaccaactgcatgccctacataattgagacacttgggatcgggtggaaaaagacaccaaattgtctcatattatgaatgaacactgaagggggagtttggggaaaaccgaatataagcaactcattcaaggagacaaattcagatgatagtttcgagaatataaatggagagatgtgattcacaataatattggggatgctatcttagatggcccgcttaagaaaaacctctcaaaa

SEQ ID NO: 14266 - DNA, 332 bp, Homo sapiens
ctatcttagaacaagttaaatagtatatgtacttgtaataacttgtgactagatatgttagttttgtctattaatttttctgttaaaaagaatatgcattgaaatgagatggaaaacaaaatgaaaagtgtttaaaaaattaaatattttagaaggatcaatatcctaagggttgtgggtaattttttcctactttctaaaacttcagattcctttcactcacttaaggttgtactaccattaatgcaatgttttctgggagtgcgagatttgctaatgaattaataacagctagaagcctcactatttgcacttttataacattctttgct

SEQ ID NO: 14267 - DNA, 334 bp, Homo sapiens
gggactcttgctaaaggcaagccagggacttagacttataaagcatcaccttatcaaaggtggaggatgatcaacttgatatcaagggtgaccagatttcagggaagagggattctcactaaactgactcccagaggtctcttttagcaaggcactcatgccaggcgcagtggctcatgcctgtaatcccaacactttgggaggctaaggcaggtggatcgtctgaggtctggagttcgagaccggcctggacaacatagtgaaacccagtctctactaaaaaaaaaaaaaaattggccgtcacaatggctcaggcctataatcccagcacttt

SEQ ID NO: 14268 - DNA, 327 bp, Homo sapiens
atactactttttgtgcgtgtgtgtatgtgagacagagtctcagtctgtctcccaggctggagtatagtggcacgatctcggctcactgcaacctctgccttctgggttcaagcaattctcctgcctcagcctcccgtgtagctgggactgcaggtgtgtgcctccatgcccagctaaattttttttgaagatttagagaacaccctgtttcaccttggtgaggaggctgagttttaactattacaccccattcgcactgagtgggtttccctcctttaatcccgcggtttggtgctatcttttattcgagattttttattacacacc

SEQ ID NO: 14269 - DNA, 331 bp, Homo sapiens
cttctcttatatttcaactgagactatactgtaagaaacaaaaatgatctgaaccatatttgccatgtaacattaacaatgtgagaaaattattttttaaaactgttgtcaattaagacataacttatatttttctcattggaatttcccaacatggctgtcctggttaggacagccaaaccaagccaaagagcagctccctatgtctgggcatgcagtcatctgacttcaatagactcttcacctcgacatgtcatgtactctaagaatgtaaaagtttttagtgctccagcaatgctaaggccaaatccagcacaactagcatcacagt

SEQ ID NO: 14270 - DNA, 334 bp, Homo sapiens
cgtccttaaagcttaaggcgctcctcccccagcagcctggcttgagggagaggcctgcctctgttgtgctcgctgtggtgggtggtaggcaccctaggtccttaagggacatacgctccagcccttaacctttcctcagcctctgagttcttccggccctgtcctgtctctgtggcacccgtcctgctaataatgccttctccattctgcccagaacaagacaccatgccgggtgcggtggctcacacctgtaatcccagcactttggggggccaaggcaggctggatcacctgaggtcaagagttctagaccagcctggccaacgtggtgaaa

SEQ ID NO: 14271 - DNA, 329 bp, Homo sapiens
acgcacacacacacacgcaaacactctctctctaacaaatgtctctgctctatacagctggactgactccgctctacatagctggactgactctgctctacatagctggactgacattatctgctaatacacattcaccttttctgtttttatactcatcagctcttcacacctatagaaatgcagtgatgatgataaaaatgaccattaaaatatcacagacaatattacaaattatatcacaaagttattttcttaataaataaagacaaattaataagaccaatggctcattagaaaaatgaacacaggaaatgaacaagcaattg

SEQ ID NO: 14272 - DNA, 329 bp, Homo sapiens
  misc_feature 152, 153, 154, 157, 160: n = A,T,C or G
gctgggagcgctgttcaaggtaaagagtggttagtaaaatgatctcctttaagttgctaagagtaagatgccaagtaacagaaaaatgaaactctcatgctagcaagtgtgtatgtgtgttggcgtgtgtgtgtgtgtgtgtgtgagtgtgnnncantanaacctgtagtgaacttttttattaacaggaattgccgctcatggtatgttctctccttcaccgtgaggagtttcacgatattccattctctgcgatccggtggaattctactaaaaaaatggttcttctcccctgggggggaattttttctgtgaaacaatctcccccg

SEQ ID NO: 14273 - DNA, 335 bp, Homo sapiens
ctcaacacacccaggtttttttgttctctctttctctctggcctcaattccatgccttactacttgattgttgtatgctaggattgagggaatatgcatgcaaatactagacaaagcacttgagggaggccttctcccacagtactggtggctgtgtaatagatgttctcaattaccaagtgcttaaactgagccctatgtacttaggcagcctgtttagagttcttacccacttgccaatgacacttgactgctgaatccaaatatgaaaaaaactatagatagattcaaggaccaaaattatggatatgccactgaaaatgtatggtagagta

SEQ ID NO: 14274 - DNA, 326 bp, Homo sapiens
aactttaaacaaacaaaaacccactaatgtaccaatttgtgattctgggcaaagtttttgaaaagtaagttatgaaacaccttttacctcattgtattccttttaataatcaagcaaataagtaaagtgataatgaaaaaataatgatatgtacttaattttatccttttgtatctttttttttttttttaaaaaaagggtctaattttgccccccgggtgggggggcagggccttggggttaacaaaaccttgaacttctaaaaaaagggaaccttccattttaaccctctgaagaggggggacttttaaacccccccccccccc

SEQ ID NO: 14275 - DNA, 334 bp, Homo sapiens
  misc_feature 334: n = A,T,C or G
gcagtggcatgatcttggttcactgcaacctccacctccctagttcaagtgctcctcagcctccagagtagctgggactacaagcaaatgccaccatgcccagctaatttttgtattttttatagagacagggttttgccatgctacccaggctggtctcagattcctgggctcaagtgaactgtccacctcagcctcccaaagtagactattcttatattttcctttcattggggagtaaaacaaaaattgtttcatatgaatacattttcacaggaggaagaaacaaatttcattcttaactgaaacttacaatggccagaaattaagccan

SEQ ID NO: 14276 - DNA, 329 bp, Homo sapiens
ttgatctgcagtgggacctggaattttatacattgagcatagtgccaggcaatgcttatgatcagatgatactaattaacccctggcatcatatgatcttcactgtgattggagttagaagatttagcttcatatcctgccttctcctatcaacacacacacatacacatatacacacacacgtgcacaggcatgccaaattggctgttacttatctcacttgtattatttatatctttttactcataaaaagactttgggctgggtgtggtggctcatgcctgtaatcccagcactttgggaggctgaagcgggtggatcatgaagtc

SEQ ID NO: 14277 - DNA, 300 bp, Homo sapiens
  misc_feature 284: n = A,T,C or G
tcttcagcagtttatatacaacaaatgccccccggttacctcttttctgggagagcctcttgtttcaattgaaagttctcatttacagcaatctcatgagcaagagtcaagtttgataagttccttgctgtagccatcacttcatcaaatgttacaacccttggagggcttgttgctgaaagaaaaacaaaagccagttaatgttgcagaagaaaagttgtcatccaacgaagcctcctgatgcagataaggtttaatttatcagaatgtatatacttcagagntttataggtcaggaga

SEQ ID NO: 14278 - DNA, 331 bp, Homo sapiens
agtaattacattagcaggtttagttgtcatgaatgagtttgggaacaatcactgatgactcttggtaagcccctctgtgggaaagaagtatctccctgggtatccaacttgcagggagtgttcaggatctcatgttctgtagaggtcataaagagggccagctaatctgggctgtcatgtagacacagctcagtggagagttttctggcaaaaggaggagcaaaggccctggggcagagaaaatcttggagagtacggaaaggccatgagactgaagtgtaataaatgaggcatgaggagtgtgtgcgaagacaggacgcaaagagagatg

SEQ ID NO: 14279 - DNA, 330 bp, Homo sapiens
gttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagaatttagggacatgggaaccaccacttataagcttgaggctgttgtgcaaatttggaccttcatataagccatttccttctatatagaatgctctttcttttgcttacccttaacctcttaccag

SEQ ID NO: 14280 - DNA, 335 bp, Homo sapiens
ggtagaggccagtgataggctaaatatcctacaaggcacaggctgctttccacctcctaatctctctctctctctctctctctctctcacacacacacacacacacacacacacacacacacacacgcacgcacatcccaaagaaacaaagagagatcccatcccaaatgacaaaaggtgtgagaataaaaatcctactgcaaccctgtatgacaaactgctaaggggtttgtgcaattaaaatataccctaagtgtcacagagtatactcaatcaaagtggaatattttatttatatcacccgcgctgtagagaatattcgcacagaactttat

SEQ ID NO: 14281 - DNA, 249 bp, Homo sapiens
cttatcaacttagtcaatggcaataatcataaagtaaacattaaggaaaatattttaattacaatactaccaatattatatacaccaaatttccttagcaacagtggttacagaagtaaacaatcacgagcaaaagcaaaatttacggctattgaaatcattaacaagggccgagcacggtagctcatgcctgtaatcccagcactttgggaggctgaggcaggcagatcacgaggtcaagagatcaag

SEQ ID NO: 14282 - DNA, 281 bp, Homo sapiens
ggcggagtcacccacagtggggcagcccctgcacaggctttgctggagtctccactgcactggcctaggtccaagcagtcatagcactgcccccagctgcccttctaagccctgtagcctagtggattagaacctggcctccctctggagaaaggcccaggacccgattcagcggcatcattccctagtgcttcgaccctgacctctctgagatggggtctatgcctcggggatgagtgctccctgcactggggggctgtgaccaccagcctgtggcccag

SEQ ID NO: 14283 - DNA, 330 bp, Homo sapiens
cttctataatgcttcttttatatttccttacagttaatgtccattttctttctccctctctacatgcacacacaaacacacccactcacacccacacccatgcataaatacacacacacacacgcacacacacacacacaccatccagcctgtagatatttatgcttcattttcagtaaacatgcagaagcacttttgacagacattttcctttaaatttaaattccaaagaactctgtagaaagcagtgaatggtaactgaaaagctgagtgaaatgttttatattgctaaaacttttgacattgattacataatgtcagagaatcctt

SEQ ID NO: 14284 - DNA, 327 bp, Homo sapiens
gtgtgtgtgcgtgtgtgtcacatgtgcgtgcacacacatatactatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagtttcttcaggaaatatcagccttttattcaagtatatgattttctataaagtattgctattataatcttttaatgctaggtgaatccacatcaagcattcaatatttgttggatgatacaa

SEQ ID NO: 14285 - DNA, 293 bp, Homo sapiens
cgacagaagggtatctttattaacaattgacttgaatttaaaaaaaattttagtatttttatttttaattttaatgaaggaaaaagtaaacatgtaaatgcttgctttatttttcaattttataaaagcagttaattacagagaagtgctgacatttctacttttcataggaaacttggagagaagtcaaaggtgtaaaaaggacaaattttagaaaatgagattcatgaggaaagactgattaagttcactttagttaatgaaatgtggaattatgaaaaattaaatattac

SEQ ID NO: 14286 - DNA, 328 bp, Homo sapiens
gttcctaaagtactagagggagacacaagccaagaacctggcacatatctcacatcccccagagatttaattcatcagttaaggctacactcctatggaccccaccctcctatgcatcaagggctggaatcactcactgaaaaaaagctttgttggctggacacggtggcccatgcctgtaatcccagcactttaggatgccaaggcgggttgaggccaggagttcaagaacagcctagccaacgtggtgaaaccccatctctattaaaaatacaaaaattagccacacatggtggcatgcatctgtggtcctaactacttcggaggc

SEQ ID NO: 14287 - DNA, 359 bp, Homo sapiens
tacggcgcgagaagaccacagaagggtgggcatatttactcatcatattcaaagtcctggggattcaggtggaaaattaaggccatttttaaaattctgcttaccacatctctggatgtgtatttttcactgcgcgttgcagtcaaaaagcttaaagagcatctagccactggactagaaaactttaaggacacttccagtcctaaaattctaaaaatctaacatgtaaagctatttttttaattggaaaggaaaaacaattatgcaaatttcaaagttagttaaatcaaaaagggtgctgaagatcttcttttcctaggttaaaataaaaaggacatgttttaacaaaagtgtcattt

SEQ ID NO: 14288 - DNA, 329 bp, Homo sapiens
ggatgggttttttttaaagggtttctcaatccatttgtcatctaaagatgcaacaagagaaagatattttcttcaatgaaaagttatcttcatctttaaatcttttaacgctaacattaacacacaagaccctcattaaatgctcatctccacatgcaaggtacttgaaaaatcattttgagaattagccatatcagagttgactgagagatataaaaaacaagaaatacaaaagacacaacatgaaaaacaaaacagaacacatcaacatatttgtacaagacatgcctcaaatgaaaggtagcaaaacaattctacaaagacacaaa

SEQ ID NO: 14289 - DNA, 328 bp, Homo sapiens
ggaccttttgatcccatcatgggactgttccccagccctaggccactggaatggggggaaagagaaccctcctttccttgttcccactcttgtttcttttgaacatgggttacctcccttcgcgtcttttggaacagaaggggatcataagctcttgagtctctgttttctgctgtcatctactcttcctgcctctggcacctcccagctcctgacttcctcctgcttccccctggagccagagacgtggctgggaagagcccctggcctttgaagccagtggtggtggtgaccaggggcaacaggccactgtgctcctggatgcgtg

SEQ ID NO: 14290 - DNA, 330 bp, Homo sapiens
tgtctcaaaaaaaaaaatttgtacatacagggggttactgtcacatagggctgggatttaggcatgagtcacctgcctgaccagcaagttcttaaattctgcagcaagttcttaaaacaatggctgtagcataaataacccttcataaaaacgctaatcacgatgctgggacggtggctcacgcctgtaatcccagcactttgggaggccgaggtgggcagatcatgagatcaggagatcgagaccatcctggctaacacggtgaaaccccgactctactaaaaatacaaaaaaattagccgggcatgggggggggcgcctggtatcccc

SEQ ID NO: 14291 - DNA, 336 bp, Homo sapiens
aggcttgtgagagccactctgagctaggacctcagctgagagaggctggagcaacaccatggcaattttcggattcactgcctaaactgatgtcagtgggcagatgagcctttcacccaataagctaacgtgcgagggtccttccaaaccccttggcagatggttttttattataggctcaaagaaaaatggggctataaccaagttccttgggggacaggactgtttccatgcttgagcttggaagcaagattgatgggacaaaacacgtacgttggtgttggtccacaccatcaaaacaaacctcctaggtcttgagctccattgaggtttcac

SEQ ID NO: 14292 - DNA, 332 bp, Homo sapiens
  misc_feature 332: n = A,T,C or G
aacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcccacaattccaggcaatggcctgtcggaccagacaattctaccn

SEQ ID NO: 14293 - DNA, 329 bp, Homo sapiens
  misc_feature 279: n = A,T,C or G
gttagccaggtgggcatgtgcataggggtggaacccacagacaccccagcccaggagccattcctgatgtgggagatagtgtgtggtatctccagtgagccccctgaggctcactcatccaaagggcctcagtctcgaacgacaggcacggtcaagacaaggcaatggcacctgtcctaaaattccttacacacctctaggaaatatatccacagataatagcttcgccttgtagtgcatgaggtccttgaatgattcctcaccctcttttggtccagntatctttctccttctatgtagcatttcaaacactccactcacagtagtag

SEQ ID NO: 14294 - DNA, 328 bp, Homo sapiens
taatgtgtgtgccagaatttcatgacctcaaggatctgaattttcaagtcactgcaaaaaggacgtgtttttgggaattttactaattcccttaggcagatactttggggtgagggggaggatgttcatcctgtctaccatctcccttctctgaaaactgtacagctgccctgtaactgggtgggccctagcaccagccacaactatactcaatactttcacttattccaaactactataaacatccacctcccttagaaagaagtactaaaaataaaggcaatcctactcttctgttattaataaaataaaaattaaacactttggg

SEQ ID NO: 14295 - DNA, 337 bp, Homo sapiens
cggggttctagcagtattcgcatgtcatggaggggaagggactacccccagaaataatacaactgcttacccactccatgaagtgaaagatttgaaagacatttctctgttccaaaggcctgtgggcagaattaatagtaattgccagaaaagccaggttcaaaacagacgctacacttgcatttattgaatgagcttattggatatcttggttgcaagcaggaagcaacctgctgacctgagctccctgtggccctggtcctctccactctgaaaacatccaggcagatcttacaactcctccagtcacacccagataccaactctaggccagacg

SEQ ID NO: 14296 - DNA, 331 bp, Homo sapiens
  misc_feature 331: n = A,T,C or G
gaaaggtctttggacgtaaacagtagaaaactacttgcatatttgaagaaaaagggactttattggaaggctgttggggaactggcaaaaataaggtcctcctgaagaacaaggcttgcagcagacaggagtcaggcagtttcagaggaccttgacaagtgcagcgtataggttaggtgcaggagtcaacctgggttcacgtctttgactctactacatggggcaggctatttaacagctttctgcctcagttttctgatctgtaaaatggtgatgatattactcatctcagtattactgtgaagtttaaatgagctggtatataaaaagn

SEQ ID NO: 14297 - DNA, 327 bp, Homo sapiens
ctgggtgacaaagtcgcaaggttgtgtctcttacctgcccacaggtgcacgtcgtcagccccaccgcctcactgcagcccccaaggttaccgccagccgccgaggggtgggaacggcagggtgatgatatcaacagccaagaaccccctgggcttgtccactgctcaggccgtcccagcccccggggaagcaggtccaccactaggcccattcgacagatagcagcacaatcaccgtcaccacgactggagaatgacatgtcccagcacctagtgccaggccctcttccaagggcttgcatttgcttatccatttaacccccagcag

SEQ ID NO: 14298 - DNA, 306 bp, Homo sapiens
ttctgagggccactactgttcagtgttgagccctcactgccttcaagcactggcatctgcccctctttggctctgtttggtctccttggcttcaccctgagcctcattcttggccatggccaagctttcctggtctggctcccatccagcacccagtgccccctgcccaatatcgcctgatgctcaagcataacccagtcacctttggttgaatgaccttctgagggttagtacaacgctagtttgaattatttttcctttcccctaatttctttgagcagactaagttagaaaaatatccatatg

SEQ ID NO: 14299 - DNA, 331 bp, Homo sapiens
gatataaacaacattactttctcaaaaactctaattcaatatataaatagtataccttcacattcatgaatcctactgtgttcaaagattactagttttctagttattcctttattcatatttatgtagaatatttcagaataagcaatacttaattttaaagaatatgtttcacaaggtattttttgatggtttaaactttgtttatcaacagaagatacctgctcagaagaaattgtgggttttcaacctcagcgctactgaaatgcgtgttggattgcttttgttggaaaaggctgtcctttggatcacaggatggttatcaaaatcg

SEQ ID NO: 14300 - DNA, 332 bp, Homo sapiens
gggttcagggccgggtccctggctgagctgaccccacaggtttcagcgggtgggcccacctgacggaggtcgaccccgacgaggaggtgcagggcgagatccacctgcggctggaagtgtggccaggggcccgggcctgccggctacgctgctctgtgctggaggccaggtgagactcaggggcctgggggcgggcagtgggtcccctgcaactagagaaacccaatgaggaagctgagccccccctcgccccacctctacctcctggtcccagagctggccacctcccatcaaagcctgctctcaagagagggtctcgccaggcacggcgt

SEQ ID NO: 14301 - DNA, 350 bp, Homo sapiens
tacggctgccataatacgacagaacggacctaagccttacaagaagagatgctgtcttggtcttgctggaggaccttgctttacttagatgtcttattattaacgttacctattattgatggaaatacactaatttgtatgggcctagatggtaacatggcatttctaatattggcttcctttcttgcgggcttgattagcttggggaccgaatcactaccgtctagcttactaacttagccaatcttggcagaacatgttcaccttacacactgcacctatacgctcttgaaggcgtcgcaatgaacaccctcctaaattctccatatgaactataccctaacaagtct

SEQ ID NO: 14302 - DNA, 321 bp, Homo sapiens
tgtgcctgtaatcccagctactcaggaggctgagacagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtgg

SEQ ID NO: 14303 - DNA, 326 bp, Homo sapiens
aaggggtaaggtagtgttatatgcaaacgcattaagacgggaaataacacaaaagaaaaaaatgagtcattctaggtggaatgtaccttacaaagaattgggtaagatataaacacggtttatctcattggacaatgacacatcatgggcaatgttaataatctgaggctttaataaaaatagaggataattggagagttttagacagaagagtaaaataatcactatgtttttttataagtacctaattgtcatgtaaagtatattcttggccgggcgcggtggctcacgcctgtaatctcggcactttgggagaccgaggcagg

SEQ ID NO: 14304 - DNA, 324 bp, Homo sapiens
tgagactttcctagccatgcaggactgtgagtccattaaacctctttacttataaattagccagtctcgggtctctcttcatagcagtgtgagaacagactaatgcaggggggctattatgttgccaatcacaggtatataataaaaagttaagaattataatttctaagtggtaggatttcccttaatccttttatctatattttcagaagttttcccaggaatacacatactgcttttgaaatgagaagaatgaaatctcatttatagtctatattgacgtctttgcaatgttcattaatccacctttcaggacagccctgg

SEQ ID NO: 14305 - DNA, 190 bp, Homo sapiens
cagggaaacagggcttgaaagaaagaaggatgggggaaaagaaaagagcccagcatcaaagagaagctggttttgcctggagtggccaagtctacctgacacaggcacaatctctgatctcatccacatggccaggagctggaagtactaaaattagaatccaaagtgttctaggctgggcacggtggct

SEQ ID NO: 14306 - DNA, 326 bp, Homo sapiens
attgttatccgaaatagagaaataactcctgttaatcaagaaaaagacagaaacttcaatgggaaaaaaaggaccaatgaaagagacaaactaccatagatcagatttcttcccatagctaaacagtatacaaagaaacttcatatttataattatacaaatgcaaatcaaggcagtgagtcattactcttatcagaaagactctaatttaaaaggataaacacaacaattattagaaaatgtgcatagtgttaactttcactcacttgtagtgaaaagtagtctggaaatattttatacatcatagagaaattccgagaatcata

SEQ ID NO: 14307 - DNA, 326 bp, Homo sapiens
  misc_feature 220, 222, 223, 224, 227, 228, 231: n = A,T,C or G
gagctagaaatctaggcaatgtggatttcagatgagtttcataacactatctgacacagcgggaagttcaaggaagtatctggcaatattatttttcttatggagcctttccataagaaagaaattcagttataacaaggtcacatttgggtaggtgacataatggtgaaatgacattttctgccaataacaaaacctatatattgtacctgagtggccncnnnccnnaanaattttttttggaaaaaaaatccccccttgtggcccaagttttaaccccaaatttcctattccgcccaactaagcttcttaaattccaggaaaaa

SEQ ID NO: 14308 - DNA, 191 bp, Homo sapiens
aatgatactgtgataaaaggcatccaccagcatgaacttcatatgtgactttgctgttagatctcaggaagatgtaaaaaggcagtttaagatcttttatcccaacttcctggataataaaaagatagtaagtttaggactttataaaagaaataaaatcaagaaagaaatggggcatgaaaaagaataaa

SEQ ID NO: 14309 - DNA, 325 bp, Homo sapiens
gagttttcatttgtggtgagattctctcccaggccacaagacatttcctgctcggaaccttgtttactaattgtaagtactttacaagtaagaacttgttttaaaaacttagcattcaaaaaaaaagctttctttaaaagttatttgattttcttgctttttttcttagcatgctatatttcgagtttcagctaaatgacaaaggacggcttatttatttgctttctttggatgcattcagtcgaaatcattaaattcttgcttaatattcatccagaccccaggctggtttttgaaaggtggggggggggccaaggtttttttg

SEQ ID NO: 14310 - DNA, 319 bp, Homo sapiens
acctatcctcattgtggtccccaaagctcttcctggggcctttctttctctttgacaaagcaaagctaagggagctgggaaaggtgccaagagtgagaagtgagagaagtgatccagaagtgagagctcccagcctcgctgttgactggcctgggaccttcagccctgcctcttacattctcttgcccttcccaaattattaataacacatgagtctgaaatacagtgagctccacagaggaaagacctgtattctctggactattcagaatgttctagggacagtgtgataggaggctgagtccacactctggagctg

SEQ ID NO: 14311 - DNA, 299 bp, Homo sapiens
gcatgaagaaagattggatgcaagacaggtctctgttgctgagatggcaaggatccagtgtgaagacctgatagtagccctaacagctgaaaacagtccctgattaacagctagcaagacaatggagacctcaatcatatagcaacaaggaaatattttcagccaacaaccagaaggtgttcaaagcaaatctctccctccttaagcctccaggtaagaatgcagcctgccaacattttgataccaactttatgagatcctaagcacggagtctagccatgttgtgccagtcttctgac

SEQ ID NO: 14312 - DNA, 320 bp, Homo sapiens
taagcaaattaacatattcagattcccaggatatattttctacataaaaatgaaggatgtatgctattgtatcctaatcgggctaagtatctcatgtacagtcattttgattttacgtatatgtttggatataggatgtctctggaatgatatgaacaactgacaacaatggtagcatctggcaaaggaaactacatagtacaacaatgggagtaagatttccttttcaacaccatacatgtttgttcttactgaacgctattcgatgtgaaaggcagtatattataacggtcaataaaatcaagctctccaggttcaca

SEQ ID NO: 14313 - DNA, 319 bp, Homo sapiens
gacaattttatcccttagaacccagaacagctgggagcagataaaatcttcttgggttatgagttcccagatgatgctgctggcctgcggactgtactttgtgaacttatgctggagcagatggatcagaaaccccggccagaggatgctcaggacccatcaagcccccgcgaggaaggactcagacccccaaccccaccaaattaaagcaggcaatggagaattatactgaagggattcttcggctgggcaaaaacatgattagatctgcattctaaagactgctcgcagagtaaaggatggattggagcagggagtt

SEQ ID NO: 14314 - DNA, 353 bp, Homo sapiens
tacgtttgtgagaagacaacagaaggggagtctcttgcccgtccaccccaagtctgacttctctcaggagggactcatgaacacgtgccctgagcacccccaaaatgacatcacacaagggcagaaaggagctgaagggggaacgtgaaaggcagaaagggagccgtggttgccaggcaaccagccctagcccacctttgtttgtttggtgacagcaactaaggtctggtcagggccggttggccacgctcatgcctttttctctcaacagttgcttctttgaagtagggagcaggctatggtcacctggcgggcctcttcagctaagaccttcacaaagtggggagccttga

SEQ ID NO: 14315 - DNA, 326 bp, Homo sapiens
cgtggcaatctctggttttaaactggcacctggtctagtcaggtttgtttttagattgattactctggtagctgaatgaactatgattttggggaggataagactggaaagagggacactaattttctggaaccttctaaaggataaccaggataattgaggtggagatacaaaataggtgacaaattcgagaagtatatatgaagtaaaataggtaggatttggtgactgatagtggatgtgaggcatgaagagagggatgaggctggcaaatactaagttgttatgatggatgaatgagaggattcccatactgtttgagatag

SEQ ID NO: 14316 - DNA, 272 bp, Homo sapiens
  misc_feature 272: n = A,T,C or G
ggccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaan

SEQ ID NO: 14317 - DNA, 323 bp, Homo sapiens
gtagggggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgcctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaaggt

SEQ ID NO: 14318 - DNA, 294 bp, Homo sapiens
cagccccctattacacctgacgtggagactttccaaaacaccgtaggagattgcttcggcatcgcaatggttgcatttgcagtggccttttcagttgccagcgtctattccctcaaatacgattattcacttgatggctgtcacgagtcaatagccttggtactgggtaacatattctgtgtagtattcataggatccgctgggagtactgtcctcttcagatcagccgttcaggagagtacaggagtgttaacactagttgctgtgccttattggtgtcatcacagttcttgt

SEQ ID NO: 14319 - DNA, 326 bp, Homo sapiens
ggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaaa

SEQ ID NO: 14320 - DNA, 326 bp, Homo sapiens
taacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaag

SEQ ID NO: 14321 - DNA, 318 bp, Homo sapiens
acctttggtcatgcatagactaagatgttttacttactttttcttttatttgccaaaaggaaatagaaaattcagaggcgatgttgacttggggagaccttctgaggaaggaagaaatcccaggtgacctggttctcttcacattcctcaggaagcccgctggtttcaggaagacctgcacaaaggggaaacctgacctcataattgaacaaagctgatttttaaacatgggaagacagggctaatggggtggttgtgaggagtattagtccccttcagggagagaatttaatgactgaggtcacaggagacaatctt

SEQ ID NO: 14322 - DNA, 318 bp, Homo sapiens
ggctgcagtggtaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctg

SEQ ID NO: 14323 - DNA, 318 bp, Homo sapiens
ctccaatccagattttaaacacaatccttctaatgtaatatctgtacctatatagatttagtatgaaaactatacaagctaaaaaatgagaaagcaaggaaggtgaaaagaaaagatgggtagccaattcttccgggtctcagtgggaagaagaaaaacagatggcaggaagtagtatgactctcttcttttttcactgctggttattatttgtaactcacagggcagaataacagctctagagctcaatttatctggaggagattcagcacacctgcttctctttttccactggcatggctcttggtgtaaatttgt

SEQ ID NO: 14324 - DNA, 314 bp, Homo sapiens
tccagaatgtgagaagagcattttaactccattttatgttctcaaatcccaagaaaataaggaatcaagaaaaatataacaagaaaaataaagaggtgttgaaatgaagaaaccttaaaatctaaaaagattcctaatttttttaatgttgccttaaatttttgcattgaactatctccttcaagtttccctaatttatacatgttttacccagaaataacagtcagctatgcatgctaactttaaaaagtcacgtttatcacatgttgttttcagagccaaaagccaaatgtcctgtctcccgatgattccca

SEQ ID NO: 14325 - DNA, 316 bp, Homo sapiens
ttcctctacaagtcaggtccttgaagtgcatgagcagcccactggggcatgaacttggccctaatgctacacataaccagtagggaggtggtgaaaaagggccttcagtggggggaaatttgtggatcaaggcaccagggctttcactgaaaataaccctgagtcagtggtctgcctcgtccctctgcttactatgtagcctagccatcagcacagctgatcttagctggtctctgattgtccctcatttcttccctcaaaagctattcatgagactgggtacagtggctcacgcctgtaatcccagtactttggg

SEQ ID NO: 14326 - DNA, 314 bp, Homo sapiens
cagggcctattatagacaatccattacagctatgtgaggatttggaaggattatctaaaaggcatcactgactgagaatagcttgatagccgaaggtgatatttgactccttcgactacgacaacatcatcatacttttaatatgtacagggcatagatgtatatatatgatcatatggatactaagagaaatttggaaaaattcaacctacattactaatataagaatatagtgacagcacgtagagaaaaagagattacgtgtttgggggaaaaaagacaagcctaatacaaaggaggtatacggctgggcg

SEQ ID NO: 14327 - DNA, 260 bp, Homo sapiens
  misc_feature 260: n = A,T,C or G
gtgtttaaaccacccagtctatggtacttgatgtggcagcccaaactgactaatacaattgttaaaatctaccttccagatttcagtagacacaaaatgaaccagcaacatctcagagattgtgaccctttgtgtgtacaaaagatgagcccgctttttttctaaatcagtgtggaaactaaaagtaaaagtaagttatatcctaaaatgccaaagtttgtcgtaatccagtaatcactgccctctaaaatacgccattn

SEQ ID NO: 14328 - DNA, 313 bp, Homo sapiens
caaaacataaatgtattactcaaaatgttttatataggggcacaagagttctttgactgaagcagtttttattttaagttgtttggcctgaaaccattcctggcagcaaaaatctttttaaaagtcttcatgtgtagatttaagctatccttggcataaaataattaatatatctatatttcaaagagcagatggcagaaaggactataccgaaatatattttatttctgagcaccagcataaaaacaagagaaaaaaaaagaacagccagaatacagaggtttttagggctattctaagtgatactatactg

SEQ ID NO: 14329 - DNA, 318 bp, Homo sapiens
cttccaagtagctgggattacaggtgctttttatgcctgccaggccggacgcagtggctcacgcctgtaatctcatggtaataaattctatgaataaatatagagcagagtcaggggtagagagagctggagggtaggcacctatagggaaggcctctctggcaaggccacacatgagaaatgacctgaagcaggagggaaggagtcatgtgtatatttgagggaaagggtgtttaggaagcgggaacagtaagtgcaaagtccctgagatgagagagtgcttgatgtgtttaaggaatggcaatgtgcagccaggta

SEQ ID NO: 14330 - DNA, 317 bp, Homo sapiens
aggttgaagacactcctaattttcaacgtctcccttagcttcttaatacagaatattaacaagcatacaagtataagatgttgatccttagaaacctagttccaaaaggtcattattaatcacaattaattcacagaatttatttatcttgggaatgtttctataaaacattttgtgactaaataggtaaagctaatggcagtatttaactgaaaaaagtaaaggggtacattgactttaataaaaacagttgaaagaactattcaaaacataaatgtattactcacaatgttttatataggggcacaagagttctg

SEQ ID NO: 14331 - DNA, 319 bp, Homo sapiens
cgggtgcagaaaacacacatgttataaacctatatcataaaagcaccataatgtcaagtacttaaaccataaattggataattcggtcagaaaattgctactgctgaacaaaatggcttaatttttttttttttttttttttccaaaaaaaatttctcttttgttgcccaggacgactataatgggtgacaataaaggtatttgtgacttccttgagttttacaacccttttacatgcttaaggcccctgacttcggcgttttgcagcaggatacccacaccccccggataattctttcttttaagtaaaaatggggct

SEQ ID NO: 14332 - DNA, 310 bp, Homo sapiens
ctgaggttatccttttaattaactctgctttgagaagggctaactgatcagttagcagttgccttatccttttaattaactctgctttgagaagggctaactgatcagttagcagttgaatatgacagtgtagtaatttcattactcaaaacagtaaaaactcaatatgttaagcatacagacatacaaatatgaagactttttttccttttctatttttgttggctaattattgggaaattgatgaattttgttatagcaaaggaacggaattggttagtatttttggtgggaagagaagagctgagcc

SEQ ID NO: 14333 - DNA, 156 bp, Homo sapiens
tagtttaggcaatattaacaccttacatctgtaattttagcattttgaatacacagtttttaatgtacattatccattgggcagatccatagaacaagctaaaactttccagattcacattactttaaaaatattttgatttgctgggtgtggtgg

SEQ ID NO: 14334 - DNA, 318 bp, Homo sapiens
gcttctgagaagtcccacctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcagga

SEQ ID NO: 14335 - DNA, 262 bp, Homo sapiens
gagttccaagtaggtaatccttctgagaagtcccacctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagcgctcccaaacttttgaggaacaaacggaatgcattgtgaacactctag

SEQ ID NO: 14336 - DNA, 317 bp, Homo sapiens
gagcagaggtcagggcttcatataaacagcctggtccctaactgcttcccttctgcagtcaaccccaggaatggactttttgttcagtgtctcctttcatcctctttgaagagatgcaaatttgaacagacggtgtcgctgttgggaactgttttgtccctgccatcaattgtatgttcctctctgtgattatctggtgagacagtgcaaaaatagggacaaaactaacaggaaaaaatacaaggaaacaggaaactctagcgtacaggagttggccagcataatttatttttttcttatgcatggtcatgctatgt

SEQ ID NO: 14337 - DNA, 294 bp, Homo sapiens
tggggaggcctctactgggaaccaccttctgtaggacagtcaccaggccagatccagaaggcttgaggccctgtggtccccatccttgggagaagtcagctccagcaccatgaagggcatcctcgatgctggatcactgcagtgcttgttgcagctgtagaatctctgagctgcgtgcagtgtaattcatgggaaaaatcctgtgtcaacagcattgcctttgaatgtccctcacatgccaacaccagctgtatcagcttctcagccagctcctttttagagacaccagtcatt

SEQ ID NO: 14338 - DNA, 317 bp, Homo sapiens
gtgaacaaaacaggattattcctataaacagataaaattaacagaagaaaacttaaagttcaaaatgtattacttgataaaatgctcgtaatattattttaccatacccattttaccatttaaatattactagttttttttcctcaatatccattgataagcttattctttaaaaacagaagtagggaaagtgctagcttttttgcttcttattcacaggaacttgtgcacctgatgtagtatagcacattctcaaacatctaataggtcacttctgaatttttctctgaattttgaataagataaaagtaatttga

SEQ ID NO: 14339 - DNA, 315 bp, Homo sapiens
  misc_feature 284: n = A,T,C or G
caattctggtagaaaaaatccagaatggttctcagtaatggagctaaatgatttcagctctcctgttctctatagtactcaaatagaaggaggacagtcaccatatttgcttgttgcaattgtgcatgtgggcataagtttcagagatgtatgtcctgttgccccaacttttgcatttcctgtgtcattataaaccttttccaaagcataatgacacaaaacatgatcatatttatatgggtcattagcaaaagggaatagctactcataggagagatgactgngccaagcccaacttggcaacagaatgaagaa

SEQ ID NO: 14340 - DNA, 317 bp, Homo sapiens
tgtggggtacattgtcaagccacaaacataacctgctctgtaataataccctcctacattgttatcttgctttggcacagtatgattcaagtcttaatcttaacactaaaattaagtggtttcactctattaaaggcatcatcctcaactgaaactcactaaagcatatacacgtcacgtggaacagctgaacacaaagctcttaatctgaagttgacctatttagtaaacctatagctcagaatttgacctcatcacctcagaaaatcagggataaaatctgtctttatattgtttcaggtacttgggtatcagag

SEQ ID NO: 14341 - DNA, 318 bp, Homo sapiens
aacactaacccacagggaggatgaaagaggaaagtgcctcctctggctgaaactgccaggatgccctctacttctaaaaacatttggtattttccatagcgcgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccaacaaagccagcaacaccccataccgccgaacagacagaaagg

SEQ ID NO: 14342 - DNA, 318 bp, Homo sapiens
tgccatcagcttctgaatcatgtgtgcaccctaccccacacggcagtggagtggcagctctcgtgactgtaaaagccacacaagctcaaggcaaaaagtggaacatgcaaagggaatgaagtgaagagccaagtcagccacgtctctcttccctccctcacctcccagcggctgcctgtgcccatggcaccgagtaaagattttaagtggatcaagatcttcatgtttggaacaacttggccaatgactttatctggtgcatctgagaaactattgaaaggagccacagctggaggaacacagcacttactagggtgg

SEQ ID NO: 14343 - DNA, 316 bp, Homo sapiens
cctactaggtcaagtgagtaccaaggacagcgtggcaggtgaccatacagacgcctgaataacaggaggcatgctgcattgaggcctacctttggaaaaagataccacgatgctttaacaaccgtggttaatagtgttcatgcctttgttaattgtactcatgaagtagtaataaaggttaatattctccattggcattatcaaatattaaagtactggccaggcgtggtagctcatgcctgtattgccagcaatttgggaagctgaggcaggtggatcactagaagttaggagttcgagaccaacctggccaaca

SEQ ID NO: 14344 - DNA, 316 bp, Homo sapiens
ggagaagaaagacgacagcgggaacacacaagaagaaaacttactcttcgtagaaaaatagaagaggaatggaagacaaaagagatgttacttctgacaaggatggcagaagatgttaaaagagaagagaggatagaagaacaacagcatagaaacagagaagagagtgacaggaaggaggtataaatatttcaggccaaggttcaattatttcagcgcaggtatcacccacgagaaatttttccagagtttcacaggcatttttggatccttcaaaagaagagaaggagacaaatgctgattgcgatggaagacc

SEQ ID NO: 14345 - DNA, 314 bp, Homo sapiens
tactggaactttctaatttgtaaaaaaaaaaaaatcctaaatactcttaaatcaacaattacaacccttcataagccattttgggtaaatttttgttcttttggaaaaaaccacactttcctgtatatgtttcacaaaaaaaaaaagggtctccccattttcccagggaccgagatttaagagttgcttgttattgcagcaaaacctcacctcttctgaccaatcatggtggaatttctgggtgtgcgcccatgtgcctgtgtgagggccgtgcgtgtttcaccccgccgaaaccctcgcctccttaacactcc

SEQ ID NO: 14346 - DNA, 313 bp, Homo sapiens
actttctgctttgccccctccctacctctatgctgatgaagagccagccatgcctccagcccttcctgaggccaccacatgatcttgcttattttcccattccaggaggtcacctgcagggctcctcccacctagccacaatggctagtcccgctgcctccacagtggccctgcagccccatcccagacccactgcacggggtcacaagcttgtgcagggtggacagagcagtagctcatggcagacattccttctgttcatctgttgcagggaaaatggggtgaggcatgggaggggttcccagaatcccag

SEQ ID NO: 14347 - DNA, 313 bp, Homo sapiens
tatgggaggaaaccaagcctcagagagacagaatcatttgtgggagcaggtggagttgaatccaggtccgccggattccaaatccgacaccacctcccactttctgactttgttaagattccacccgcactagcctgggcccgggcaggcctggggtcagtcccccactgcccggctggaccgcagagagcagggcacagctcttcctaccctagttggggccagctgccaagatgcctcttggggttgggaaaaggagctgagctgcttgtccaggctggtgggtgattcctggggcacctgtttcagtgct

SEQ ID NO: 14348 - DNA, 279 bp, Homo sapiens
  misc_feature 264: n = A,T,C or G
aatcactgatgactcttggtaagcccctctgtgggaaagtagtatctccctgggtatccaacttgcagggagtgttcaggatctcatgttctgtagaggtcataaggagtgccagctaatctgggctgtcatgtagacacagctcagtggagagttttctggcaaaaggaggagcaaaggccctggggcagagaaaatcttggagagtacggaaaggccatgagactgaagtgtaataaatgaagcatgaggagtgtgtgcgangacaggacgccaaga

SEQ ID NO: 14349 - DNA, 309 bp, Homo sapiens
aacacaagagtcaacactctgtaattggaaatattaatctgtgtgaaggaaatagctaaattaatgtcaaacaacaatcccgaagacaaagctgatgccccagactcagtttcagttgggattaaatagatattatttcagtgtttattaaaagatgagacacattaactaggttatcactcgtatttaagtttctttaactatacgggtctaatgtaggtactaaacaaagttaaaaatattttaaaatagctaaaaaataagcaaatttgcatacagaaaataaatttattagacacttttacattt

SEQ ID NO: 14350 - DNA, 306 bp, Homo sapiens
  misc_feature 303: n = A,T,C or G
agggggtatcttgtagattaggtagcaaaattggaagtcaaagtgtccagtggcagtggtgaaaagtgttgaccaacctcggtttgatgaaggtggcgtgaaagtcaacttaaacttttcactgggaagcaggatatttctgagcctaatgcttatggagaattggcctctgtatttccctccagactttcatgaggcacccggcttggcccaaacatgagccagatgctgaatggcctgccaatgcctgccaatgtgaaaattattcagtttggttaagaaacaatttactcatattctggnttg

SEQ ID NO: 14351 - DNA, 303 bp, Homo sapiens
ctgcttcatgtttatacctcacgtgattactcatttcaagcatactgtctctttccgagagtaatgatgaaaacattgaagaaaccatcgatccaattacccatactgatcccagaagtataaagaaaatggtaatattcttggatggcttcttttcatatttggtatagcttgatataaagtaggaagcctgcatgattttactgtgctctcagaatagggatttttgttttgctttaacgcaagctgggtgttggaaggagatttgaaacttgtgtttggctgggatatgatgtagacagg

SEQ ID NO: 14352 - DNA, 247 bp, Homo sapiens
tcttacaataatcctgtaaggtaacatatacctctttttataaatgaggaaattggggcttagctaagttaacttgcacaaggtcacccatgtagccaagaagcgttacctagcttacattattaactcatgccacttttattttttgagacggagtctcaccctgtcgcccaggctggagtgcaatggtgcgatctcagctcactgcaacctccgcctccggggttcaagcgattcttgtgccttg

SEQ ID NO: 14353 - DNA, 293 bp, Homo sapiens
gaccagctcaaaagagaaaaaggtgcaaacaatgcgaagaacacttaaggcaagtatctaactacatatttggaaacaagtgaatgaaactgtttatgtaccagagatagaaaaaatattataacagtctacaggtgttgcattagtgttgtgtgcttgtctttacaactaggcagataaataaaaacaaatatgtttttaaaattccaacatgtggtagtttgaaagtgtgtctcaccaagtggaatcataaaatctggctcaaattttagataaatttggacttaaatata

SEQ ID NO: 14354 - DNA, 298 bp, Homo sapiens
gagcctttccatcagcccctgtgctgggtacgggtgaacctggggttcctggtttgagctcatggagagccttgggccactaggggttccccaacgcggtggaaagcccatgagaggaatgtgagctgtgacggaggagaagtgaggcgctattggcataaaagaaaactaatcctcgccacggggagcgggacctgggtctcccatggaaaaaagtgccttcccatcaatccctgcgctgggccccgtggacccaggcgaccctggttctaggcctgggtgcacctcaggcccgcta

SEQ ID NO: 14355 - DNA, 301 bp, Homo sapiens
tttcttcagggaatttatcagctaccttctcccacttgaatactatatttaaattccctgtatatctgtattggaatatgcctgacaaaatataataacctgagtatgtttgcttatagatattacctacaatatagttaaattgtatcattttatgtatcaatggttgaaatactggcctagttcatccactattgttttaacaaaatgttgacaccttcctgttggtttaaatagaatctcccttttctatatctttgctgttactattaatatgacatgtcaagtcagatgtagacaa

SEQ ID NO: 14356 - DNA, 326 bp, Homo sapiens
  misc_feature 206: n = A,T,C or G
ggattctacaagcttttttggtggaaaacaatgataagtaagccctattcatgaaaccgtatgcctctcattttgaaatgaataattgcacgtacagacttataagaataatggcacttatagtgactgctatttttaatgtctttttcaaagtgctcttctaaaacattcttctttgacatttctgattcttttacccagcaagntttatgtatttttctacttctgaggtcacctgagtaagaattttctaacagataccactttttttttttttttttttggaaaaggagtctggttttgcccccaaggttggggggcggggg

SEQ ID NO: 14357 - DNA, 295 bp, Homo sapiens
cacccttcccccatgccaacactgccactggcagaaaactaccgagggagaccagcagacctgtccccaactcagtggtagatgctgcccatgttaacgtgcacacagaggatgtacacaagcccatgccaaccggtgcgctgccaacaccactggcagtgcaaatgtgtgtatgggcaccactgggttcccctacccccatgccatacagccaccaccaaagctgtgactgcctgcacaatggctggcatatctgcactcaccagcacccccctacagttgatgagcatgcacg

SEQ ID NO: 14358 - DNA, 286 bp, Homo sapiens
  misc_feature 240, 258: n = A,T,C or G
gtgctaagaaaataatctctcttttttctgttgaaaactagcacaagtggcctgtgaacttgcttgatgggagaaagcacatttaatctggatgttcatctgcaaagcatttagtttaacagccacagaaaaattattcctgcgtaattgatccgtgaagcagatttatcgtgactagaccatttgtgtgtgtgtgtgtgtgtatgtgtgcgtgtgcgtgtgtgtgagtgtgtgaatganaatcaggatgacggtgtnacaacagcaccctctggagacgatagtg

SEQ ID NO: 14359 - DNA, 284 bp, Homo sapiens
caggtaaattgcctttgcctctctcctgggctagatcctgattcctgggcctgatggcttcctatttctcagttcaccctcatttggtgaaacatatcctcaaatatcttctttaaaaagtcatggccagaaggctgggcactgtggctcacgcctgtaatcccagcactttgggaggccggggcaggcggaccacctgaggtcaggagtttgagaccagcccgcccaacatggagaaaccctgtctctactataaatacacaaaatttagccaggcgtggtgg

SEQ ID NO: 14360 - DNA, 276 bp, Homo sapiens
attcattatattatggtttacttttgctttatactaattattagctcaaaaacatttatttaaaaaattgaactagaattttaaaatataaaaaatttaaactaacaagttagtcagttttactattagcatcaaccattataagtaattcttttctataacagatcaaaatctcagtgaaaattcataaaccacaatagttgtctcaaattatttatgttgtcaaaataacaataagactattgctacctcaataataggtacctcaaaacaaat

SEQ ID NO: 14361 - DNA, 270 bp, Homo sapiens
gaggcacgataaatagtacaaaaggcatacaggtttctgcaatgtgtgtacactggagcccttataatgaagacccagacacaagatgggtgcagaagcttgtctaccatatgaagattacagaaagaatggggtcttggatcacatgggaaaaaaaaaggttatgtgagaaaaggacgctgactagcaacagtggacttattacgtaggcgaaacctcactgggagcagtcctcagagtgcatagagagaaaatgtttctttcagacct

SEQ ID NO: 14362 - DNA, 269 bp, Homo sapiens
  misc_feature 261: n = A,T,C or G
tcccaacactagcttgctatctgagaccatctgcctgctgctggctttcctggcacaaacattctgcatgtaggcacagtgtgctcctggactccatgtcacctcagttcaccctcatgttccctcggttcctgtccccagtccagcaagcagaaactgattacagatcttaacagaagatacagattgaaaataacttgcctgttcccgtggactttatccactagtcaaggaggacaagtggacaaggggagagggtangtgggggc

SEQ ID NO: 14363 - DNA, 429 bp, Homo sapiens
  misc_feature 376: n = A,T,C or G
cccatcgattcgcccaccttcatcctgagcctaaaaggccatctctgagcacttgggcagccactcctctgggcctcagagggccatgagcttggccaggtaggcacagcggcggggaagtcacagctgtcaggtaccggccatggtgcaggtgggaataggagatgccagagctgctttagctgagagaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgctgaaaatcagtaaaggttgattacctggngcgagaccgggtgactgtggcagtgcaggtgaaggtaccctggaccttctcag

SEQ ID NO: 14364 - DNA, 426 bp, Homo sapiens
ggcacgaggccacagaaacatgcccctgattcagtgcctctgcttagctgtaacatgttaatcagaactacctggcatcttcctgaacaagactttcaataggggccagtatgcttcgcttcatccagaagttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaactctggcaggactaa

SEQ ID NO: 14365 - DNA, 427 bp, Homo sapiens
ggcacgagcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctactaggtgctggatgcggccggctcctttgacaacagtagtctctgctccggcggcggggaccaaggcgtggttctgtgggatgtggcatcagggcaggtcgtgcgcaaattccggggccacgcatggaaggtgaacacggtgcagtttaatgaagaggccacagttatcctgtccggctctattgattccagtat

SEQ ID NO: 14366 - DNA, 423 bp, Homo sapiens
ccccatcgattcgaattcggcacgaggaaaccttaaactatataggtctgctggactgtgtggctgagtatcatagagattttcattgtgatctattacctacaaagtcttcctgtggtttctctttaggggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaata

SEQ ID NO: 14367 - DNA, 387 bp, Homo sapiens
  misc_feature 48: n = A,T,C or G
ttttagtttatgcagagcgactggtctttcttagcattttttttgtangtgattggcagaaaataaaaatggccatatgtttgaaactcagcatcatctgccctagggaagtaataaacaaaacaagagagcacaaagactcaaataaagaagcaaatggggcacatcaaaaaaagtctattgagaaaatttaccccagtagctaaagataactgatagtagagtataaattgaggtataagaactctcagtgttcagtatgacagtgggtacacttaagactaagtgcttttttttctcatttaacataatttaatacttatagaagtttcaagaactgtacaaagaatttcagaataatttttacccagatttcccaaatgttat

SEQ ID NO: 14368 - DNA, 415 bp, Homo sapiens
cccatcgattcgaattcggcacgagggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggc

SEQ ID NO: 14369 - DNA, 420 bp, Homo sapiens
gatcccatcgattcgtggagctaggtctccaggtgggcctggttcccaggcagcaggtgggaaccctgggcctggatgtgaggggcggtcaggaaggggtacaggggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcaaaagaagggtgggggacgtgggcaggccaggctcacaggtggaaatcacggatgcagggtggtgcccacgccaaggcctgcag

SEQ ID NO: 14370 - DNA, 383 bp, Homo sapiens
  misc_feature 350: n = A,T,C or G
gacttccggtcggcgtgagcgtgaggtgtgggtgttcgtttctcaagtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccanaggcaaagaaaaaagcttgaggcaaagcgagat

SEQ ID NO: 14371 - DNA, 409 bp, Homo sapiens
ggcacgaggcccggccatgcttgtcctgttgaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactggttgtttaacgaaggctcgaagattatcttccgggtggccctgaccttaattaagcagcaccaggagttgattttggaagccaccagcgttcccgacatttgcgataagtttaagcagataaccaaagggagtttcgtgatggagtgtcacacggttatgcagaaaatatttttcagaacctgggaggcttatccctggggcacccgtcgccca

SEQ ID NO: 14372 - DNA, 396 bp, Homo sapiens
cgttgctgtcgtaaaaattagtgatagaggtagagatttacatatatataaatctcattcattacttactatagaacacagtaattttaatatgttcctttgaaacatatgaagaaaagcagagttttcacatatatgtagttagaaaagggaaagcgctataataacagttagtggatttttttgttactatatcaaactccccacatatttcggaaataagttgcaatgtagaatctgaaagcctatgactaaacttccatactcaagtgttaaaagctattggtttagcatgcactttaagatgatattttacccataagtgatttttgacatcatatattggtcatttgaaaaatactgcttcactgtattatgtaattaattgcataaatg

SEQ ID NO: 14373 - DNA, 395 bp, Homo sapiens
cgttgctgtcgacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgg

SEQ ID NO: 14374 - DNA, 396 bp, Homo sapiens
cgttgctgtcgggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatag

SEQ ID NO: 14375 - DNA, 380 bp, Homo sapiens
tactccacaaatagagatgtatctactcggatcgggggaactgtaggagagaatatgtgaaagccacttcctacgcccaatacgaatgagttgtctttaaacatctgccaggcccaggcagctctccatgcaagtgcaagttcacaaagaagttttctactcctgtcctattccgccttcctttgatcctactctggaagagttagaaactggcaaacttggggtgcaagcataaaaattaggtgtctcatctccttccccactgtggacttctagcctacagaagttcctagctgaatgaaagacctagattttgtactatctcatgtttgggatttggattgagaccacaccatagaagagaatcatgagcctagagc

SEQ ID NO: 14376 - DNA, 289 bp, Homo sapiens
acttgagcccaggaggttgaggctgcagtgagctgtgattatgacactgcactccagcctgggcaacagagcaagaccctgtctcctccttccccgtcccctccaaaaaaaaaaaaaaaaaaaaaaaaaaagggggggggttttttcggggaaccccacggggaaaaaacctttgggggggtggggcccccccccccttaaaggggggggaaaaaaggttttttttgggaaaattgggggcgcttttgtttttttggcccctttaaaggggggaaaaaacgagtaacag

SEQ ID NO: 14377 - DNA, 393 bp, Homo sapiens
cgttgctgtcgaggaactcggccgcccggagttgtggcctcatcgtgcttcccgccaaaaacgccttggtactgtcgggacgcggctaagcgtggacgcgcccgcatctgcccctcctccgcagtggtggaagacacccgcggagcgccggtggataagggccgtttcctgagaccagagctgtatccgcagcagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggcgatcccttattcccc

SEQ ID NO: 14378 - DNA, 397 bp, Homo sapiens
cgttgctgtcgatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaa

SEQ ID NO: 14379 - DNA, 393 bp, Homo sapiens
cgttgctgtcgaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctt

SEQ ID NO: 14380 - DNA, 403 bp, Homo sapiens
  misc_feature 403: n = A,T,C or G
cctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacan

SEQ ID NO: 14381 - DNA, 360 bp, Homo sapiens
gggagtcggagggggcagctagccgagatgacgaggcaccactccagcctggcgacagagtgagattttgtcctaaaaaaagaaagaaagaaaatgaaaacatttcatctggaatatccaaaattaggtttaatatattttaaatctcattagactttttgatagattgctgtaaatattatgtgaaagttatgcttgtcttcaatttcagtggtgttagatatctaaatacaagcctggctatttttggtttttttttttttttaaaaaaaactttggtcttcaacccggccggaggggggggggaacaatttgggtaaaaggaacattggcctccaaaacccccccctttccccggcg

SEQ ID NO: 14382 - DNA, 382 bp, Homo sapiens
cgctgctgtcgttaagtttcatggttaagctgttttcagcaggcccacgagtatcaagaacaaaagggacggtcctccagtaaagatggccatcaaggcagcaaatctaatgactccggggaagaagcataaaaagagtttatttttgtgtaaaggtcacccacgcataattcttcctgtgcccctagcttggcaagcccctttactggaaccctggtcctgatatatgtttaccaggcggacgtctgtgcgtgctttattctcttctttttctttatatagcccccacccccatcccctgcctttttttttttttttggaaaaaaacaccacctttttttggaaaacaaaacaacatttttggggctttcccccccccttg

SEQ ID NO: 14383 - DNA, 360 bp, Homo sapiens
  misc_feature 342: n = A,T,C or G
ggcggctggcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgntgcctggctcctggggct

SEQ ID NO: 14384 - DNA, 337 bp, Homo sapiens
ttatttgggtcttgtgggaagaataattattgctattggttttgttagtatcccaaagaaaagttattatttttaatatacgcacctagatctctgtctctctctacacacacacacacacacacacacacacacatatttacatatagatataaatctggaatgtatctttttatacatacatttgaaatataaatcaatatctctgtatatatccatttatacttatatatatggtcatattggtattatttatagatttaagaaaactactttgttaaatagattggcaagattctttgagtacgatgaaacttcaaattgcctataaagtaag

SEQ ID NO: 14385 - DNA, 329 bp, Homo sapiens
ataagattggatgactgcttgaaagttatatgaaactgtgtaattcagcttgcagaaattaagttccctgcttcatgtttatacctcacgtgattactcatttcaagcatactgtctctttccgagagtaatgatgaaaacattgaagaaaccatcgatccaattacccatactgatcccagaagtataaagaaaatgttaatattcttgtatgtcttcttttcatatttgggatagcttgatataaagtgggaagtctgtatgattttactgtgctctcagaatagggaattttgttttgttttaatggcagctggcgttggaaagag

SEQ ID NO: 14386 - DNA, 330 bp, Homo sapiens
  misc_feature 330: n = A,T,C or G
ggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtn

SEQ ID NO: 14387 - DNA, 322 bp, Homo sapiens
aaatgatacctttaaaaaagcctcttcctaaagacttcttttaagtaaaatgatgatcactaattactttgttgtgagcacaaataagaattactttcttcaaaaattctaactaaataaattactccagtcaaaaagatgtactcaattaattctttattaagggcgttgtaaaatctaagtgattgttccagagaagttaggcagtgccaggaaaatatttatcacttagcttagtaattatttacttagaaaaagttcaaaaaaggccgggcgcagtggctcacacctgtaatcccagcactttgggagaccaaggtgg

SEQ ID NO: 14388 - DNA, 324 bp, Homo sapiens
aaatgatacctttaaaaaagcctcttcctaaagacttcttttaagtaaaatgatgatcactaattactttgttgtgagcacaaataagaattactttcttcaaaaattctaactaaataaattactccagtcaaaaagatgtactcaattaattctttattaagggcgttgtaaaatctaagtgattgttccagagaagttaggcagtgccaggaaaatatttatcacttagcttagtaattatttacttagaaaaagttcaaaaaaggccgggcgcagtggctcacacctgtaatcccagcactttgggagaccaaggtgggc

SEQ ID NO: 14389 - DNA, 318 bp, Homo sapiens
gtgacaataatgtattttataacattaaccatttttagattctttgaataaactcaatttggcaaaggtgcgggtggttttttttttttaaaatagggcttgttaaacttactttttggggaattttgcatttataaccgggccttcatcatttttaactggaaaattctattctaagttataaaacttaaggcaagttactcaaataatacattaatacttgcccacgaatctttaaaagaatccagaaaaaaggaaactcccttttttcttcaatactacctatcctctgccccaaccttttctattcattctttt

SEQ ID NO: 14390 - DNA, 187 bp, Homo sapiens
acacttttaaatatgtaatgcttccaatcttgctttgtgtatctcatttaatttgttataaggtagtactgattttagcatattaatgcgacttcttccttgttgtttgctttggtctgtggtcatccagagagcttaaattgtcattattttgggaagaaaacctgtatttttgttagtttacaat

SEQ ID NO: 14391 - DNA, 319 bp, Homo sapiens
aactagatggagtcctggcactcactgggattgagaacacatgacaaactaataggtttactgggcaggcggctaagctgatctacttgctggttcaattagctccactttccggaggctagcattttcccaaccttgccccatgctcttgtgggtacatttaccctatttggggccttagcgctttacaaatgaacgtttcagtttaagagacattgccgcataacttatattaagtggtatgaattcaaaagcaagctctgccactacacatcagaatccagcactgaaggaggtgtggaagtcataaagatggaca

SEQ ID NO: 14392 - DNA, 174 bp, Homo sapiens
gtagatactatgtgttgaagtctatagctaagcaacttaagccaaaaaggtctttcaactgaagctttaatcaacttattttggagatgttctctttcctttactcatgcgtgattcctaaaataataagatacatgggattaaatagcccttggcttttaacacaaatcaggt

SEQ ID NO: 14393 - DNA, 177 bp, Homo sapiens
  misc_feature 2: n = A,T,C or G
anaaacaaaagccacatcctgttttttatactgtctttttgtggcttgctcatggcatgaattttctagctgtcaacaaagggaggggcgcttttgggctggaggagacaagaagccttcaggaaaaaggagggcttttgatacattttctttctttccttcctttctttccttcct

SEQ ID NO: 14394 - DNA, 392 bp, Homo sapiens
  misc_feature 385: n = A,T,C or G
acagttaagaaaatattacagaatgtagaacaaagaaacaaacagaaaacaaattagtgaaaaaaaattacacacacatacacacacgcacacacttatctatctctctatatatatctagttcagtacttgcaatataggcatcctagagagaaacaatggacaaagtagaaggaaaaatgatcaaggaactaataaaggagatgttcccagactaaatgcagtcataagtctgcagttggagtttgcttactaagtgtccagcacattaaataataaaaggctcacaacctaaacagatttttgagaaatttgaacatccaaatgaaaaaaaatagaaaatcctaagtctttcagagacaataagtaactacaaaggaagaanaatatga

SEQ ID NO: 14395 - DNA, 415 bp, Homo sapiens
cgttgctgtcggtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaatag

SEQ ID NO: 14396 - DNA, 386 bp, Homo sapiens
agaggaggagaatcgggagcagaagaaggaggaagagatgaagagaacaacaaaagaatgaggaaaagagaagaggacgacaggaggaggagaggatgagaaaaagaggaaaggaggaaaggaagagaaggaggaggaggagaaggaggagtacaggagatggacaaggaggaggaggggaccaggaagaggagaagacgacgagaaaggagaggaggagaatcggcagcagaagaaggaggacgagatgaagaggtgaatgagaggaggaggaacggagaacataacgaggaggataacaggagtggacatgactgcatgctgcattcactcggacacgccgccccttatttcaggacgaacccgtggcctatgtgataccgccc

SEQ ID NO: 14397 - DNA, 423 bp, Homo sapiens
  misc_feature 423: n = A,T,C or G
aggcagctgatacactaggcatagagtgtttgcagcacagagaaaagtgcagcagcacctcactcgatcctgctggcattggctttcagctgcttcttaactttgggtgaaacggcagctgccaaccagtcacactggctttttgtgagaccactaccattcccgagatacttctgattagccatgcactctgccatagcctcaggaggttggaactttcagtacctggaagaagagtttttacccaaagaacagcttcttcctttatgatctggccagttgtcagtggaggaaggtgtttgtcccctcaggtggctgaaaggtaactacataattgataagagtattaggaataactatagtcttgcccttcaaactgatcttgaaccaactgtgtacatactttggggcactaaggaaaan

SEQ ID NO: 14398 - DNA, 413 bp, Homo sapiens
cccatcgattcgaattccgttgctgtcgggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattggccgtggcaacc

SEQ ID NO: 14399 - DNA, 333 bp, Homo sapiens
aaccccactgtaggagcactcttgaagaaaatctgccttaccatctttaacaagagtttaaaaatacttttttctttaaaagttacttactgatccagccctttataagaagaaaaacccttagtccccattttctaacagtgaatttattagttttctttaaagaaaacaataataaaagacccagtcaaaatctattttattcatcaagaatcttctcctattgagttgcttcattccattaagcttaaatcagcctagactgaaagaacctcagatacttaagggtggttcattatgttctatagatattctacttatttataatgaggc

SEQ ID NO: 14400 - DNA, 418 bp, Homo sapiens
cgttgctgtcggtgactctctcttctagagaagaggttttcaataacagggcttggaaatgaacgtagaaggggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctct

SEQ ID NO: 14401 - DNA, 389 bp, Homo sapiens
caaatggttcttatttaggaaacacacacattattaccttagaaaatatttcattatatttgcaagctacataaaatagttcttgtatgtgtataatttattttatcctatcattctagaaaggattttaattgggtcttatttttaatgtatgtctatgtaatttccctacttataaaataaacttgtttattataggatagtattaactgaacaaaaggctgtataattttctgtacacatatgaatattttctaactcattttcattcatctcaactttagaatgtctcatttttcttgactaaaaaactctcagagccaacagttatgccctccaaaggaagcaatgcaggtgataataagtgaaaaaatgctgatacagaccct

SEQ ID NO: 14402 - DNA, 422 bp, Homo sapiens
cgttgctgtcgggcaactaaacctgtcctcttgaattacttcttcactgcgctttctgaggaaatgctgattggttactgctaaagattccactaacaattcaaattggggatctttgttcccatggcatgaaaatgcccatgcccgcatgcaaaaatgctgaaggtctgaaagacagattgttttgtggaaagtaaagagctctggtctggaagaaactgtttccctaaagcgtgttcgggtgtgatttgtgtggggggctgaaagctactgcatgaatcataacggctcattgaaatgtatggaccttggtttaaatccagggacccggctcccaaacacactcttgaaatgctgttgaaaactgttttataaagctaagaattgcacttcttgaggtataaaaaccaaacggaagttgg

SEQ ID NO: 14403 - DNA, 415 bp, Homo sapiens
ggcacgaggctgcagccgctggcccgaaaatgctgctcgggcgagcaggggtcaggcgggaaaagaagactccaaatccattctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggaagaagtagtggaaacg

SEQ ID NO: 14404 - DNA, 391 bp, Homo sapiens
ttgtctgtgggaatttcaacagaaggtaatacacaggcaaactacacttgaaggcaacatttctctctggctttccttttctacacagagagatattctaactgatttgcaagggtgcttctcagttggccggaatgagatattttcagatgaaagcctatgactctgtgtcactttcccccttatttttgaatctcatgtcttagttctgcaggcactgttatttttaattattattattatgcctgttgccaagctattccactttacacagagttgattagagacctgacaaatccaggccaacataaagtcctggcttccagatcagactacgtgaacaaagaaaaaaaagaaatctaccaaagtgccagcttttagaaagctctta

SEQ ID NO: 14405 - DNA, 391 bp, Homo sapiens
ttgctctggggctttccattttaaacctgacctttctggctctgggtttttccattttaaacctgacctttctggttccaggtgaaggcagagacagataaaataggattattgtatgtcagtatgttttcaactatttctcctgaaacttggaaacgtattagaccatgtgggataccacgcggacgggaacgggggataaatgtgtgttcatatatactcctccacaaatatacatgtctcaggctgggcgcagtggctcacgcctgtaattccagcactttgggaggccaaggccggcagatcacttgaggtcaggagtttgtgaccagcctggccaacatggtgaaaccctatctttactaaaaatacaaaaatgagccgggcgtgg

SEQ ID NO: 14406 - DNA, 432 bp, Homo sapiens
  misc_feature 432: n = A,T,C or G
ttcttttgcggatccctcgattcaattccgtgctgtcgcttttcattcctgattctttgtatgtgacttgtttttctcctcctttgcctttctctttggaggcctgtaggattttctttttgtccctggggttctataatttcacagtgatgttgtggggtggaaatctttctcattttttgagctgtgtctttgcttatcttttttccatttgggtaacaatctatatgttttgttgggagatcaaacaaatatcagtatctgcatgttttatctcttgggccaattggttttcttagagaagaacctcataatctgctcagggagttagtttaagaccagcatcattgtgggagcccagtggtggaagcaggaatgatgtcctcaccatttggtgtacaggttctcacataatgcctctgttctcagtcn

SEQ ID NO: 14407 - DNA, 387 bp, Homo sapiens
gtgatcaaaagaaatccccagtaattctgaaggccgcgtaaacagcgaacgaaaggagagagggaaaatgatcccggccgcctggaagcgagaggcagccacagacacactgttccggaaaccgcaggatgtaactggggagtcctggagagtgactagaaccggaaagggggcagacgctttgagggaggcaggcgggggaacaaacgggttgcagccagcaggctgggccgaggttccgggggacatttgtcctgggtgttgaagcaagctggctcctggccgcttacctagtatcctgtgaactctcacatggcatcgtcaggaacgaagcgcagccattcagtcaaagcggccggctggagaggcaacaagcaggtgcagctg

SEQ ID NO: 14408 - DNA, 421 bp, Homo sapiens
cgttgctgtcgcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcacga

SEQ ID NO: 14409 - DNA, 422 bp, Homo sapiens
cgttgctgtcgggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagaca

SEQ ID NO: 14410 - DNA, 419 bp, Homo sapiens
cgttggtggcggctgcggccggtttggcccttctttgtaggagagtttcatccgccctgaaatggtgccgagcgttaataactcctcaggtccctgcctgcacagggttttttcttaatttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagag

SEQ ID NO: 14411 - DNA, 417 bp, Homo sapiens
cgttgctgtcggccggtttggcccttctttgtaggagagtttcatccgccctgaaatcttcccgagcggggtaactcctcaggtccctgcctgcacagggtttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggagcagcatggacctgtcagcaactaaggaacaaaagtaatgaagatttacacaaactttggtatgtcttactgaaagaaagaaacatgcttctaaccctagagcaggaggccaagcggcagagattgccaatgccaagtccagagcggttagataaggtagtagattcca

SEQ ID NO: 14412 - DNA, 429 bp, Homo sapiens
  misc_feature 22, 23, 29, 32, 429: n = A,T,C or G
atatccctcattcgaaggtggnnggggtncanaacaacccctttcatgttggaaaggaagctcatcaaacgagctctgggaaagggggcattattcacagagagaaacgacagcatcgtaaacgtgataaggtgctgactgattctggttcattggattcaactatccctgggatacaaaataccatcacagttaccaccgagcaacttacaaccgcatcatttcctgttggttccaagaaaaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcan

SEQ ID NO: 14413 - DNA, 435 bp, Homo sapiens
  misc_feature 382: n = A,T,C or G
tcgattcgaattccgttgctgtcggcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcancaggatgaggagcgcagcaccaggctcaaggacctgctcgggcggtactttgg

SEQ ID NO: 14414 - DNA, 425 bp, Homo sapiens
cgattcgaattccgttgctgtcggcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttca

SEQ ID NO: 14415 - DNA, 397 bp, Homo sapiens
cgttgctgtcggttcaggtcactgattgtttggaaagcctgataaactgccacggccacgaggagtctaaggacacatccaatttccattcgcatccaaaatggaatccgagacagaaagaggaccttagccttcatatctgtttttttcttatgaagcttcttctgggtggaaacttgtcaaatttcatcaggtaagaagtgctaaagtgaacctgtaaactttgtttcaaaaaacaaaaaccgaagtttaagaaatctaaagatggtgtcagccttagacagatctctggactgtaatctgggaaaggtcaaataagatctccaatcgtgtacaattccaaatacatttgagagcagtgggtctgaaaatgtggttcccagaccagcagcatcaa

SEQ ID NO: 14416 - DNA, 391 bp, Homo sapiens
cgttgctgtcgatcatttcatggaaatatattttcttcacatttgggccccaacagcacaggtgttgctatatttttgtggtgaggaactgagacccagggaagtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcagaaactgcacaagaaacaaccttggagttttgaacaag

SEQ ID NO: 14417 - DNA, 396 bp, Homo sapiens
  misc_feature 396: n = A,T,C or G
ggcacgagggctgctccagcagcttggattcagagtgagaaggcataaaggagaatgcccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgttagggttcacaaatgactcttcactgccctcn

SEQ ID NO: 14418 - DNA, 401 bp, Homo sapiens
ggcacgagggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatcatctatctatctatctatctatctatctatctatctatctatctatctatctaaatgacctgacagaagaaaactgttaaaaatggatattattggaggggatttaaaacagtgggtgtgaattatcattctgatggaaagaaaat

SEQ ID NO: 14419 - DNA, 394 bp, Homo sapiens
  misc_feature 394: n = A,T,C or G
cgttgctgtcggtataagagcttttcaagatatttctcgatttctgtaagcactggataattaattcaagaccctcccactttctttgtaggaatagatgaggcaataattttatgactataactgaattttttcacacaagaccttgagatttggtagaaaataggatctgtttgatctgcttgcctcggcctcccaaagtgctgggattacaggcgtgagccaccacgcctggcccttttactgttctataaaataagaagaataaaaggggtatttgaggtacatgcatttgaagttcttagaatgagacctagcatgtaggaaacactcattgttagttgctcctgctattaatagtagtaaataggtcaacatgactcagttaacattn

SEQ ID NO: 14420 - DNA, 370 bp, Homo sapiens
atacacttcgtcatttttttttctctgacagactcagcaagaccaattatattatctaagaactaaccaaggaggtgtatagtttagaagagtcaagaaaaacaggtaaaatatagcaaatatgtaaaacaaaagaaaagccactaaaatgcaaatttctgcctaagtattatatgttatatgctagagaacacagataatcatttgaccaagtaggaaggaaaacaagaaaatgaaaaaagtggaaagaagagaaagtttgtaaatgaaaaaagtttcaaatgctgagtttctaaagaactgagaaaaaaaattagaaacagtgattactaaagaggataaaattttttataaaccatgacattttgca

SEQ ID NO: 14421 - DNA, 375 bp, Homo sapiens
agttcttaatttttaaatttgaagtcaggttttagcatctttaagtttattggctgttttataaatgtattattttccctgtgaaactcctatttgaatcttttatacccccaccccctgtcctttttccccttgtatctttttaaaaaattgatttataaaagcacttgtgaggctgaggtgagtggagcacttgaggtcaggagttctagaccagcctggccaacatggtgaaaccccatccctacgaaaaatacaaaagttagctgggtattgtggagtgcgcctgtaatcccagctacttgtgagactgaagtgagacaattgcttgagcccgggaggcagaggttgcaaagaactcttattgcactccag

SEQ ID NO: 14422 - DNA, 371 bp, Homo sapiens
tttcatttcctgtgtggaaaacaattaagcttataattttgcgttttacagaaacagaatcacttaacttctgaaaggagaaattaatcctaattaaatgaggctgcttttttaaaatccagatattatatactggattgctttggagaaaattttgttttataccagtacctaaatagcttttaagagttcaggttaacctatgctgaggaaattaatagcaaaaagaaaaggccacaatcaagacggaaaggatttaagttttattaatgattattaagtgcattatttatagtagaatccccaacatatgctcacgaaaataaaccagttctaataaatacatgataaagatcacaaaattagaagag

SEQ ID NO: 14423 - DNA, 298 bp, Homo sapiens
  misc_feature 159: n = A,T,C or G
gatatatgtatttatgtctaaaaatggtgacctttaattttaattggggggttggaaagagacagttgaacttaaacacacataaattattcacttctcatcctattacttatcctatccaccttaggtgaagagtaagcgtaagtatttttttcttanatgctaagcactggatgaaagtcctctgacaatcacaacactatttgtcaatacagtagtaaacatttgtttcagatttaaaaaagtcatttatttcccttgcttataaaataggagtcaagagttatctggctgtact

SEQ ID NO: 14424 - DNA, 381 bp, Homo sapiens
ttctagagcacgcaacctagatccctcacatgtgcagttcacaatagggttcacactcctatgacaacctaatgctgccgctgatctcacaggaggcggaactcaggtgggtaatgctcgctggcccaccgttcgcatcctgttgcacagtccagttcctaacaggccacggaccagctgaggacccctgctctagagaatcgccaaatgtgagggtggtcatgaaagtttcaaacaggtgttaaaggcaaagtgatataaaagaatcatcactgcagttttaaagagtcctataaggaagaactctcatctttttctcttgatcaaattcactttcagaccaaagaaacatgcatatagaatttaagcagaatactgtga

SEQ ID NO: 14425 - DNA, 394 bp, Homo sapiens
cgttgctgtcgagcgaatcacctgaggtcaggagttcgagaccaacctggccaacatgttgaaaccctgtctctactaaaaatacagaaattagccgggcatgatggtgggcatctgtagtcccatctacttgggaggctgaggcaggagaagagcttgaacccgggaagcagaggttgcagtgagccaagatcgcgccaccgcactccagcctgggcgacaaagcgagactctgtccccctcccaaaaaaaaaactggcatgtttcatttattagatgtttattttttcaacttcgctttttagaagtcatttagttagggtcattctaaagggtgaagtattgagatttaatacagagaagtctctgaaaatgtttgggccattgtatatta

SEQ ID NO: 14426 - DNA, 373 bp, Homo sapiens
agccctactcctggggtgggagggggctgtaaatgggaattaaagtgttcaaatgagactaaccgtaggggtgaagaaggtgtgagaaaggaaaccagagcttggcttactgcttaaagtcaggaagcgaaactagctagtcttccctataaagatagcttaaagcaaaacaaaactagcacaaatatattgctagccaccatggccaataactgaattaggccagttattggttcagtggatacatctgtgagatccttaatattgctgaagaacagaagcacagaaaccaccagagaagacttatgtaagaatggggatagaggtttaaatcccatgggtggcaggcagcaggcactcacaaacacacacg

SEQ ID NO: 14427 - DNA, 369 bp, Homo sapiens
gcctcaagcagtcctcctgccttgacctccaaaagtgctgggattacaagcatcagccactacacctagccaaaatcttcattttagtacgatccaagggtagtttgtatgatatatccattaaagtttgagatacacttgtctataattttcctcaaatcatgaaatgaaactgaccacaaaattttcaaaaccactgagaaaatttttttcaatgtgtgatctagaatagcttacacggcagttctaattattttgtttgtttacactattttaaagaaaagttcggccgggcacagtggctcacgcctgtaatcccagcactttgggaggctgaggcgggtggatcacgaggtcaggagatcgaga

SEQ ID NO: 14428 - DNA, 235 bp, Homo sapiens
ccacccagagctggtgtctacatccttcagccctgacttccacgggtgccactagccccagaaaacgcaacgcgcctcaggttgaaatcctcctcctctgaaatctatgagcctccgcccccttctcagagacgttccaagcctccactggccccttcaccctctcgtttaagggcaccacattctggcccggcgcggtggctcacccctgtaatcccagcactttgggaggccg

SEQ ID NO: 14429 - DNA, 378 bp, Homo sapiens
aaaatggagacaggcacactagcttcctcacagtagtagctgtaaaatttacgtgaagtaacttatgctaactcatggcataatacttggcatatagtatacaatgactaattttaactactactattataaatatctttattttatttttttgagacagaatggtgctctgtccctctgtcgccgagatctgtagtgaccccatctcttgctttgagtggggcgtcccaagaattataggaacagggctgatgggcatttcagccacaacaatgtccttgacaacaaaaaaaagatcgtgcttcaacaacagaaatgcaatgtttcttttatcacttttcagtgtgatcacagtcattggcgctctggattgcatgg

SEQ ID NO: 14430 - DNA, 404 bp, Homo sapiens
cgttgctgtcgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagag

SEQ ID NO: 14431 - DNA, 402 bp, Homo sapiens
cgttgctgtcggttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtg

SEQ ID NO: 14432 - DNA, 400 bp, Homo sapiens
cgttgctgtcggtcttgctgtaagagaagaacaactgatttttctgatttcttaagcattgtaggctgttcaaatggtagacataatagtgagaagccacctgagccagtcaaacctgaagtcaagactactgagaagaaggagctatgtgaattaaaacccaaatttcaggaacacatcattcaagcccctaagccagtagaagcaatatgaagaccaagcccagatgaaccaatgacgaatttggaattaaaaatatctggctccctaaaacaagcacttgataaacttaaactgtcatcagggaatgaggaaaataagaaagaagaagacaatgatgaaattaagattgggacctcctgtaagaatggagggtgttcaaagacataccagggtctag

SEQ ID NO: 14433 - DNA, 402 bp, Homo sapiens
ggcacgaggccgcacttctgcctgctgtttgcatttctcctggactaagctgctcttgttaatcacatggatgttggcacagctgatgcacttgtccttcattactgtggattatggaatttattggcattggggagcaacaaggtgagagcccttgaagatgactcaagaattcagcctggctcctgactaggaggatggtgattctaataatgaagagaatggggaagaagatggagttttgtgaaagagaggaaattgtgattggttaaggcatctgagccagcctggctgtcaagtatgagaaatgaggacatgatttctggaaacagcatcccaaagatgccgtttgcaggggaacctctactcagcacaaagcatttgagaagggctggttacttg

SEQ ID NO: 14434 - DNA, 373 bp, Homo sapiens
ggattaggatcagaatggttttgtgcttctcaacagccaaattagaatttagaaacaatagagctataggccttcaaattctaaggaggaatgatcgccaacctaacatttgatacttgttcacagaatcaaatggatgtgacacgggaataaagacattgatagatacacacattctcaaaaccatttccttcccacatacctcttcttaggaagtgactggacgatgagttccatgaaaataaggtataaacaacgaaagatgaaaagatacggtataggaaactgggagcaaatggaattatcataaccttgaagggagacccccccaggacagtgtgggttccatataataaggggttgggcctccgtc

SEQ ID NO: 14435 - DNA, 397 bp, Homo sapiens
ggcacgaggagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactggaagttactaatttgattttataaggtttggagcattacagaataactaaactgggatttataaag

SEQ ID NO: 14436 - DNA, 367 bp, Homo sapiens
atctcttccaagtatctttcaatcataattacctattatattcaagacactgtgctaagtactgtacacagcatttcctaaccagtgtcccaggcagggcttggccagctagagtcctagaccactagtctcagtctggaccatttcccgcagtgtgcttcaaagattccgtgtgtgtgccatgatatgaaaaaagtacctgccctcaaagaacttacaatccagtaaaaagaataagtacccaaatcactgtaataaaaggtagtataaggccgggcgcagtggctcacacctgtaactcagtactttgagaggccaagacaggcagatcacctgaggtcaggagtttgaaaacatcctggccagc

SEQ ID NO: 14437 - DNA, 409 bp, Homo sapiens
cgttgctgtcggttcatttgctttagtcttagcgctttaaagaagtgtcataatgttctacaaagacacaaagcttcaggcttatacaaaactgagtatgattagaaatacctgagcccagaaatgattctgagaaaagagaataatttgaagacacttattttaaagtaattatggttagaaatgaattaatttaaacatgtgttcacatatccctttctctaacagtttaacctagacaaacatctgtatcagtatttttttattcccctgattgattacatttggtttctttattctgagaggagaataacaaaaacttcagaaattcctaagggtgtaataagaaagtgggttttgagtttcctttcctggaattattttacagttctttggtgggtctcgtcag

SEQ ID NO: 14438 - DNA, 405 bp, Homo sapiens
cgttgctgtcgatggatttaaacattatagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcttatggaaaaagtatttctttttcagtaaaggaaacctgcccaaaccaaacccaaaattaaaaaattaaaaatattctctatccctactacctaaaaaaaaacccttttaatatttgggccggttccctgccaaggggttttttgggaatacaggagaatttgggtggtttttaaacaaaacaaggggaacattctgaacatactggcttatagtagggcg

SEQ ID NO: 14439 - DNA, 404 bp, Homo sapiens
  misc_feature 229, 404: n = A,T,C or G
cacattccgttgctgtccaaaagttgtacaaaaagtgatttcatatttggtttataagcatttatatgtgggggttatttggtcttttgctttttccatcttaaatatcatcatggctaaaacttaagggtatttatagtttaattccatttcagttttatagagggcagtaattattctgatgaatgttgaattaagaaatggatattttctttctctgttgtgcagntattggtagatcaatttcttataacccacaatgtagcatcaataattgatagcatgtattttatttaattacttgaattatttagacttgatttctctaattttttccataaaaggactgaacagcacctacttgtggtctggacagcttaacccaaagttcctggaagaataan

SEQ ID NO: 14440 - DNA, 402 bp, Homo sapiens
cgttgctgtcgtgaagactggatatcaaatatctgtttttagcatcctatagtctgcacatggtaaatacaacttgtgtacttagctcttcagaccacagccctaattttcattttcttgtctttatcatattagaactactaagcagatttccaaaaacaatccatgagatgaagttagagggatagaaggaggacaatctgaaaaatatgaagtgattaaaaaacattgttctagctagttgctcacattcaaaaaaaatgttaaaacccaattagaaacaaaagtcatagaaaatgtgagcatattgtgttccttaaataaccagatgttctttccttcctgaaggcagtaagggctaggaaaaaaggtttaaaactattgttttaagttaacggtgag

SEQ ID NO: 14441 - DNA, 398 bp, Homo sapiens
gcacgagggcatttgtttaatttatactggttacttatttacgggggaggggacatgaaggtaggtaaataggtaggcctctaattgaaccacctctctaagttatgtacgtatatataagctgaaattgtgtttgacattctgagggttttctttttctttttcctttttttttttttgggggggggccggggggaaaaactttttttttaaccccgggctgaatacccacgctaataatcaaatataaatgagccctcgccttttgaaataaaggagattccccggccaaactttttggagaactggaaaaaaaagggccccccacccacccccttatattttgtttttaaagaagagggaagtttcccctttgaggcccaggccggtcttaaccg

SEQ ID NO: 14442 - DNA, 400 bp, Homo sapiens
tcccactcgattcgaattccgttgctgccgatgtggcttttatttgtactgctcatatccactgtacagccacttgggagtatcgtgcgtagcttgcagcaactgctgactgcatttatactggttattgcatattcttttccctggaagcgaaagagaaatgtttttcttgttgcattgattacattttataaatttgcttaactggaaagtttgggaaaagaagcctgtttgtcaattgtacaaccgattgtgaagctctagtgtgaatatttttacgtctgtattaaacattttctttgcaaatctattgttcgattgaaatgtaaatgaaattaaagatggtgtacacccatcatgtaaaaagcaggcaccatctcttagatggatttaacgctcc

SEQ ID NO: 14443 - DNA, 397 bp, Homo sapiens
cgttgctgtcggtcttgctgtaagagaataacaactgatttttctgacttcttaagcattgtaggctgttcaaaaggtagacataatagtgagaagccacctgagccagtccaacctgaagtcatggactactgagaagaaggagctatgtgaattaaaacccaaatttcaggaacacatgattcaagcccctaagccagtcaaagcaatatgaagaccgagcccagatgaaccaatgacaaatttggaattaaaaatatctgcctccctaaaacaagcacttgataaacttagactgtcatcagggaatgaagatcataagaaagaagaagaccatgatgaagttaagattgggacctcatgtaagaatggtgggtgtgcaaagacataccagggg

SEQ ID NO: 14444 - DNA, 369 bp, Homo sapiens
tactcatataatcttcattacaaccatcttagtaacctgtagttacaagaaaaacaaaaatgttaagttgtaggaatcatattctccaaattattttacattaaagaccactgacaaaggaatcactagagatgttattccactatcaccaaatagtatattgttaccatctgttaacctacaaccttgggtaagatgggataagttaacatcagttgcaacatacacattcaatgtaaaatagctttaacacaataacaactattttggtttattgaaacaagttcacacattgtcattaaaaaggcattttgaattcactgtatttttattaccttaattctgttgaacatgggaaagagcctggtc

SEQ ID NO: 14445 - DNA, 405 bp, Homo sapiens
tcgaattccgttgctgtcggtctccttgaaaagttgatggtcctgcagccgcacaggcagttgtgggcatggtgggcgctgagtctggaggttgttcaaggccagcagcgttgcccggagccctgctgctgacgctgccgtcactggttctagctctcacattctcagctgcacgtttctgtttccacctcagtaaacgcaaactcttgttcataggcacagctgtcactgcagcacacaaggactcaggtttgtaaagacaaacgattgatttgtgtgtgacgtgctgcttgtttgcactggattttgcaaattatttactaaagaaaagtacttcagaccttttgtggcagacaataaatacagcgatactctaatcttcagtattcataaaaatgggtgaag

SEQ ID NO: 14446 - DNA, 408 bp, Homo sapiens
tcccatcgattcgtttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagggactgaaacaatgagaaagaatacagcacaacccttggacaaaatggaattagaaaatatatttaggtttatagcagaagcaagttcaattggttggttggaaag

SEQ ID NO: 14447 - DNA, 369 bp, Homo sapiens
aggcccagagtcgggggaagttttgtgagagaagccacattagagaccagaggagaagtaccaatttgggatgaccttctaccaaagacctcaccgatttcaaggacagctcagctgttcctatcctctttccctcattgcactgttttctgtttatatttatatatacatttgtaattacttgactaatatctgcacacattgcctgctctaagctcttcagcatcagtcttttttatcattttgtcccacagtgtttgacaagcaatagttactcaataaatatcatttgaatgaatgaatgaaccagtaaacgaagtgacatttgaatatgcaagaaacccctaagtttgagaatcctgttggcag

SEQ ID NO: 14448 - DNA, 363 bp, Homo sapiens
gacagataggagaaagctatcatatattatgttctgtagaatgcttcttttggtggcatcagaagaaatgacccatgtttgaagatctgaatttaattaagtctacacagaatatagtttaaaggcgtgaagactttgctattagtataataaatactttttcttaagacattgtttatctacagaaggactaccatattcaagatttaaaggtagattgtttttgttcacatcattttgatcttaggttttgctggaagcattcacattaagggggcctttaatttatgtatgctttaagaatacttaatagctaatctacatattaaaaaaaaaaataccggcctaggctcggtggcttaa

SEQ ID NO: 14449 - DNA, 361 bp, Homo sapiens
gaggattgtaacagggaaagcatttagggttttcaggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccc

SEQ ID NO: 14450 - DNA, 369 bp, Homo sapiens
cacatgcaacagaaaggcacagttttatttcaaacaaagcagtgttttgctgtaacaccgttaaaaactggaaaggaaaactcaatcaaaccaaaaactagatgcttaggaataaatggtagaattcttacaaaaccaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttccaggactctgcttctttccctctgcccattaacaatgcggggttaaaagtgacttcctaccactatgtttcttac

SEQ ID NO: 14451 - DNA, 407 bp, Homo sapiens
  misc_feature 407: n = A,T,C or G
ggcacgagggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggaagan

SEQ ID NO: 14452 - DNA, 411 bp, Homo sapiens
  misc_feature 411: n = A,T,C or G
cgttgctgtcggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcn

SEQ ID NO: 14453 - DNA, 404 bp, Homo sapiens
  misc_feature 404: n = A,T,C or G
ggcacgagggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggan

SEQ ID NO: 14454 - DNA, 403 bp, Homo sapiens
ggcacgagccccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactcttcactgccctcttggatgaaataaactggttcccatagaaatggaccgtctctgatttcacagtctaa

SEQ ID NO: 14455 - DNA, 394 bp, Homo sapiens
  misc_feature 394: n = A,T,C or G
gcgttgcggtcgcaggatgattctgaggatgactacggtgaatttctggatcttgggccggctgggggctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctgggtagatcatccttacttccagtctctgaaccaacagccccgtgaaataacaaaccaggtcgttn

SEQ ID NO: 14456 - DNA, 385 bp, Homo sapiens
  misc_feature 258: n = A,T,C or G
ttccttccttctctctagcatcatattctcagaaattcttcctgtgttgctccattccagttcttataagtgattgttgcatgtggttttgtctagatttatctgtttttggtggaagagttattttaatacaagctgcactggaactgacttttgaattgaaacctctttccatgcttggttcaaaccaatccctatacgtaatggttatgagcccagagttggagccagggtcctgaattcccacctctgacactntctggctcttaatctctgactatttgcttaacatctatgtgcctccatttctatataacggtttttacgggttttatttattaaacaaatggggatacccggaccccgcgtgacacctggtcaatcg

SEQ ID NO: 14457 - DNA, 365 bp, Homo sapiens
atttcctttgtgtttttctgtaatttacagattttttttcctcagtgagcaagtattacttttataaaccgaaaaaaccctgtatttttcatcgagtatttaattaacttatgaagaaggttattcattgtggcattgtttgagtataaaataacgaagtccaacaacagaagacgggttaaataaatcatgttatgtccatgctgtgaaaactatgcaactgtttaaaaaaatgagacacatctatatgtaccattatggaagaatcccaaactataaggatccactgaaaaacaaaaggaaaaaaaagatgaacaaccactttggaaagcagtttggcatgatttactgaagtcaaaggtatg

SEQ ID NO: 14458 - DNA, 362 bp, Homo sapiens
  misc_feature 181: n = A,T,C or G
aagccctgtggctgggtaaaaatacaaaattagctgggcgtggtggcacatgcctataatcccagctactcgggaggctgagacaggagaatcacttgaacccgggaggcagaggttgcggtgagccaagatcacgccattgcactccagcctgggcaacaagagcaaaactccatctcanattaaatgcgaggcaaataaaagaggggggcggttttttctcgaatgcccaggttgaaaaaaactttttgggggcgcgcgcccaccccccttgtttgttgaggaaaaaaaagggctttctttgacaattgtgtggcccgtgagggcttctggggccccccctataaataatagcccctacc

SEQ ID NO: 14459 - DNA, 366 bp, Homo sapiens
cctgccctcctccacctgacacccccaaccaggcctggggctcggtgcctccagctccaagtcctcccctctccaacagccacttaaaggcctccctctggctcttctcagagaagaaaatcacaacaaggagagagggaggaaaggcagtacttcagggcatggattcaaatctgcatgtaggagatggaaaagcaaggtacgagatgggcagagacacaggaagagcaggagatgtagggtgtggccttatcacttgctgggaggtaggggtgggacaactgagtgaggagctggcttatagagcagactgtggagtttagtcctgatggaggtttctgaaagagacatgggggtggtgggtgc

SEQ ID NO: 14460 - DNA, 391 bp, Homo sapiens
ctgcggacctgtgacccggcgacttggggccctgatgtctggattctttctccgatactgagacacggcgcgtaggtccacaggcactatccaactggaagttgaattgtgagtgagagtgaacaggaaccttccggcttccggagggttgtgtggccagtgactcaaagtgagaaggccctcgaagtcgtcttacgtctcatgcggcgcctcgcccatggtccttcttgtctcgcctcggtcataactaaggaggaacgagggccgaggagtgtaagggctcactcgaagcttgggtgctgtttgcggtatccgaatcccactagcacctggaaccccgactgaagactctgcactccccacacggaaccaggagaggtacgccatgacg

SEQ ID NO: 14461 - DNA, 375 bp, Homo sapiens
  misc_feature 357, 375: n = A,T,C or G
ggaagaaagagcttcctgcaattcaaggactgtacaaagctgaaacgcagagattttcatattatttgggagactcagaaatgagcttttaaggttgttccttgacttgcgggtcataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactcctcagaccagaagaanatcattagcctatggtcn

SEQ ID NO: 14462 - DNA, 394 bp, Homo sapiens
cgttgctgtcggtcacccccctcaggagccactcccagggccctgtggccattcccagcctcctctgcaggcaccgagtgagcagcgctgggattctgggactggagagggccctgggaaccctccaggcctgccccctggtgggtgagcctggttctggggcctcccggagaattttttttttcctggaaaagagggagggtaggggtggagcgtgacacctgggcaggtgtcccttgtctccatcctggccctgcatgctgttaactcaggtggtgtggctgcccgagcctgggcacagccaccgcttccaggtgctgagtgtggccaccgacgggaaggtgctactctggcagggcatcggggtaggccagctgcagctcacagagggctg

SEQ ID NO: 14463 - DNA, 395 bp, Homo sapiens
gagcatattatcaaggtaaaatgcagcgtgaatagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattg

SEQ ID NO: 14464 - DNA, 408 bp, Homo sapiens
cgattcgatgggtggtccggcatcctcagggggtgtgtgttgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggctccatgtcagaacccagaaaggtggatccccccactgttgactgcatgaagtttttggtaccccccttttggtccagaacccgtctgcctttcccttggggacaagggggccttttgatggcactggttgtgacctggacccagccccgcgctggcatgatccagaaatggggcccggacatccttgcgggcaggaggcaccgtcc

SEQ ID NO: 14465 - DNA, 362 bp, Homo sapiens
agatcagaataagagtctctaggttatctgctcaacagaagctaagaccactctgatagtcattataacagtttttctttagttacttccataattagatttgtttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatggtatctgcctcaacgaatcagaacagacagtcgcgcttttct

SEQ ID NO: 14466 - DNA, 388 bp, Homo sapiens
cgttgctgtcggaacacgcggctagaaatcatctaccccaggaatttttttttttttttttttgggggcagttgggaaaaaaaaaatggttaaataaaaaagggttttgttggggttgcccggaaaaacggttatttttctccctatggggaaactgggggagtacgctaaaattttgcgaaccggggttgggttaaaccccccccaccggcctcttttgcgggttaaaattggaagaggggggaaaaggtttccttttatggggggaaaaattggatttatagtcaaaagggggcctatttttctgcctgagaaaaaaacccccccgagggccaagggggtccctggataaccccccggaaccaaaaaggaaagggggcgcttcctt

SEQ ID NO: 14467 - DNA, 408 bp, Homo sapiens
cgttgctgtcgggacatggcacctttcttctgtttcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacgggagcaacagcccttagcaagccagagctgcatcttcattctggtgtgtacaggcgtctaaccatcccaggaaccccaacagtccacggagcctggtccttggaagagg

SEQ ID NO: 14468 - DNA, 393 bp, Homo sapiens
ggcacgagggaacatgggctttgcagcaaaagcgatgaaatctgttcatgaaaacatggatctgaacaaaatagatgatttgatgcaagagatcacagagcaacaggatatcgcccaagaaatctcagaagcattttctcaacgggttggctttggtgatgactttgatgaggatgagttgatggcagaacttgaagaattggaacaagaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctacctaaac

SEQ ID NO: 14469 - DNA, 400 bp, Homo sapiens
ggcacgaggccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccg

SEQ ID NO: 14470 - DNA, 408 bp, Homo sapiens
ggcacgaggcctctcggcgcttggatattaatacggtcaccgtggagtttttcctggtgggacaagacaacgggccggtggaggtgtccacattgcagtgcttagcgaatgccacagacggcgtgcggctagcaacccgcatcgtggacacaccctgcaatgagatgaacaccgacacctttctcgaggagattaacaaagttggaaaggagctggggatcatcccaaccatcatccgggatgaggaactgaagacgagaggatttggaggaatctatggggttggcaaagccgccctgcatcccccagtcctggccgtcctcagccacaccccagatggagccacgcagaccatcgcctgggggggcaaaggcatcgtctatgaacctggaggcctcaacatcaaag

SEQ ID NO: 14471 - DNA, 381 bp, Homo sapiens
ggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcacgctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctttacagagagattttgaaacactgaaagagataaatgatggcgaaaaggcgg

SEQ ID NO: 14472 - DNA, 402 bp, Homo sapiens
ggcacgaggggatgtctctggcgtggtgatggaatgtgggcttgatgtgaaatacttcaagcctggagatgaggtctgggctgcagttcctccttggaaacaaggcactctttcagagtttgttgtagtcagtgggaatgagggctctcacaaacccaaatcactcactcatactcaagctgcctctttgccatatgtggctctcacagcctggtctgctataaacaaagttggtggcctgaatgacaagaattgcacaggaaaacgtgttctaatcttaagcgcttcaggcggagttggtacttttgctatacaggtaatgaaagcatgggatgctcatgtgacagcagtttgctcccaagatgccagtgaacttgtaaggaagcttggtgcagacgatgt

SEQ ID NO: 14473 - DNA, 396 bp, Homo sapiens
atcccatcgattcgaattccgttgctgtcggcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctg

SEQ ID NO: 14474 - DNA, 409 bp, Homo sapiens
cgttgctgtcgagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagtc

SEQ ID NO: 14475 - DNA, 399 bp, Homo sapiens
ggcacgagggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattggtg

SEQ ID NO: 14476 - DNA, 403 bp, Homo sapiens
tcgaattccgttgctgtcggcctgggaaactaaaattatttccagagagaaacgacagctgcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgag

SEQ ID NO: 14477 - DNA, 399 bp, Homo sapiens
ggcacgaggcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgctt

SEQ ID NO: 14478 - DNA, 349 bp, Homo sapiens
tataaatattattgtatctgctttcattttattaaaattatcatttattttgtttataatcagcaatgcattatatttttgaactatgcaatatttactttatttttttagcaactccttttcaagaaactttttttaacaatcaaaatacacaatattttaaatagcaactgttattccaatattctatataaaatatgtcacgtacacaaaaagtcaggtttgtcagatattatgaaatctgtatataaaatatacacatatacatatatgtatacatatacaagcataagtacttatttattatagcaatctatgctttttgaaagacagtatggaaacaagtgaa

SEQ ID NO: 14479 - DNA, 350 bp, Homo sapiens
  misc_feature 294: n = A,T,C or G
gtcatctctgactagttgtgtaaacttaagctacttaacctctctcagctcagtttctcattgtaaataagtaaggataatattttttaccccacacaactattaagagagttagatggggaaaaatgcatggataatatgggctaccttggttgaagctgaggctcagctatacctacatgtgaattttgtcactatgtacattggttttgagcagtgtgactttttcactcagacaaatgtcttagagctctatgtatgttagaacaaagagagtggcctcctgccttttanagagccttacaatatttcatagtaggtattatgcaaacagaatacaaaaaagagct

SEQ ID NO: 14480 - DNA, 336 bp, Homo sapiens
tcaagagctcgaaaacaatctcaatcatttacagggttgtgatcatttcacttgcattaagccaactaaagttgtatttgtaaaagtaatgctatgaatattactatttgacctagacacataggttagaattggaaacacaggctataaagtatagtaattgtgtaattgtgaaaatattaaggcttcaactcaaaactgaaacacagtagggcttagaaatctttgaattatttatacccctcagtttaaaaacttccagtccaggcgcagtggctcatgcctgtaatcccagaactttgggaggccaaggcaggcggatcacctgaggtcagg

SEQ ID NO: 14481 - DNA, 339 bp, Homo sapiens
ccaaggtacggctgctagaacacgaccgaagggccatagctaaattatctaactatgttataaacattgggaataactatgttataaacactgggaattacagagaactagtctggaatggggctgactctaaaaatgcttataatcgcttggagaaacttggtcgtgaataccaagacaataaaagtcaaacaaaatccttaatttagtttactgcagttgttcatgtggcactgggccctatggaagcccaaaaaaagtattcgtattataagtaaagctgtgccaaaacatgttaaagacttatatttctttatacttatagaaatatttagagag

SEQ ID NO: 14482 - DNA, 310 bp, Homo sapiens
cgggtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactgtgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacat

SEQ ID NO: 14483 - DNA, 359 bp, Homo sapiens
aggtgggtttgtctagttttatctgtttttgggggaagagttattttaatacaagctacactggaactgacttttgaattgaaacctctttccatgcttggttcaaaccaatccctatacgtaatggttatgagcccagagatggagccagggtcctgaattcccacctctgacacttctggctcttaatctctgactatttgcttaacatctctgtgcctccatttctatataagtgtttttaccggtattatttatttaataaatggagaaacaaagacccaacatgacacctggcaatttggtggcagaacctaaatctcaggtgtcctaacttccagtccaaagcatagagaaaa

SEQ ID NO: 14484 - DNA, 355 bp, Homo sapiens
ctttactttgcagtagttgctcaaaattacgagtaaaagaaaggaaaatagatagcttcaggaatgatggaggggagaggaatggcctaaaagcaggatgcatagtggtgaaaagtaaactattttacagcttcatctggagttggaccaatatagcataaaacatttgaagttagtatgattgtctgtagccatgtggctggatgaatccacaatgatcgttaaaggggccactgacaaataccatacaaaaaactgtgacttatctacctagtcatttacatcattatacttctcacagtgaagaatgagaaagtattttaaaagtagacatagctttaaaagatgtgctctg

SEQ ID NO: 14485 - DNA, 340 bp, Homo sapiens
tacattgttcaggtcttctgtgttcttacccaggccccactcaacctttgagctattccagtatgagagtgaattagacctcccactatcacggtcttactgtcatttctcatggcattagtcttaatattttttatatggtaattctatgttcaagactgtgaacatattcaggttccaagttattttgtgttcattaaaaattttactttgaatcattatgaatagttcctaggttgagcttcgggctccctgaccccagagcagtttccatttgcacgtgttgaccatattctctaacccgtcccataaaattgattctactatttcctgcttttgg

SEQ ID NO: 14486 - DNA, 358 bp, Homo sapiens
agaaattgaactgaaccgtaaaggatagctgagaacagaaaatgcttgagaagaatattcccataaagaagtgataggaattaaaacagcaaatacagtttgataccaggtaatagagtggcttgaatccagtttagggaatttggtttgggtgtgtatatgtgtgtgtgtgtgtgtatgtgtgagagtgtgcgtgtgcgtgagagagagagattgcacatatatattgacgtgtgactaaatagcggctgcaacctgaacagtctatactcttggaaacccacggggtgacattgtcttgtgcctggtattggaagcacttattggcaggcagatgatggagacttagtatcgaggg

SEQ ID NO: 14487 - DNA, 340 bp, Homo sapiens
tatctacgggatcataagtctaggtgtctataattcagaaaactacctttcattgtgtatttgatgtttttgtatatccagagcgtattaataaattgaattttaaaagtctcttaaattaaaggagctaggttgggcgcagtggctcacccttgcaattctagcacttatggaggccgaggctggtggaatcttcagaggtcaggagttcaagaccagcctgaccaacatggtgaaaccccgtctctactataaatacaaaattagcagggcatggtggcatatgccttgaatcccagctactcgggagggtgaagcaggagaatcaccttgaacccct

SEQ ID NO: 14488 - DNA, 353 bp, Homo sapiens
  misc_feature 353: n = A,T,C or G
aggcagaaatttcccataatggtttacaagcttggtggaatatcaaaccccatcagctcttggaatggaaaagaagttctcacacaaatctaagacctaccaataataaagataaaaacaaacaaccaacaaaaaaaattttcaaacaaaaagaaaaaaagggacccccccccttttttttggaaaaaccctggtttttaaggccccccattttttctcctaccaaaaaaaaaatttggtacaattttttcaaaaaaaaaaaaaaatgttgggaaattttttaaacggcccccaatttaggcgccaataaatgggcgaaaaaaaaaaaaaattttccctggttttaaaaaccn

SEQ ID NO: 14489 - DNA, 385 bp, Homo sapiens
cgttgctgtcgataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcaatagactatgaatgctatttctagaaaaagtctagtgccaaatttgtcttattaaataaaaacaatgtaggagcagctt

SEQ ID NO: 14490 - DNA, 351 bp, Homo sapiens
  misc_feature 192, 193, 195, 196, 197, 198, 199, 200, 201, 202, 204, 205,206, 207, 211, 212, 213, 217, 219, 220, 221, 228, 235, 237,242, 276: n = A,T,C or G
gaactgtgatggcctaggggatgagataatgcagcaaaataaaactgttcttcctaccatttttgtgcagttattttttgatttttttgctccattgtgttgtgacagtatcttacctacacttctgagctctcctagagctatttttattcttggatagctaattgtgtgtgtgtgtgtgtgtgtgagtgnntnnnnnnnntnnnnttcnnntttntnnnttttttnttccctntntcttnttttttttgggggtttggttttttttgtgctggnccttttgttctattggggtggtgggggtgtttccttgctgcccttgttgggggcccctcatttgtttttttttac

SEQ ID NO: 14491 - DNA, 341 bp, Homo sapiens
caaattattgatgccaggctgaaacttctctttctttaaataaagcactcttgaatgtctcctttatgttttgctttgtgatcatacttcagttaatttttcaagaagaaaaaaaagaagatgaagataaggatgatactgaacattactaaatgattataatctccccgccattatgctaatcactttgagctataatctgttaatatcagggaatattttattttttagagaatcagtattttctcagtttcatagagatgcatatgaattgagtgtatcactagggaagcggaaccactgagcaatacaaatgaggaatttattttaggccgggcgcg

SEQ ID NO: 14492 - DNA, 345 bp, Homo sapiens
  misc_feature 345: n = A,T,C or G
accacatggctgcctatgatacagagcctgcttttgataatactactgtactaatcataccactttagacttcagaatgacacatgtgtccatagataatagctaggttgggctgaggtgggattatcaaaggtccaatgtgaaacagcacggcacatagtattgcccgttttaaacaaaacaaaggctgagtgtatgagcaatatatcatttaagacacttctcaagctgcagtgttatggaaaatggcagagtgaaaccagcaatccaaagtaaaatataaacaacaaataccttccaaagactctttaatatacacataaaatttagacctactttgagccn

SEQ ID NO: 14493 - DNA, 355 bp, Homo sapiens
atgctattcaggagaatcaaagtaaaccggtgcaaagaagcgtttgacaattatgagcacactttgttccttgggaaaacatacttggttagttagaaaaaacaaattaaaagaagaatgagctacatgttgtactaatacatttcattcttcttaacactaatgcataccttgaggtccttagctgtagcccctaccttccaggttttcatagagtggagttgaatatcaacaaaattaaataccaacatttacataatacaagctatttaaacaatatcattgcatttatttggggcttcaggtaagattaaattaattgtttaaaccatgcactttttgaaaaataattact

SEQ ID NO: 14494 - DNA, 383 bp, Homo sapiens
  misc_feature 165, 166, 167, 168: n = A,T,C or G
cgttgctgtcggtcaggatggtggattaacctgtacccagaatacttattgttcattttgaaaagactttgttcttttcatttttatttgggagtctttgtgaccagagaagttagggaggaggttatttttgtgttttggggttggctggttggttggctttgnnnncggccctacatgaccgatgaacaaatggttccagatggctctgtgtccataggcagccttgaatagggctttacacactctgagacaatgacagcctgtgttgactgaaccctgacttgtgttcaaccctgccatagtgccagtgcctttgcatgaattcgataatttgagcctagcactcgccttaagagggtggctctggtacctccccgttg

SEQ ID NO: 14495 - DNA, 360 bp, Homo sapiens
  misc_feature 331: n = A,T,C or G
aactaatttgtacagatttaaactacaaactcccttccaccgcttgtacagtagctggtatctttactcaagtctcacagtttcagctgctgatttattttattttatttagcctggttccttggcatttgccataggcttgcataaaatagggtcggccaaggatttgaagagagtatatacaatgatccctcaatatccatgtggtttgattccaggacccctgaggatataaaaatccacatacgggcagtgtgtgatggctcacacctgtaatcccagcactttgggaggtcgaggtgggtggatcacctgaggtcgggagttcggngccagcctgagcaacatggagaaaccccg

SEQ ID NO: 14496 - DNA, 353 bp, Homo sapiens
atatgttcattgcaacactattcacaatagcaaagccatggaatcaacccaaatgcccatcagtgacagactggataaagaaaatgtggtacatatacaccatggaatactataaagtccattttaactagacatccctgctgaaatccgttcctcctgccactgtctacctattgcagatctgcaaatctccaggtctatgaaactcaatctttcaaacagtaacctggtctaagctttattctcctattacataaagccacaaaggttatgtccattttgcataagaagaagctgaggcctgaaaggctgacttgcctatagtgtgtcccaagttagcggtggaagctcgg

SEQ ID NO: 14497 - DNA, 309 bp, Homo sapiens
ctaccattttaaattaatttagcattggtctgttacaaagtgcatataatttagattcagaagaattgggcttcagttatacttttgtcactttctcaatatgtaacctaggataaatcgctccctctttttcaaatttgatgtgtacaaatgtaatatgaagtacttggcaacgtcaggaacatttgataaggcaaggtatataaagatatgtgtgtagccaggcacggtggctcatgtctgcaatcccagcccttggggaggccgaggcgggtggatcacctgaggtcaggagttcaagacctggcg

SEQ ID NO: 14498 - DNA, 344 bp, Homo sapiens
aaacaagaagaaataactgttatcagaatctggagagaaagttgtatggggagggctacctgacaggagctgtgacttttagtagaggggatgcagttagccatggattaccctgaggtgaatgaaccaggctaataaatataccagcaacctccctccaccatcaactagggtgattctataatttattgtccaaagtgggacaaccactatgggcaatttagtcatatctattaaagttgaaattgtgcatacatagaattacacttacttattctggagacactctctcatacaggttgcaaggagacatgcaaaagaatgttcaacagctacaagaactg

SEQ ID NO: 14499 - DNA, 339 bp, Homo sapiens
  misc_feature 309: n = A,T,C or G
cttcctctttcatatgcaaccaattccagaataaagagaattctgaggtcttagagaatagaagagccacctaaatgcctgcaccgatatgcatcagactgttaggtaagcgcacacacacacacacacacacacactcacacacacacaaagacgaagaagattatgttaaacttctaaaactctgcagttttatttaactaagtaaccattaaactaattaaccagctgcctaatacagacattggaatatggagtgagaggctgcttgaatataactaaaatatgtgggtgcttagcgattatcancacgctagaattctagggattcatattatg

SEQ ID NO: 14500 - DNA, 340 bp, Homo sapiens
catttccactctttttggcctttaatcactcatgatagccctttaatgtgtcccttagactctatgatatttgatagtaaaagaggtattgaaagcatattttctggtcctcctgctttcagattcttccttctgtccctacttctgagatggagactgagtagggagtcaccaaactgatctggagaagatgaactagatatgctcagattatggaccctggcctcagtggggagaaactggaattctaacccaccagtccaactgtcatatccaattttaaactctggctgcgaaccatggctcacacctgtaatcccagcattttggaaggccaggg

SEQ ID NO: 14501 - DNA, 340 bp, Homo sapiens
  misc_feature 340: n = A,T,C or G
agggagaagtctagctcctgaccaggctctgatttccccggccctgccctattcaagttcctcaaattccttgaccccaacccttgccccataagaaacctccccatgaccctgaccctgacagagaactggctgtgaaaatttttgcattgacaacagatattggaatgcagggattccctatctacttcaggcaccttcaagaatcagaggaggccaagcatgatggctcatgcctgtagtcccagcactttgggaggccagggtggggagatcacttgaggccaggatttgagaccagcctggccaatatggcaaaaccccgtctctactaaaaatn

SEQ ID NO: 14502 - DNA, 336 bp, Homo sapiens
aactagatggagtcctggcgctcactgtgattgagaacacatgacaaactaataggtttactgggcaggcggctaagctgatctacttgctggttcaattagctccactttccggaggctagcattttcccaaccttgccccatgctcttgtgggtacatttaccctatttggggccttagcgctttacaaatgaacgtttcagtttaagagacattgccacataacttatattaagtggtatgaattcaaaagcaagctctgccactacacatcagaatccagcactgaaggaagtgtggaagtcagaaagatggacaggaagatcccttcaagc

SEQ ID NO: 14503 - DNA, 383 bp, Homo sapiens
cttagtggcttttatcccctcggcatgctattttgctgatgtttctataattgcctcagactttcacatttactagtagggctgagagaggctttagtgaggaaagaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttt

SEQ ID NO: 14504 - DNA, 353 bp, Homo sapiens
gtattgactgaactaccagatattgaggcttctttgcttattagctgcatgactttgggcaagtcaagttccacctgagccttgcaagtcaggcctggggagtccaaccacccagaacctttgagtctctgttagagagcaagaccctctcttaagaaacaaaaataaaacaaaaaaagagtattgggatatggggagtttggctcctgtagaaagggtagtctgggaggcctgttacaggagttaacattggacctgagacctgaggatgaacagaagccatcctgaaagaactgggaaaataaagaggtggccaggcgtggtggcgcacgcctgtaatcccatcactttgg

SEQ ID NO: 14505 - DNA, 243 bp, Homo sapiens
  misc_feature 243: n = A,T,C or G
catagtcaagataggctaaattatgctgagataacaaacaaataaaaactccaaaatcttaatgcctttaataacaaagatgtatttcctaatagtgctacatgtccctctcagatcagcaaagagatctctgctcattgtatttaataagaggcccaggctgacaaagctgctgccatcttgaatatagctccttgatgtgccagacagaataaagaactctgcaggatcacccattagcan

SEQ ID NO: 14506 - DNA, 342 bp, Homo sapiens
atgctaactgagttaattagatgagattctgtagagaaaatggacactataagaaataatagtgtccagaactgagttataatgacctctaatatttaatgataaatgaaagaagaggaactgatgactgaatctgagaagaaaccaataaacttgtaataacagaagaacaaacccaggtggtgctaaagaaatcacagttcatcaaaaaggagggacaagtggacttgccttgttaaagatggactgccttaccaaatatgacaaatattaaaatatgtttagatttcaatgatgaccaaatatgtaaataagacactggaatttattcgtcaaattcct

SEQ ID NO: 14507 - DNA, 355 bp, Homo sapiens
tttcaatctttcgtcccaaatgccatattcactacaaggaacaggggttccttggagaaatggctgaatataagtgtgggtaaggaaatatacaaatgaacctggaatatcttattatatatatattaaaaaaaatctactagattcacgtcaaaagtagccagagaccaacttgaagtttgttatttgagcaccaatggggatatgaactggaacccacaggttcatattgacaggagttaaaaaaaatactttggtcagctttgaatgatgttccattagcaagattaaccaagaaaagggagaaaaaatctaaataacctcactaagaaatgaaatgagagctattacaact

SEQ ID NO: 14508 - DNA, 360 bp, Homo sapiens
cagggaaatttgataagttaatcattatttcagccaacaaatctgaggcggttaaaatacttttccttccatatttgatttataagcatcttccccttgatgtgatttatcttttctaaagggactagatcattctaagcagaggaacaatcatagcgaactgtgcctcaggctatttgcagacgatgtcacttgagtttaaaccacaaagacatttcagaaagaaaacatttctatctcttaatatgtaagccaagagatatgaaatcatggcatccccagagaaacacctttccctgatgtcaacttggcgacttgcatctgcttttctgatgaacaaagaaaagtatttggctatgg

SEQ ID NO: 14509 - DNA, 380 bp, Homo sapiens
cgttgctgtcgattaatttaacaaatttatttagtgttgtctcagacacttgagacactggagagttggaggtggatgaaaggagaaccttattctttagttgtttacacagcagagtaaatatcacaaaggcaggtaccttgtcccttttgtcaactactgtgtctgcagcatctagcaccatgtctgccatacagtaggtgtttgtttaattttttaaatgaatgtaaagtacaggtaagtatagttttacatatattatcttccaattatttggattcctcatttcatttctctcctcatagtgtgggaagaggaaagatttgagatgaaatggagaaacatcaagatgaaatgcagagtatttagacaagattatc

SEQ ID NO: 14510 - DNA, 337 bp, Homo sapiens
  misc_feature 337: n = A,T,C or G
ggtttcaccatgttgaccaggctggtctcaaactcctgaccttaagtgatccacccgcctcggcctcccaaagtgccgggattacagacgtgagccaccgtgcctggccaacatttatttagttgaattcttaaaatttatttttctaatagaataagggagagcattagaagtagttttcataagacacaataaatataaacctgtcatttacctgtctagccctgatattctgaaatctggaacttgggtttagaacaaaatggattcagttaatccttttttttttttaaagagagagatttgtatgaggctggctgggttattcattcattcn

SEQ ID NO: 14511 - DNA, 367 bp, Homo sapiens
  misc_feature 367: n = A,T,C or G
tctacggctgctataatacgacagaagggaattcaaggagccggtcaccacaagctgcataaacaaatcgttaccagcataaacagaatatatagcagaatttattcttcgaaaaaaatacttactgatattcaggccaggcacagtggctcctgactgtaatcccagcaatttgggaggccgaggcgggtggatcacctgaggtcaggagttcaagaccagcctggctaacatggcaaaatcctgtctctactaaaaatacaaaaattaaccgagtgtggtggtgggtgcctgtaatcccagctacttgggaggctgaggcaggagaatcgcttgaactcggggggcggcggttgcagtgagccan

SEQ ID NO: 14512 - DNA, 359 bp, Homo sapiens
tgggtttgtcagtttcaataggagattctatgtatttagtctccaaagaacccagaattatctgtggggagttttgaaggagtgagccatttgtaaaaaacataatatgtagggcatggcaaacaggaagaaaaagcaaaaaggagcattagagtgacaaaaggacaaacccaaaacaggatttacatggaaacccatgccagcaacctgcatcagagaaatgtatctgcagccagcagtatctctgctgccatacagaggtctagaaattttgaaagtttataaggcaaaaagagaaaagacaaataccaagcaaggaatcacagatggaacaatcagaaggattactaaaacaagaa

SEQ ID NO: 14513 - DNA, 287 bp, Homo sapiens
ggaccctgcccctcaccctacacaggctataggatctggaagggaagggacggttcctgttaatatctttgcatcttaaggacacagcccacagggtctgttgggtgactgactgattgaatgagcaagacttctagttatacatagactgaaaacttccacttatctctgcttcttttcaaaatcccactaaaatatgaataaatgcatgttttaaagacaaaaggaggccgggcgcagtggctaacacctgtaatcccagcgctttgtgaggccgaggcgggcgg

SEQ ID NO: 14514 - DNA, 245 bp, Homo sapiens
  misc_feature 245: n = A,T,C or G
ggcagccttttcatagatatactttaaataccctttgaataaattcattcagcaatagagttattgagtattgtgcagaggtatagggtgatataattgtgactaggtgactactttacattagatagtcttctctgatgttaacatttaaatttaggacctcggctgggtgcggtggctcacgcctgtaatctcagcactttgggaggccgaggagggtggatcacctgaggtcgagagttcan

SEQ ID NO: 14515 - DNA, 386 bp, Homo sapiens
cgttgctgtcggccaaatactgtgcttagggctctgtccagatcattccagttaatccgcccaagaccccaacagcacaggtgttgctatatttttgtggtgaggaactgagacccagggaagtcacggtactttgcccaaagtcaccccgatgtcaagcgttagagcaagaatttgaaccccagagcttaactcttaaccattttgctaactggctgtctctccaggcccccatcaccctttccatcaccctcccctgccccaggggcattctatcagatggcaggtcccccctcgcttggctcagcatctccaatttaaagcttcatggatctccctcctgttgaaggcatgggaaggatttcccatctcagaaactggacaag

SEQ ID NO: 14516 - DNA, 338 bp, Homo sapiens
cttgtctctttttctccttttgtgaaccagagattgaatactaggatagtcaaaagcaactacatatacaagaaaaatttgaaagtcattgtgcatgcccagggaaaggcacaggctcagaaaagacctgagaagaccttaagtttacagttcagcctaatcttcagaaaagaggcagcctacaacaactacaaacaaataaacaacagcaacaacaacaaagcaaacagcaagcactgaggaatgggaggaaatctgatttccagagatacaacactattaggttcagaagctcaatttaaaaccaaatatcacaaggagcacaaaggaacagaaaa

SEQ ID NO: 14517 - DNA, 376 bp, Homo sapiens
cgttgctgtcgggaaaaatgtggggtgtaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgg

SEQ ID NO: 14518 - DNA, 339 bp, Homo sapiens
caaatacttactgaccactgcatggcaggctctatgctgagcactgtgaatacagaagtgcatcttgatatggggattcgaactgcatggagctcacaccgtccaacccagattgacgtacataataggtccttgactaaaaaaatctcagaggctgccaggcctagtggctcacacctataatcccagcactttgggaggccgaggcaggcagatcacctgaggtcgggagttctagaccagtctgaccaccatggagaaacctcatctctactagaaatacaaaattaactgcgtgtggtggcgcatgcctgtagcccagctactcgggaggctgtg

SEQ ID NO: 14519 - DNA, 337 bp, Homo sapiens
cccgcaggtggaggagacaaggtctttactgttcacccaggggctaggcctcttccactggctccctgaatccccatgctggccaccaagggaaggagctatttctgcagctggacaaatgaggaaacagaggcacaaagcattctagcatttgctcaagtggcacagcagtaggaactctttccctgggggccggcccaggagtattttgtcccatggagaactggaacagcatcaggacagtgagccagcaggcagcactggcaggtgtacatttagaagactgactgttgcccggcgtggttgctcacgcctgtaatcccagcactttgggagg

SEQ ID NO: 14520 - DNA, 355 bp, Homo sapiens
atcagatagggtcgagaacaactgatccagacatatataccgaagtgttcatgaaataaagcgtagaagttagtgcacgaatttgttctgggcgtttgttttagtattccagcattttgtttctattgctaactgatgagaaatgctttaaacacataaacatgttctgatgtgtatgtgtgagacttgcgtttcccaacgttgcataaaataagcacaaataagtgtaaaatagtgtaaaataactgcaaatagctttatcttacacagaaagacaggtgaacagctcgtctttaatcttaagcataacatttgttttggtaatcttataaagattgcttcttgcacattttta

SEQ ID NO: 14521 - DNA, 268 bp, Homo sapiens
aaaacaaaaaaaaaaaaaaaaaaaagggggggggtttttttctggaacccccaccgataaaaaactttttggggggtgggacaaccccccctttaaagggggggaaaaaaggggctttttttgaaaaatggggacgttttttgtttttttggcaccctttaaagcccccataaactgggtaaaccccccgcctgggcttttttttttttttcacgttccaggggagggggggggagttttgctccctccagcagccccttttttcctg

SEQ ID NO: 14522 - DNA, 291 bp, Homo sapiens
aaaaaaagcttaatagtcataatatatatgggatttttaccaaagaaaaacaccaaaatagaaacatgtataaaggaaattaaaaggaaatcaccaaagacaaaataagaaacccctcacaaaacagcacattaaaatgagacatttttgggttgggcgtggtggctcacgcctgaaatcccagcactttggcaggccgaagtggctagatcccttgaggccaggtgtttggcacgagcctggccaatatggcgaaacccctctttactagaactaccgatattacccagg

SEQ ID NO: 14523 - DNA, 342 bp, Homo sapiens
tgcatctcttgttatcttctgtgaagtgagtcagtttcaactttgcctttgtgcttatgtgtcattctctgctctttgatgttcaagtctatattggttccagactctgttttatttaatctgtttgttttctttctaaaaacatattctatattcccgttcaagagtggagctaacttcacaggatttgggaaaattctgattattctagcccatacacagaatgcccaggacaaggaagacaccacttctctgaggaattgtgccaagaatacaagtcggtgaagtcagcatgcacatgttgaatgtttacaatgtgccaggtactttcatatactattc

SEQ ID NO: 14524 - DNA, 386 bp, Homo sapiens
  misc_feature 386: n = A,T,C or G
cgttgctgtcggggggatgcacaggacactctgtgcctcagttttcttatctgtaaaatggggcaaatacctaccaagtcatagggttgatgtaaagtctagttgagataatggagggtaatttcttttttttcttaagcttaaattttggatccattttgtgttgatttttgtatattgggtggtaatttcttagaagctagaaagttattaaatgctgcttatgagccaaatactgtgccaagggctctgtccagatcattccagttaatccacccaagaccccaacagcacaggtgttgctatatttttgtggtgaggaactgagacccagggaagtcacggtactttgcccaaagtcaccccgatgtcaagcgttagagcan

SEQ ID NO: 14525 - DNA, 382 bp, Homo sapiens
tacggttgcgagaatacgacagaaggggcgtgagctactttttttttaaacagataatcaacagggccaaagcaattaagtcattttcccagtcacttggccaataagcagcaagtcaatgaccagaacaaattatacaactttcatcttcccataactgatctaagcctaccaaaaaaacggatgagactagacagaagaaacagtgtcaccttcatccccggtcatctagtcaagaactacgcaaaagccatatgtaacagaaatctaggaccacaggctacagtgccatggcacaaacatggctcaatgcagcctcaacagcttgggctcaagcaattctcccacctcagcctccagagtagctggggctacaggcata

SEQ ID NO: 14526 - DNA, 343 bp, Homo sapiens
  misc_feature 343: n = A,T,C or G
gataggcctgaagaacacagggcgctgcatttagaaaggaggcggggtcagaggaatagaaagggatagggctgaagaacagaggtcgctgcatttagaaaggaggcggggtcagaggaatagaaagggacagggctgaagaacacaggtcgctgcatttataaaggaggcggggtcagaggaatagatagggacagggctgaagaacagaggtcgctgcatttacaaaggaggcggggtcagaggaatagaaagggacagggctgaagaacacaggtcgctgcatttagaaaggaggcgctgtcagaggaatagaacgggatacggctgaagaacacaggtn

SEQ ID NO: 14527 - DNA, 338 bp, Homo sapiens
gtcggttgtgacagtgaaaaatatcttcagacattgccaaatgttccctgggaggcaatatcacccttccttttctgccaggtagttctatgaatttctcacagcagaatttctctttccatattcctatgggcattagagaggtagaacatcagcatttaccagacatatttgatactaagtccctatttgttaagtcagagaagtctgaggttataaaatcattcccttcctcctcaaagagaagtgaaatccttatattgtagagatcaccaagttttcatagtcagacatttccactttgtctgggtttttaaaaaacctatcagagaaaacta

SEQ ID NO: 14528 - DNA, 317 bp, Homo sapiens
gacctgggagaagctgacaatgaaaatgatcggctttttttttttttttggagtggggccctcttttttccccccggtctgtatttcccacattgcatattgaagtaaaatgctcctgtccctggtgcttactagtgtagtgatcataccccggcatcctgcttggggaacaaaacatcccaatacctgcctagggcaaatttggcaaaccctaaaaaatatgagcccaccgcatttacagattccttaccacgaaaaggaaactccgcattttgtgaccatttaaaaattggggctatagctaccccaacagcccg

SEQ ID NO: 14529 - DNA, 338 bp, Homo sapiens
catcatatactcatggcactaaaccacaggaaattctaaaatttctagcagtatttctggtaatctaaataatatatataaaagtgtgtgtgcgcgtgtgtgtaggtcctttgttaaacccttgtacatttatgattcggggcggaagaattctttgctttagaaactatcttggttctataatttttaaaaaaatcctgtcttttttctgtttaaaaggcaatacttattcatttttttaaaaaacagtgacagtaaaaagttaaaaaataagctaagtagggactaaggaaagagtaaaagtcaagggtatctatactgattaaagaatttttagg

SEQ ID NO: 14530 - DNA, 341 bp, Homo sapiens
gtgcggctatggagacccaggggcagcccaagtccttttgaaccaagcagggaggggttttcagggtctttccagtgacccaagggaggaagggctgcgctgagatgtgccactttcaggcagagagagagagaaagatctgggggtgaggggtactagacctctggatcgggtgtcatcggctcgctccttggcatagtttcagacccgattttctggctgactttcagaactacagtattgctcaaactctgctgtgctcagagcctcgtaggagaactggtgagaatgcagatgcccaggccctaaccctggagattctaattcacaaggctagggag

SEQ ID NO: 14531 - DNA, 349 bp, Homo sapiens
acgacagaaggggtgttggtttgttccacatttaggatcattttcccaggctagattttcagatgtgggattatgggttcagatatggtttacacatttttatagttcttaatacagatggccaaattgctttctgaaagagaatcttttcttaagtatttttctccaacttgtatcttaaacatcctgaacatgcttagcaccactgtcttgatatatctgcggaaagccacgtctgcactttttagtgttgtgggccctgggataggcaggcattctgtgcttgctctttgtagctggacgtaaaatttctttttcttgctgggcgcgtgggttttttcccgaaatg

SEQ ID NO: 14532 - DNA, 383 bp, Homo sapiens
tacggttggagttgacgacagaagggaacacattaaaagccagagttcagggatatcagagctagatataaaatgttacccttcaaatgcagagagccttgaggttatgtgtggaatacccacgaggaggaagtccttaatcagttatcttgcaaagactcagcagaacctgggcataaacccagacttgagcaaacactaagacaatggctcctgcaagaactgtctcctctcaatatttggagtatgtcagatacagcagtgcctttcagaatgtgcctaacatccctaaagaatttgaatatgccactctttttttctgatttaaaattttcttactgttgcagagtattaatttaaaaagatgtttaagactgttcatg

SEQ ID NO: 14533 - DNA, 353 bp, Homo sapiens
gaggtttcatttgtggcgagattctctcccaggccacaagacatttcctgctcggaaccttgtttactaattgtaagtactttacaagtaagaacttgttttaaaaacttagcattcaaaaaaaaagctttctttaaaagatattcgattttcttggtttttttcttagcatgttatattttgaggttcagctaaaagactaaggttttcttatctaattgctttaaatttatacatttagtcaaattcaacaatttcttgctaagcattttgccagatgccaggcttttcaaagtagtgtaagatcccagccttgaatcctcatcaattgctgctttctgctgcaacacata

SEQ ID NO: 14534 - DNA, 342 bp, Homo sapiens
gataggggagagacagaagggaggaaaagatttttcttaaggagagcaagaatcaatactatgaaagtcaatttccttattcaaattcaaagagaaattttgtaaccaaaaatgggagaactactgaaaagtcagaagtaaacagaagactggagtagacagtgaggagcaaagataaaaggagagagaagattcaagacagtccccccatttttattggtctttagctgtgcctattgtgagtgggtagatttgtttaaaggctcagggtctggccgggcgcggtggctcacgcctgtaatcccagcactttgggaggccgaggcaggtggatcacgaggt

SEQ ID NO: 14535 - DNA, 374 bp, Homo sapiens
  misc_feature 374: n = A,T,C or G
cgttgctgtcgcacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagan

SEQ ID NO: 14536 - DNA, 335 bp, Homo sapiens
aagactccatctcaaaaaaaaaaggaaggaaaaggaaagaaaaaacccttggaaaagtaggggattttgaaaaaaatttccccattttcattaaagagatggacatataattttaaaaaattcaaataccctatgtaaaatgctatgtaaaacaccctttgcaaaaacccaaagtattcaaatttttgagggtcatggcaaaaaaaaaaaatattaagggcagttaacgacagggggcaggccacataagggggaaactacttcaaactcacaggggaactctcagcaatatcccacagtcaaaagactttaaaaacccatattcagcatttttg

SEQ ID NO: 14537 - DNA, 360 bp, Homo sapiens
ctttgttttagaacgtatttgctcttccctagaaacagactcagaaaaaaaagaactattttctctaaaatttaaaaaaatattttctcaaaagtgaaacttggatatgtaaggttttttgctaaagctttgctaacattagtaatagcaatgaataggaattaatgacattagaaatagtaataccaaataactgtgactagtgcaacttcaaaataaatttcattctcccacaaagctcacaaattgctctttgcttaaagatcttcttttgttgtgtttaacttttctagagcattgtatatcttgcctaaaataaatccaattacgttaacaacatttaataaacattttcctccg

SEQ ID NO: 14538 - DNA, 358 bp, Homo sapiens
  misc_feature 289: n = A,T,C or G
ggacatgaagaaagagcttcctgcaattcaaggactgtacaaagctgaaacgcagagattttcatattatttgggagactcagaaatgagcttttaaggatgttccttgacttgcgggtcaataagcgcacaatggtgaagaaaaggctgccttctaatgacacggtgttccggtttgagactccgggcagcccaaggaaggccaacgtggaggcctcacgcagctccacagacagccccagctcggtgttcctcagctcagaggctgagaatggtgtggaggagaganagaaagcctagcggtcgtcctcatctgcataccatagcccatttgtgtaggcggagtctccagaccaga

SEQ ID NO: 14539 - DNA, 344 bp, Homo sapiens
tatctcagagagtactgggattctgaaagtgaaagggttatacccagttaaagtatgggagtgctggaccaagctaacatgttcaagaagaaatatgggatatatttatggaaatagataatgaaaatgctgaattgaagagcaaagattggacaatggagaatgtttcagtttatcaatattggtgcactcttccatgtaggatgatttaactctgtgatatgtaccctggaagattgaagaaatattacgactatgtaggatcttgggcactagaagcttgctgaaagcggattccactttaagctttgtagaaatgctaagaggtggccggtcgcggtggc

SEQ ID NO: 14540 - DNA, 346 bp, Homo sapiens
atcttggggaaggttaaagacacctggagaatgaaatcttggattttactttcctgaaaggctgaggctaggcataattctctgcctttgttcccctcctttgtcttggttaaatgttcctggccatactgtacctgtggttttattgtcgtcctttttgggaacaagcaggatataaatcagtcagtgaaattttagaatgtagctctttggtctagcatctaagtagataaagaagaaatgggcacttaataagtgcctctggaggcttgtgatttgcatggggctcccaatgaaaggtaaagtctttgcttagaggttacacacaccgaatgcagggtggtcc

SEQ ID NO: 14541 - DNA, 350 bp, Homo sapiens
  misc_feature 49, 350: n = A,T,C or G
gaagaaagagcttcctgcaattcaaggactgtacaaagctgaaacgcanagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtggtcctcagctcagaggctgagaatggtgtggaggagaaaaagaaagcctgcaggtcgccaacagcccaatcccctaccccatctgtggaggcggactccccagaccn

SEQ ID NO: 14542 - DNA, 325 bp, Homo sapiens
  misc_feature 239, 242, 244, 245, 246, 249, 252, 253, 254, 255, 256, 267: n = A,T,C or G
ctgagaacagagaggggatggagcatgacaattagtgttcattgacattgttgttggaggtccctaggtagggccagactgcaggcagccagagagatggcccaggcctagggagggttgaggacggggacaggtgcagggccagcatccccaccactgcctggcagctccccagtaatgcagatgctgggtggcttcctggagagggcacaatcctgggggaggtgttgggaggttanccncnnntcnttnnnnntaaggcccacnaagtttcaggccgcgtggccagaggaatgagctgagcatttgttgtgctgcatgtaga

SEQ ID NO: 14543 - DNA, 386 bp, Homo sapiens
cgttgctgtcgccagagcttaactcttaaccattttgctaactggctgtctctccaggcccccatcaccctttccatcaccctcccctgccccaggggcatcctatcaaatggcagttcccccctcgcttgcctcagcatctccaatttagagcttcatggatctcctcctgttgaagtcatgggatggatttcccatctcagaaactgcacaagaaacaaccttggagttttgaacaaaggatattcaaggagtattcaagaatgaatcttcataatcgtggtcatgagacatgagaaaaaaggtgtctaccacgtcttgtctctactcataaagaacattggccaggtgcggtggctcacgcctgtaatcccagcactttgaga

SEQ ID NO: 14544 - DNA, 351 bp, Homo sapiens
cggggctagagaagaacaaactagattcttgcaggcattccaaggaggctcatcttgaagcccaacctgaccgaatgcaccagtagactcggccaagcccttccttatggccccaggaaactcccaagctatggcaccacaggaagcctatccaagctgaggacccaagacaagttaaaaacaggttcaacggaaaaggctgagaatcactggcccattctgtacccatgcctttaaaaataatacccagctgcgcacggtggctcacgcctgtaatcctaacactttgggaggtcaaggcaggtggattacttgaggtcaggagatcgagaccagcctggccaacatggg

SEQ ID NO: 14545 - DNA, 359 bp, Homo sapiens
gatattgaggcacagagaggttaaataaatcatccagagtctagaaagtgacagaactgtatttcaaaccagtatcttcttgatttctaaaagtctttacttttttttatttttttttgtggaaaaagggttcgactttgtttccccggctgaagagctgggctgcaccactacactaatgttacctctacctcgcggtgggaggtgtctgtttggctcacatccctgagtgacttggatagcagtatgctcacctccgccttcgcctcatttggtgattggatcaaccacggttttattgtcagattgcccactggggggctatgcttctacttccctacagtctctttaatcagtgg

SEQ ID NO: 14546 - DNA, 201 bp, Homo sapiens
tagcctggcttaatccacgtattgacttgaacccggcacctctgcatgctgggcacacacacatccacacaggtgagcacagtcgtgtgcacctgcacgttacacaggtgaacttttctcatccaggcctgaggtttccactgcatcttaaacacttagccgaggtgtgtcaggaccagcaatgttgtctttgcggccctt

SEQ ID NO: 14547 - DNA, 340 bp, Homo sapiens
gacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatg

SEQ ID NO: 14548 - DNA, 352 bp, Homo sapiens
  misc_feature 352: n = A,T,C or G
gacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaan

SEQ ID NO: 14549 - DNA, 386 bp, Homo sapiens
cgttgctgtcggctgggagacacgagggtcacaggcatggagaatggagatggagggggagcccggtccgtgggccccaagagccgagccggacgagggatggagtggggagacgcaggagggcggtgtctagggctggggaatggagtcgtgtctggcaccccggtggggactgtattggaaggcagcccagaatgggcagcggcgaggagtgaacacctggctgcaggtgacggcctgcaggaaggaggcgaagatggccccagggaaccaaagaggctttgccgacccccgggagagggagaggtggactgggaacccctggccaaattccgagcagcctgcgggccagagctggcagacctggtggctgaggagttggcctt

SEQ ID NO: 14550 - DNA, 360 bp, Homo sapiens
gagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggaaagcttgaagcaagggaccttgttatataagcctttaaagcccaacacagatatactttcattgaagaacgctatggaaaatataacatcagtgatcctttaatggttctacgagagattttgaacactgaagagaaaaa

SEQ ID NO: 14551 - DNA, 352 bp, Homo sapiens
gggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaagaagaggagcgggcactcccagggaagaccgtagcctgggcaaagatg

SEQ ID NO: 14552 - DNA, 345 bp, Homo sapiens
ggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttg

SEQ ID NO: 14553 - DNA, 360 bp, Homo sapiens
ggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggaag

SEQ ID NO: 14554 - DNA, 361 bp, Homo sapiens
cggggacgagctggaggacccctatcctagacagatgagcttcttctgatatacacgggactcgggggacgctaacgacctaggagtatccaaccagcaccgtaacacacagaaccacttcaactcctgctttctctccatgtgtacacaatgtgacagggacggggtagataagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagtt

SEQ ID NO: 14555 - DNA, 379 bp, Homo sapiens
ttcgcggccgcaaattcttcttcttcccctgtccctcctccccacccctgcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatg

SEQ ID NO: 14556 - DNA, 384 bp, Homo sapiens
ttcgcggccgcaaattcttcttcagcccctgtccctcctccccacccctgcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctg

SEQ ID NO: 14557 - DNA, 355 bp, Homo sapiens
cagaagacatctcctgtggggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcc

SEQ ID NO: 14558 - DNA, 341 bp, Homo sapiens
attggaagaaccaacatctataagaataaaaaagattattatgatatgtatgagccagaagaagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgccttt

SEQ ID NO: 14559 - DNA, 301 bp, Homo sapiens
  misc_feature 301: n = A,T,C or G
atcaaaaggagacttaagtgattgagaaaaacatagtggaatccggaaagaatgacacctgaaacaaagatggtgagtataataacccatctatcctgtgtgtggttgttttttctcagaatgagggagaagctataaagcaaatatctttatctttatttacaataactcataagtaatataaacactgacttggctcttattataactgtatctagggtaccatgaactttgagtgactgagtgaagatggcagacccatactgtatctaactatagacactttttgaccaataaacan

SEQ ID NO: 14560 - DNA, 179 bp, Homo sapiens
tagtgttttcattcccagatgtcaagcaaagaagtggagttataaatttctcgactagataaacctacaacagcttagaatacatttgttttaaaatgtgattaaattattataataaagttctcataactctaggacaaaactactatctttgtacaaggtatacattttttccttat

SEQ ID NO: 14561 - DNA, 313 bp, Homo sapiens
gtttaaaacattaaaagtaaagggttatataaacattcataagaatattaaaatgtgcttcaaagtaaacatcaggtacatcaaaataaatttaaataattagaagtcattttaggcataaataaaaatgctatctttcatttatccgtatgcctaaaattgtctcttctaagcggaaaaaaaccactttgtttaacacagatttttccttattgtaattagaaatgcagatggaaagactaaattaggcaatggttgacaggaggaaagacatttgctttaaaatcgttgggagtgatttcaagttcaaatc

SEQ ID NO: 14562 - DNA, 332 bp, Homo sapiens
  misc_feature 304, 328: n = A,T,C or G
agtcaccctgagagtgaaacagatacaaagagagaatgaccctcacagctacagaaagaaatgaaatggggcaggagaagagggggaagaaagctaaataactgatttttttaagaatgccagattaaggccgggcgtggtggctcacgcctgtaatcccagcactttgggaggccgaggtgagtggatcacctgaggtcaggagtttgagaccagcctggccaacatggtgaaaccccgtctctactaaaaatacaaacattagcaagatgtggtgtcacgtgcctgtaatcccagctagtanggaggctgaggcaagagaattcgntgat

SEQ ID NO: 14563 - DNA, 322 bp, Homo sapiens
taaacagcatcatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaagtgttgatggaaa

SEQ ID NO: 14564 - DNA, 332 bp, Homo sapiens
acttcaaatctatattttgggccctgagctgttgcccacatttcactcacaatgtaatactcagaagcctgactgctttgtctctaccttgtcttcctggcttctgtaatcatttttcccctttttaaaccttttactttgaataattcaaatttatagaaaagttgcaataactggccaggtacagtggctcatgcttgtaatcccagcactttgggaggccaaggcgggtgtatcacctgaggtcaggagttccagaccagcctggctaacatatagtgaaaccccatctctactaaaaaaatacaaaaattagctgggcatggtggtga

SEQ ID NO: 14565 - DNA, 324 bp, Homo sapiens
gtatgtaataagaaaattaactctcatttaagttagtgatataattggaaaggaagtaggagaaaatcatatttataaagaaaaggataaacttaagggtgttaactttttataatagctctaaaatatcatttgtctctacctgtcttttagaaggcagtagtatcctcactctcagaacttcaaaattaagcaaaacacatagatactggaaaagtccccttagcatctccccttagtaatgccttctgagaataaaagtttagtccaaattccagtatttatcaaattcaactgggcaagaatgccagcttctaaacattg

SEQ ID NO: 14566 - DNA, 310 bp, Homo sapiens
gtttcactgtgttggctaggctggtctcaaacttttgacctcagatgatcctccctgagccaccgcgtgagccaccagcgtgagccactgcgcccagccaaaagcttttacacatctttgaaaagtcttctgtgtgataaccattttgtttcttatatatgataaaagctttaatctgttagataataagaaaattctgaagaataactatgattgtgctacatattaatatcaattattctctgccaagaattgcatataacatacttaatactaatattaaatatatctttcttttccttcaattatt

SEQ ID NO: 14567 - DNA, 308 bp, Homo sapiens
gggacaatttgacatgtatgtaaaaagctttaaaaatgtaatgtatattacattatcatacatattaatgtatattacatttaccctttgactcccacaattctactattaaaaatgtatcctatggggaataattacgttttaactataaagctgcgtaaaaatcaaactccgcaagaatatattacaaaccagctttgaaactattaattttactttcttttatagattttcagtgactctttcacaaggaccaattatttttaaaagagttattttaatgtagttaacaataggttgaatttaat

SEQ ID NO: 14568 - DNA, 207 bp, Homo sapiens
tggtacagggagaagtctagctcctgaccaggctctgatttcctcggccctgccctattcaagttcctcaaattccttgaccccaacccttgccccataagaaacctccccatgaccctgaccctgacagagaactggccgtgaaaatttttgcattgacaacagatattggaatgcagggtttccctatctacttcaggccccttg

SEQ ID NO: 14569 - DNA, 334 bp, Homo sapiens
aatccattctcacaaaataaagcaattttaaaattaaaattaggtggtttcattctattgcttatgatcaaataaaacatttctctggctttttcttgcacatagacataatccaagtattttttcacatgacctacaaatctctgaatgatttggtcttttccacttctccagcatcatcgtctacaatcattactacatccctttctctctgcactgacagcttcttccaagcttttttctgcctccagccctttgaattttctcttttcttttcttgatcttgacatagctgagtctttttctttattaaaattgtagacacagcagcatt

SEQ ID NO: 14570 - DNA, 300 bp, Homo sapiens
ctaccattttaaattaatttagcattggtctgttacaaagtgcatataatttagattcagaagaattgggcttcagttatacttttgtcactttctcaatatgtaacctaggataaatcgctccctctttttcaaatttgatgtgtacaaatgtaatatgaagtacttggcaacgtcaggaacatttgataaggcaaggtatataaagatatgtgtgtagccaggcacggtggctcatgtctgcaatcccagcccttggggaggccgaggcgggtggatcacctgaggtcaggaggtcaa

SEQ ID NO: 14571 - DNA, 327 bp, Homo sapiens
tccaaatgaggcaccattcatcacagcttctttctcatttccatctagtgggtaagaggtttctcttcttaaaactacaatttcttaacctttacaagttatttaacattttctatcatattaaattagcaacataaaacattatcctttatctataaacttctagtctggttccctagagtttatatacacgtttttatttctaatctgcaagaaaaaaaattcctatttgttatttggtaacagagcattaaaagatactatacacatgtggtgcatatatatatatatacacacacacacacacacacacacaaaatacacttt

SEQ ID NO: 14572 - DNA, 149 bp, Homo sapiens
ctcacaccatgaagtcaaaccctcaaagatctacagcctcagtgaaaagttggataagaaaaacagtctgctcaccagcactggacgacaagaaggaagcttatctgactctggatgacaaggacgggggaaaagtctcttctaagaat

SEQ ID NO: 14573 - DNA, 334 bp, Homo sapiens
ggctgctttttactcctttgaaaatattatttcatgcattacttctcggtagtacaattgaatccttttctcattttcctagacagttaatgtcgactggacctaaaacctgaaaaggtaatatttacaaatttgaacacatatatctgcctctctgaatatctccatttaaatgtctcttaatgtcttatcagctcttgaaaataattagcaaattgagtagatgcatgacatcataatttctgatctcacctcaaagaacaacaaaagtctactatgaattcaatagtgaattttaatgatttttgcactgcattcattacatctatataca

SEQ ID NO: 14574 - DNA, 333 bp, Homo sapiens
  misc_feature 162, 164, 166: n = A,T,C or G
acctattttcttattgttttcctgcatattttggaatgatatcttgagattcgtgctttatgccaaagcctcacttgattagggaatattgagtataaaccattgagaaagcaacagtctcttgagttttactaattggtgtgtgtggggtgtgtgtgtgtncntntgtgtgtatgcatatgtggatatgtgtatgtatattaaagatataagtaagaattttggaatatgaattatattttggtttaaaaaaagaggggagttttagttgtgttagttatgtaataaaattggtttaaaaattagggtgaagtggggggggtattttgttag

SEQ ID NO: 14575 - DNA, 313 bp, Homo sapiens
  misc_feature 313: n = A,T,C or G
cacttgtttgtaaaaggcaagcagaacacacagaaagataattgagttgaattttagcagtatgctttctgcctacacattaaagaataaattattaagacagaatccacagaccccccaaggatatttgaacgtacatttttctgatgagatagcacaacactttgaggagatgctcagagaagttcatgacctttgacaagcaatttctgcattagggaatatactttaagattttattctcagaatacttcaaaataagctataatggtaacaattccctaaattcaaggatttctcatgaattatgccn

SEQ ID NO: 14576 - DNA, 331 bp, Homo sapiens
aatgaccacatttcacaattgaacaggggatattatttcatactataatattatttcaaactataataaagaactggctcctgtagaagagaagggaaattattttctatgatccaaagaattgaaatacatatcagttatagtaagattcaattgtagtagcaaaaacaattggaaactatttaaatgtgcatcaatacaggaaaatggtgacatgtactgtaatacatccatacaaaagaatactgtcggccattaaaagaataaagtacatccttggctgggtgtggtggctaacacctgtaatcccagcactttgggaggctgaggg

SEQ ID NO: 14577 - DNA, 333 bp, Homo sapiens
attttaacagcaaatatctttctttgttagtgatttaaatcagctgactataccttgcttaaatccagcttctcacaaaatagaataaacagcacatggttttatgattgcaccaaatgattcttaaaaattttccctttgataaatattgtttctacctatgtagacataatgtggcgatttggagagtgacattagcttatgatcaaataggattccatgactgaaaacagaaggaagatactttctttcttttcttttttcttttcttttctttactttccctttctttcatggaggtgtacttttgctgcccaggctggaattgagtga

SEQ ID NO: 14578 - DNA, 327 bp, Homo sapiens
tcgaactcctgacctcaggtgatccacctcgcctcagcctcccaaagtgctgggattacaggcatgagccaccatgcccggcctactctttaataagtgtaaaatatctgtgatgaaacaacttagtctttaatcaaacaatataccgtactgtatcttatttttttaaaaaaatccaaatttattaaagttcagagtaatagagtttgaccaaatttcattagcctttctaaaacacagaatgatgtggaaaacataaagggattacgatagggaatctcacttaagatccaaggtaattttggcaataaactaaaaattttcttg

SEQ ID NO: 14579 - DNA, 335 bp, Homo sapiens
ttagcaaaatgcctcttcgacatctatgggatcatttaaaaaatgttttgggggacttaattataattctcctctaagcttttgaagcttagctaagactattacctattctcttgggttttgctaccaccatgtgctagtatgtgacagatgtttagatggctgtgaccaggcagactggtcacttcaaaacttgtttgagccatatgcaagagaaaacataatgtcgagacagaaagctgaaaaatgtgtaaacaataaaattaatttggtaagttatgaccaacagtattctttttaatgagataaaataagtatatcagaatacattgaac

SEQ ID NO: 14580 - DNA, 320 bp, Homo sapiens
gagttttcatttgtggtgagattctctcccaggccacaagacatttcctgctcggaaccttgtttactaattgtaagtactttacaagtaagaacttgttttaaaaacttagcattcaaaaaaaaagctttctttaaaagttatttgattttcttgttttttttcttagcatgttatattttgagtttcagctaaaagactaaggttttcttatctaattgctttaaatttatacatttagtcaaattcaacaatttcttgctaagcattttgccagatgccaggcttttcaaagtagtgtaagatcccagccttgaatc

SEQ ID NO: 14581 - DNA, 335 bp, Homo sapiens
caaccttgacaaatagaattataggagcttacatgttctgattgatagatgagcagactttacaataaaaattataaaaggtagatagatattttatgcttgcattagaaaatatgtaggccaaccaggcagtggctcatgcctgtaatcccaacactttgggaggccaaggtgggcggatcacttgagggtgggagttcaagaccagcctggccaaattggtgaaaccccatctctactaaaaatacaaacattagccgggcatggtgacagccgcctgtagtcccagctactcgggaggctgaggcaggagagccgcttgaaccctggagtgc

SEQ ID NO: 14582 - DNA, 268 bp, Homo sapiens
aaccccactgtaggagcactcttgaagaaaatctgccttaccatctttaacaagagtttaaaaatacttttttctttaaaaggtacttactgatccagccctttataagaagaaaaacccttagtccccattttctaacagtgaatttattaggtttctttaaagaaaacaataataaaagacccaggccaaatctattttaattcataagaatcttctcctaatgaggtgcttcattccattaagcttaaatcaacccaaactgaag

SEQ ID NO: 14583 - DNA, 125 bp, Homo sapiens
tacgttcttctaaaacacatattgtgaattaatagaaatactattgaaaaattggaaacgtaatttgaaatcattcaaaagcaaacgcctccacttgagccctattagaggaatatgaacaaaat

SEQ ID NO: 14584 - DNA, 315 bp, Homo sapiens
atatctcatatactccataaatatatatacatactctatccacaaaaattaaaaataaaaaaatagtaacaaagtttttctaaatttaatagtgttttagaaattaaaagagacccaagaataaaaggaaaggtgaactaagagagatataggttaaaaagaaatataagagaaataagctatgtaagagatacaggccgggcgcggtggctcatacctgtaatccaacactttgggaggctgaggtgggtggatcacctgaggtcaggagttcgagaccagcctagccaacatggtgaaaccctggctctacta

SEQ ID NO: 14585 - DNA, 317 bp, Homo sapiens
cttattgcccactcttaccaatttgacagagacttctgaagataattcgcaattctaattaaggttttctgaaacagttttggcggtggttgttttttggtgtgtgtgtgtgcatgtgtgtatgtggtggtagtgatttctaaaatatatagttttaaacattgaacagtaaaggttagcaatgatatctcttttttctctgtgatttactgtgctttctaatgttctacatttattgtatattgactttatagtcacagaaaacatgttatacaactatgtagatgtattttcgaaggcacgcattaacctatcag

SEQ ID NO: 14586 - DNA, 322 bp, Homo sapiens
  misc_feature 322: n = A,T,C or G
taaacagcatcatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaan

SEQ ID NO: 14587 - DNA, 337 bp, Homo sapiens
tggagggtgccggaattatctggaagatctgggagcgtcttcactcatacgtccggtgtctgggctggatgactccacggttgtgcgcagctggaggacagctgacccgagtgcccacacgtggcctctctgtgtgacttgggcttcctcacagcatggtggtctcaggacaggcagacttcctgcatgacgtttggttcatcaaacaaggcagaaggtgaatcaccttttatgatctagactcagaagttgcctctatgctggagtgcagtggtgtaattatagctcactgcagccttgacctcctggactcaagagatactcctgcctcagcctc

SEQ ID NO: 14588 - DNA, 323 bp, Homo sapiens
tcatgaaataaagcgtagaagttagtgcacgaatttgttctgggcgtttgttttaatattccagcattttgtttctattgctaactgatgagaaatgctttaaacacatacacatgttctgatgtgtatgtgtgagacttgcgtttcccaacgttgcataacatatgcacaaataagtgtaagatagtgcaaaataactgcaaatagctttatcttacacagaaagacaggtgaacagctcgtctttaatcttaagcataacatttgttttggtaatcttataaagattgcttcttgcacatttttaaagaaaaaatgtgaaa

SEQ ID NO: 14589 - DNA, 323 bp, Homo sapiens
gaggttcattaaattgtaaaaggtcactcagctctttaagtggaagcatgtggattttacataggtatgttaaaatcctcttacacagagcccagactttccaaggtttattctgtgtgtgtgtgtgtgtgtgtgtgtgtgtgtgtgtgtgctcaagttgaggcccagggtgctcacacttgaaagagagaggctgctcggggcaatatagatctaacggggggggatatagaattgaatacgcaatacgacaagacctagcttacgttgtgaaatgaactatctcttcggtgtgcacggtgacacacgcctgttattctagg

SEQ ID NO: 14590 - DNA, 312 bp, Homo sapiens
ggtcagctggaaggagcgtctacaaaagaatcttaatagtattccctatatcattaatgaagacaataatccacaggtatcagcagtagctgtctttattaccaatagacagcattaaaaatgttgacattaccattcttgcagataacctggatttatattcatcaattcattgaactaatcaattttaaaattaaggccaggcgtggtggctcacacctgtaatcccaccactttgggaggccgaggtgggcagatcacctgagttgggagttctcgagaccagcctggccaatatggcgaaatcccatc

SEQ ID NO: 14591 - DNA, 130 bp, Homo sapiens
ggtattacatcttgtaaagtggcttttccggtatagcttttaactgcttgtggattatatatgtgaaggaaagtctgatggcatgataggatgcttactattggaggtgtcatgttataatgctatctct

SEQ ID NO: 14592 - DNA, 267 bp, Homo sapiens
gagccctcctgggctaagcccaaaatttggggctcccctgcaatggatcagaactgtgttctcagagggcaatttggaaaccaactggcaagtgaaaaattttaacagtctttacaaatgttagcacaaagctttcatgatctgagtaggtaatcttaactcatttcatctgcctctgcagatgcaaattggatctcacttatttatttatttatattttttgagattgagtctggctctgtcacccagactggagtgcagaggcac

SEQ ID NO: 14593 - DNA, 334 bp, Homo sapiens
tacattgttcaggtcttctgtgttcttacccaggccccactcaacctttgagctattccagtatgagagtgaattagacctcccactatcacggtcttactgtcatttctcatggcattagtcttaatattttttatatggtaattctatgttcaagactgtgaacatattcaggttccaagttattttgtgttcattaaaaattttactttgaatcattatgaatagttcctaggttgagcttcgggctccctgaccccagagcagtttccatttgcacgtgttgaccatattctctaacccgtcccataaaattgattctactatttcctgc

SEQ ID NO: 14594 - DNA, 322 bp, Homo sapiens
gaatcaacggggagtggtttaaggccattactgagaggcacagagctaccactaatgaagggggtgcgatggcatagagaagccttctgaacaactcagctttcaacatgtgcaagaattactttgacaaaaaaattacaattttctaatttaaaaaaaaattactaagttattgggcttatctaggctctagattgggggatatgaaaatcatttcaagtaattatctcatagtatttcatcccactgactacaaggctacaagagaaacctcccttgggagaaaatgaagaaaaatatttaatagggaaacagactaatt

SEQ ID NO: 14595 - DNA, 313 bp, Homo sapiens
gcatcttcattactgaaaatctaatttgtttctcaaaatcttcgctggaaatattgaactggagcagagaattaaattagctcaaattcaaatgtggtttgctgtcattcgagcaaaattggtctctctcctgaatttctacaacttcctgtccattattttggtggactttcctgaggaaagtggtaatttgctgaaatcaaaacataataaaaatggcccccattttctaggatcttaagcaggtggaactgactttattcaaatcccagaggaaagatgagacacagacttccgttctctgagctggcca

SEQ ID NO: 14596 - DNA, 332 bp, Homo sapiens
  misc_feature 54, 60: n = A,T,C or G
ggatgggtagctggataaatagatgagttggaggtagatgtggggagagaaaanactcancggggacggaaagcacagggaggaaaaatggccaccagagataacagagcagcctatgctaattaatgatcaactgtgtgtggtttttttcttttccccccctgtttatgttcctccttgttcctcccttctccctagcttttcttccatctcctctcctaatttcatagtttcccatcccattttaaatccccacttttttctccgctccccaaatccttctccactccttctcctttctctctctatcacttccctctcccccatctccc

SEQ ID NO: 14597 - DNA, 330 bp, Homo sapiens
catatgttcctccaagtctaggaaccattgccataaatatcaaccgcctcttcctcgtgagaccacagtaactatgggatgatacaataagggcaagatgaaagatcaaagctttggtgaaggaaagataatggaataaaagacacggctgtgtatcctgtaattaccactatacaaacaggcatcagctttatagtaataatcgtagagcatttattctgcacttcctatatgccaggctttttactcttttatgaacaacatctcacttgtcacagcttgaggctgtaagttgaattatgtgttgcttactaaagatactggaaatta

SEQ ID NO: 14598 - DNA, 331 bp, Homo sapiens
  misc_feature 284, 310: n = A,T,C or G
ttagtatgctttggaaataaataggattttaacctccagggaaaatcaaattgaaaaagaaacttttgtcaataatttattcaattcaatttaacttctctctgcctttaccataatcaaaatttctgggcactcaaaattggaatctgataaggctaagaaaacaacttgactgatcacacagcagaagtagctgtcttgaactttttctcatgtacttattgtccacatgtatgtcttcttttgaaaaatgtttatattctttgcccactttttaatggggntgtttgtttgtttcttatatatttgntgaagttccaaataggaagaa

SEQ ID NO: 14599 - DNA, 330 bp, Homo sapiens
  misc_feature 330: n = A,T,C or G
catatgttcctccaagtctaggaaccattgccataaatatcaaccgcctcttcctcgtgagaccacagtaactatgggatgatacaataagggcaagatgaaagatcaaagctttggtgaaggaaagataatggaataaaagacacggctgtgtatcctgtaattaccactatacaaacaggcatcagctttatagtaataatcgtagagcatttattctgcacttcctatatgccaggctttttactcttttatgaacaacatctcacttgtcacagcttgaggctgtaagttgaattatgtgttgcttactaaagatactgggaaatn

SEQ ID NO: 14600 - DNA, 324 bp, Homo sapiens
tcatgaaataaagcgtagaagttagtgcacgaatttgttctgggcgtttgttttagtattccagcattttgtttctattgctaactgatgagaaatgctttaaacacataaacatgttctgatgtgtatgtgtgagacttgcgtttcccaacgttgcataaaataggcacaaataagtgtaaaatagtgtaaaataactgcaaatagctttatcttacacagaaagacaggtgaacagctcgtctttaatcttaagcataacatttgttttggtaatcttataaagattgcttcttgcacatttttaaagaaaaaatgtgaaat

SEQ ID NO: 14601 - DNA, 162 bp, Homo sapiens
ggcttcttccggccgggccgagaggtgggtacattcgttgaaggacaccagctgcggaatttgcggctttggcagattgaaatcatggcaggtccagaaagtgatgcgcaataccagttcactggtattaaaaaatatttcaactcttttcctctcacaggt

SEQ ID NO: 14602 - DNA, 329 bp, Homo sapiens
  misc_feature 304: n = A,T,C or G
aaactatgcctatcttcacacacacacacacacacacgcacgcacacacacgaacacctatttaggatgcaggaaatatggaataagaaacttttaaagcaagcacagaagaaaatataatttcaaataagggtcagtttaagattgaattttgagaggatgttgaaatacacatgcaatgaaactggaaatagtaagtgaaaagccagacacaaaggatatttgggggttacataaatgaaaattattacaataaaagtatatatggataagaattataattaatggaacatctatgcctaanaaaaaaaattaaaaacctaaaaagg

SEQ ID NO: 14603 - DNA, 328 bp, Homo sapiens
aagttgcctcagaatgagacacactctttgacttcacatgcaacagaaaggcacagttttatttcaaacaaagcagtgttttgctgtaacaccgttaaaaactggaaaggaaaactcaatcaaaccaaaaactagatgcttaggaataaatggtagaattcttacaaaaccaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttc

SEQ ID NO: 14604 - DNA, 195 bp, Homo sapiens
tcatgaagcataacatagaattgaatacctgtggagcacaaaacaaataacaaactattattaatatcattgaaataattcctatgtttcttccatgtctcatgctgtcatctttcctgcatcctcactcacagaaaaccatttgtacgtataatttggttatcttgctcttctctttaataattttattaccca

SEQ ID NO: 14605 - DNA, 330 bp, Homo sapiens
  misc_feature 325, 326: n = A,T,C or G
tatggtatgggagaaagagagagaaagagggcaacacgcgcacacacacacacacacacacacacacacacaaacacacacacacacccccctgtgtgtaacccagctgaaaaagatctgaatcagccagtggttatgagagggacaaaaattggggtatgggggtgtcacaggggacttttttttctttttctctcacatctctggtgggaggaacttttgccttttctttagttgtgtcttctattttgttttctcaggaactggctcagcacagtattttcttaagataggttcttgctttgtcaccgaggctggagtgcannggcc

SEQ ID NO: 14606 - DNA, 308 bp, Homo sapiens
  misc_feature 300: n = A,T,C or G
agagtaattgtggtgcacctaatttagaagcttttgaacaaagattatcaggaggtaagtgaatgagtcttggaaatacttaggagaagagaattccagggcagcggacaagcaatgcagaggcagaagcataccaatttgtggaagtgtttggagtgcaccagagaagagaagcagaaaagaggtaatgggggcagatctcaaaagcctcatagatcactgtgttattctacagaaatctatgaggacataaatatatgagtacaaaaatgttcttgcagcattgtttgtaagcagcanaaaattaa

SEQ ID NO: 14607 - DNA, 212 bp, Homo sapiens
agatacagcgagattcccttctattgtttacatgtcacggatgaaaacaaaatacgttagtcacttttaatcagttaaaaacattgaatcaaaacaatcttgttgctcagttcaaactatcttcttatcgattattggttttcctctaattataacaccacaaaaaatagctcctctgagtgaaatcatataatagaaaatgacagataatc

SEQ ID NO: 14608 - DNA, 328 bp, Homo sapiens
gagaggaacagtgggcgcaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgacaggaggggagagtggatttgaaatctggaaacaaaatccattcccgcg

SEQ ID NO: 14609 - DNA, 332 bp, Homo sapiens
cggggatgtgttgggacttaccactcttatactgccccgtaaaaagggctttgtttgcgaatcatgagatgctattactttattcgtccccatcataatgtggaatacatgagtttactacaacaactgcatttattctatggttcaggctcacatctatgagtgcaacttcttctaggctgaagcaggagaattgcttgagcccatgaagcataggttgcagtgagccgagatcattccattgcgctccagtctggcgacagaacaagactctgtctcagaaaaaaaaaaaaaaaaaaaattgcgggggcggtttttatctaaataccacc

SEQ ID NO: 14610 - DNA, 317 bp, Homo sapiens
aagtttgctggacaattaccgtgtaaacgtcatgacccgtcagtacctaacactgcttccgtctctacagtagccacgggcaccgcagcggcctcagagcagaaggcacagggtactaccagggaggcatcgcagggcgtcaacaccgaggacctgaggccaccgccttgagccacgccgcgtgcaggagcgggtcctgcgcgttcggccccgggaggcggcctgcagaaaccgtccaaagggctggccttgttgttcgggcacacctctgactgggccccagtttctggagggcaggtgtggggaaggcttgtccc

SEQ ID NO: 14611 - DNA, 244 bp, Homo sapiens
taccaccctgaccagctgacttcacctgccatgtggaaagaagctgggaagagtggggagggtagacctgggaaggggacacagaggagaaaggcaggaacagagacacaaagaaagaaggagacagctgcagagggccaggcacagtggctcacaactatgatcccagtactttgggaggccgaggcgggcagatcacctgaggccaggagttcaagaccagcctggccaacatggtgaaact

SEQ ID NO: 14612 - DNA, 333 bp, Homo sapiens
actctgattctgtctcatctgtggcctgtatgaccacagtcacagcctgcagaaatgttctgggatctggtggctcagccctcctttctccttaaggtgcccataacaagtatacattgagtcaaaaaaaaaaaaaaaaaaaaaaacccggggggggcccccgggggaaaaactttaattttttttggaaacccccttttttggggggttttggaaggcccttttaaaaacttttgggggggccggggaaccttttttaaccccaccctttggggccccccctttttttggggtttccaactaacccccaatttgtggccccgggggttaaaa

SEQ ID NO: 14613 - DNA, 327 bp, Homo sapiens
gatgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccagcgtggaggcctcacgcagctccacagacagccccagctcggtgttcctcagctcagaggctgagaatggtgtggaggagaaaaagaaagcctgcaggtcgccaacagcccaatcccctacccca

SEQ ID NO: 14614 - DNA, 325 bp, Homo sapiens
gctcctcctcctcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtactgcgtcacaactagcgcagactccggcagtatttaagcggtgcggcttgggaactagaatccacttcctgtcttccgcctcaggctagagggcgagcgcttcgccgtgggacttcttctgcctggctccgcctcttgccccggaagtactcacagcggacggtggtttttgg

SEQ ID NO: 14615 - DNA, 325 bp, Homo sapiens
cgaccctgctgcccccagtagtagggccaccacacatttacaagagcccggatgagcggctaccccacttgcagccaccacctagggccaaaatgtgctcccagctgcctattacaatagacacaactgaaaccatgtccaccctcctcagcaacagggttgcaatgcagctgctattactcaagcattcaactgggcgcccaagcattccactggatgcgtggggatcaccccacctctgcctaccacagccagcaaccacattactactagggtatatgagaacaggccctcctggacaaggtccaccccaaacctccatgcc

SEQ ID NO: 14616 - DNA, 313 bp, Homo sapiens
ctctaggagcttccaggtcacttctaactgcctgcagctctcccttctcggaaccctgctgcattcagagtggagccgcgctatttagctcttttttcttgtctttttttttttttttaaaaaggggtttccttttgccccccgggctggagggcggggggcaaataaaaactaatggaggcttctacttccccaggataacagaattgcccattttcaacctcaggagagagggggaaaagcggccccccccacatggccaaaataatttttgttttttttcaaactacgggtgttatcacaagaggctccc

SEQ ID NO: 14617 - DNA, 328 bp, Homo sapiens
ggacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggac

SEQ ID NO: 14618 - DNA, 300 bp, Homo sapiens
  misc_feature 300: n = A,T,C or G
ggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatan

SEQ ID NO: 14619 - DNA, 324 bp, Homo sapiens
acagttaccttggtaggaaagtaacgcttggtcttaaattgcttgaggaatgaagacagaaaaaatgttgtgaaaaacaagatgacacaccaaaagagcacatctggaatataaggtccatgatgaccacaagctgaccccaagaatacaccacgaagttttttacattcctggaaaaaaggagaaagaaaaagcagaatggggattcttacgtattcaataaattattatgagcttcattgactcgtaagatgcaactgattgtaagaggcaccattactttgcattccttataaagaaaaaacattgtccagccaactatat

SEQ ID NO: 14620 - DNA, 323 bp, Homo sapiens
aatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctag

SEQ ID NO: 14621 - DNA, 323 bp, Homo sapiens
aaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagg

SEQ ID NO: 14622 - DNA, 303 bp, Homo sapiens
ggatccagctataacattttgttcacattggatacctgattgtgacatttatttaaaatgttacccattttcaaatttctgagccaatatcatgatttaattatagtggcttcatcgtaagttttagaatccgataaagcaagtcccacttcattagttttttttttctttatataatatgccctagacattcattttttcatgtgaaaaaatgaaatgcagaattttaataaaattctaattatgatggctgacatcacaattaaaatcctgcatttttgtttagagggctctttaataata

SEQ ID NO: 14623 - DNA, 297 bp, Homo sapiens
caggggctccccccagctccctaaggcataacggcctctactcactctacatggtgcatgaggtattggcagagacatgcttagcagcattttgcacataaacaaacactacacgtatgagctctttgtaatacccaggacatgcctttcacacaaattccttcggaatatccttccatttgaatctcacaaccaccaagagggacagaagacaaatactactgcctacattttgtgcatcaagaaactgaggcttaaataattttaagtagcttgccccaaattacatgggcaacg

SEQ ID NO: 14624 - DNA, 309 bp, Homo sapiens
gctggtaatttttgtatttttagtagagactgggtttcaccatgttggccaggctggtcttgaactacaggcctcgagtaatccacccaccttggcctcccaaagtgttgggattagaggcatgagccaccgtgctcaggcttcccacaataatttttactttgacacatacagacttcaatatcacattcgtatgcaccaagctatatgggagaatatctgtaaagattcatgagttgttatgtatagagtgcttaaattgtggacatagaaaataatatttctatccagatgcagtggctcacgcct

SEQ ID NO: 14625 - DNA, 293 bp, Homo sapiens
ataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgttttaatgttatgggcagctaccaatttggggcgtctctgtatatttttggaaagattctcattttttatgcttgaagtatttggtgaaaagatgttggttgaccataatt

SEQ ID NO: 14626 - DNA, 308 bp, Homo sapiens
  misc_feature 308: n = A,T,C or G
aataggagggacacctcatcacaagcacaagctaagggcaccacagccagttatctctttacaaatggtttagtcaccctgagaatcagatgcatgtctacaccctaatggagagctgttaataaagtctgattaataagctatgtcacagagtagtgaattttccgaatgagtgttgattatgatgttacagagaaaaattatactcatgttaaccagattgttgtaagtagtgcaagtccaaatcattcttagtgttgtttttggacttctcacgtacactggccacatctaagaatgaaataatn

SEQ ID NO: 14627 - DNA, 302 bp, Homo sapiens
gagtctgtgaataaaacaataaaagccgtgggttttatgaacagtttcagtttggattttcaagaagcaaaagaaggtgtcaaaagaacgaccaaggaataagaggctttcagaaataaccaagaacatcaaaaataaagaggacttttacaagtgaaaaatgcagtaatcaaaaatgaactcaaaagagagattaaatagattagacacaactgaagagaaacttagtaagtgagaagctctatcagaagaaattatgcctaatacatggagacaaagaaatggaaaatattcaagaggag

SEQ ID NO: 14628 - DNA, 309 bp, Homo sapiens
acagtgagcactctgggtcatgtcagacaattccatttattgaactactctgaatttgctgcctctgtcaatcaaatttaatatttcaactgacataaaaaattgagcaatttttgtttccactttatttttcttttagaacctgacctagttaactggtgactgctactaatgtcaaagttatccgatttttgataaggctagcgggtcctgccatttcatttagagtttattccgcatggtgtatgcaattgttttgaatggcatggtaaagatgttttattaaccctaagaaataagagatccaat

SEQ ID NO: 14629 - DNA, 303 bp, Homo sapiens
attttgcacatgatcctgggaataaagagtcacaggtaaacaaggctgcaagaaaagtccaggtggtgttcacacagtagctgcaaacttctcagaacttttcagaaattcatccttgcctgtcattacattttttaatgagccactcagcattccaacgaacaacccaatacatcatttcctctattaattggtgcagttaatttgaaaactgttctcagttctatatttatatgggaaatattaagagtccatctccttgctcctttttcattaattccacacacattcatggagcatcac

SEQ ID NO: 14630 - DNA, 307 bp, Homo sapiens
tacggatgacaaaagacgagccgaatggtccccatttttaaattttggagcttattcaaaaagcttaaaatacaccatgagccaacattatatgaagcaaactaaacatatctagagatgcagcttggcccatggactattcagttttaacttctgctttaaaggatgacgctcaattggcagttcatacatacatatatatatatatgcgcataaaattcacagacctttggtttacacctgactctgtgacttaccaactgtgtgggcttgagaaagatgcctaacctctctgagcgaaagatgg

SEQ ID NO: 14631 - DNA, 278 bp, Homo sapiens
ggactccaccagtctgaccttagagccccacttttaaccctgtttacccagggcccccaggtacttcaaatctatattttgggccctgagctgttgcccacatttcactcagaatgtaatactcagaagcctgactgctttgtctctaccttgtcttcctggcttctgtaatcatttttcccctttttaaaccttttactttgaataattcaaatttatagaaaagttgcaataactggccaggtacagaggctcatgcttgtaatcccagcactttg

SEQ ID NO: 14632 - DNA, 259 bp, Homo sapiens
ttatgactttgactatattttacaacttgaaaaattttcatttttatggtgccatcagcctgctacttaatagaaaatgctttattgacatttatgttctttacctaatgatgtggatttaaatgatggctgtcatcttcattagaactgactgtcgaaagagtacccagaatgacaataccgaaacccggtctcattttaattgggcaaaccgagaaacataacattgggctgaacatttcaccaatttgactaccac

SEQ ID NO: 14633 - DNA, 415 bp, Homo sapiens
ggcacgagctcaggtaaaacatggctttttgctttttgagtaagtggaaaagaaagatgcgtgctgaaaagagaataaagaatgccccaaaggaggccagcaggcttaaaagtattctcaaactagacggtgatgttttaatgaaagatgttcaagagatagcaactgtggtggtacccaaacccatacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagataagaaaggggaaaagcacagcaaaagcagtgaaagtggcaaggggtttggcctggtatactcg

SEQ ID NO: 14634 - DNA, 386 bp, Homo sapiens
  misc_feature 318: n = A,T,C or G
tatttaggactttaagcctcttttctgcctatctcacatatcattttgcaagtcttcttggaattatttaatttacagtattttgataacttcaaagctggtaaaatgaaattagagctatctgcttgtgctcagaaatcaattctcatcaaataatatgaaattatgttatctaaaagcatttaccctattaagtgacagacaaatgagaagtaaggagacttaatacactgtttgcctattgatgacactggccacaaacatcccactctttacaagcagtaacagggaagggagtcttttgaaaaaacaatttgngccgggcatggtggctcacgcctgtaatcctaacacttttggaggccgaggcgggccgaacacgaagt

SEQ ID NO: 14635 - DNA, 378 bp, Homo sapiens
tttataagtatacctggacagaagaaatacaagataccgttctattaactcaatatagtgttgctaagttcgtacttgtgcttggtttattttattttataaataggtatcactcgcatggttccaaatgcggtaggcacagagagtatatatgatggaattacatcctccttccctgcactcagcaaccgagatcatcccgctacgggcactcaaaggtttcattgtctgaaatattagcctaaacgtagtttatgtttaggaagcaacaaccgtaaataggcccacatccaaacggagtggatttaggtttcactttttcaaggaaaaaccatcaaagaatttttccacatacttataaaccatcccacgtataga

SEQ ID NO: 14636 - DNA, 378 bp, Homo sapiens
ataactaacttcttttggtcttcccacatttaataacctctcgatcagagcctttctttttttatgtactcaaaaataatagaaatgccatttttaatatttaccaataacctatttaacttagtaaggaactgcttcccctgggggttagaaatttgtacacagccttctggatacaaataatctttatttaattaattaatttatttgttttttgagatggagtcttgctctgttgcccaggctggagtgcagtggctcgatctcgactcactgccatctcgccacctgggttcaggtaaaaaattctcctgtctcagcttcccgagtagctgggactacaggtgcatgccaccatgcccaactaatttttgtatg

SEQ ID NO: 14637 - DNA, 395 bp, Homo sapiens
  misc_feature 358: n = A,T,C or G
cgttgctgtcgctttttagcatcttaaaatttatttttatatgagtgcctgtagatttgccgtatcctttaaaaaacaattattttaatatatattataattgtacatattttcggtgtgcatatggtgaaagtcattggagtggaagatagcaaggagcttggaaattgaaaaggaattcagaagttgttgatgaactctgaagttatcagcatggatggttgaatggcatcatagacaactatctagagagacagtacttgctttacttttggaaatcagtgtgctggcattaaaactcagggacttgaaaatgatggacacagccaaagaatatagtatggtgcctggggtgtanggagtggagggagatattcatgcattctgtaatctgg

SEQ ID NO: 14638 - DNA, 393 bp, Homo sapiens
cgttgctgtcgaagtaactgggcagggatggttagctgggaggtatggatttcatttccattactaatgcctgcaattgctgataatagacgtgccccaggaatcgctgcaagggaaatggagcaagggtctccttctgtggcccagtctggaatgttagtggtgcaatctcgactcactgcaacctccgcctcccggattcaagagattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaaccatc

SEQ ID NO: 14639 - DNA, 388 bp, Homo sapiens
cgttgctgtcgaagtaactgggcagggatggttagctgggaggtatggatttcatttccattactaatgcctgcaattgctgataatagacgtgccccaggaatcgctgcaagggaaatggagcaagggtctccttctgtggcccagtctggaatgttagtggtgcaatctcgactcactgcaacctccgcctcccggattcaagagattctcctgcctcagcctcccaagtagctgggattacacgtacgcaccaccatgcccggcaaatttttgtatttttagtagagatagggtttcaacatattggccaggctggtctcaaactcgtgacctcaagtgatctgcccgcctcagcctcccaaaatgctgggattataggcgtgaa

SEQ ID NO: 14640 - DNA, 366 bp, Homo sapiens
tggggattcaccgtgttgggcaggctggtctagaactcctgatctcatgagatctgcccgtctccacttcccaaagttctgggagtacaagcgtgatccaccatgcccggctgaggctaggattttaattatattccaacatttcttactctcttcattattactccccaaacagcctttttaggcattttcctcctaggttctgcctgtgaaaatttactactacagattattgtatgtctgtatgtatgtaatgtatgtatctgtgctttatacataaaatgattacttttgcccttccttcgcccccgctcttactcccattagcgggggtttgcttccattaacaaagatagctgggcctgg

SEQ ID NO: 14641 - DNA, 390 bp, Homo sapiens
ctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagcggaacctaattcctcaagtctaatggaaaccaatcctctggaatggccagaaaggcatgttcttcaaaatttggaaacttttgaaaaaactaaacaaaaaatgagaactgggtcattacctcattcatctgaacagttgctgggccacaaagagggacctcgggactcaatcacattgttggatgctaaagaattgg

SEQ ID NO: 14642 - DNA, 391 bp, Homo sapiens
ggcacgagggcaggaggccagatttggtcctcaggctgtaatttcttggccccttgtctagggagaggtaaacgaggggaggagagatcagtcaaggatgacgtgagggtttgctgggagcaccaggaatcctggagaaggtagtggcaagagggtgcagcaagctcagctgggcggggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctg

SEQ ID NO: 14643 - DNA, 386 bp, Homo sapiens
cggtgctgtccaacacatattgtctggtttttaacaggagtgatacagaatggcaaagcttgatccatatagtaagagaatacaattattgtcgagttttaacaggagtgatacagaatagcagaggggcctgctgatgaattgaaggggatccaataaagagattactggaataataaagatgatcaggacttacactaaaatatttgtgataaggatagagaaaaagtgttaatgtattgggggaaatcacaggatatatcagctgaatgcttatgtgaaatgagaatgatgaaaagtacttaaatggagagatggcatcggccactgtattactctgtgctcacattgctataaagaaatacctgagactgggtagtttataa

SEQ ID NO: 14644 - DNA, 383 bp, Homo sapiens
cgttgctgtcgcacacacacacttacacaatggaaatacaatatatatggtgaactcatttacaatacgcgattaccagttttccatgttagtttttctacccttacctgatcatttttacgactacttaaaatttctctgctggatcaacaatattttatctacatcctatcaatggctcacttttaggtagcttcccatatttttactcttacaaatgaacattatggaggaacacctttgagcatatacctttctacacttgtccaagttttctctctctctccccccctttttttttttcacctgcagacacagggcaaccaagttgtcgtcttcaaattaatttctcagagtctactctctggataataggggtgagt

SEQ ID NO: 14645 - DNA, 385 bp, Homo sapiens
cgttgctgtcgggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaaaa

SEQ ID NO: 14646 - DNA, 380 bp, Homo sapiens
cgttgctgtcgggaatgggtcttagtatatcccctatcttccctttccactgccctcacctagtcttcaaccctgagtaatggggtgttcatagaactctaatggggtgataagatattttatagaagtagaatcttgatctgacctctccttctaattgggaacgtctatgttctaactagcagaaattcctcaaagtttctggcatatggaaaattttccctctatttttattcctttgatcatttcaatgtgaatttagaatgaggcaatttagaagcctgtcctcgcaaagccattttatttaaaaaccacaaaataacactttttttctgtgtgaagaaggttagaaaaaaaatgctcaagactcataattatat

SEQ ID NO: 14647 - DNA, 369 bp, Homo sapiens
cgttgctgtcgctgggacttgttaggcattaacatatattagtcaaacgagtgactccttacaaatataaattcttttaggtgacatgggaagtaaatatggttttaattgtagcaccccctacagggctgttatgcagaaaagagtagctaataggctggaccctagaagttgtactgtttctggtggcacaaagaatttctttccaaggttctgatgactcttttttattcctaataagttcttaaatggttatgttcatagcttgaggttcaggctgcacaaagaagttactttcatggatacagttagaacttctactatgggctataataataaattttgcaccataacctactggcagggctt

SEQ ID NO: 14648 - DNA, 342 bp, Homo sapiens
gcaggtaatgagactgcagaaaggctgaaggtagattaggataagatcaatgaaaggcttttataaagcagttttgaattgtcctttagaaaataagaagccataaaattttattttttattttcaaaaagatatttctaacccatattagaaatggattagaaatagataacatataacatttggagaagatagaagagttagggcctataggaatagttcaagcaaaaatcatcttatcttaattttggatactttctaattacttcctatcttgaataattagataacattaatcatagtggacacatgcatacatatgtttattgcagcactgttcac

SEQ ID NO: 14649 - DNA, 362 bp, Homo sapiens
cgttgctgtcgcccacacagggcacagaccccacgcaccccacacggggcaggcagctcacacagggcacagaccccacgcaccccacacagggcacagaccccacgcaccccacacagggcacagaccccacacaccccacacagggcaggcacctcacacagggcacagaccccatgcatcccacacagggcaggcaccccacacagggcacagaccccacacaccccacacagggcaggcaccccacacagggcacagaccccacgcaccccacacagggcagggatcccacgcagggcacagatcccacgcagggcagggccagcccaaggccaggcccctcccctgtagatatcctg

SEQ ID NO: 14650 - DNA, 318 bp, Homo sapiens
gatgtgtgataacacatgcaaccacgcctcacctcacctgagactggtggcccagagtttttcttaatggccatcacatacgcatacagtgcctgcatggctgacctcagttactgaagctgcagccagagagggaacttaggtcttcactgtaaatcacattgttaggataaactaaatggaaaaactaaatgaagtacagtatagctgaagacctcccagcaggcaaaatgctcttatcagtcagaatgtttcaagggctcagttccaaggagccagccaagggccagtcatgaaaacccccattcattggtaatg

SEQ ID NO: 14651 - DNA, 318 bp, Homo sapiens
tctggggaataaaaagcactaatggacaggagatgggttttgcaaaccatgaaaggccatgtgcagctgagctggtattatcactggagcctggcacttcgccttcatctgtggtttcctctgtgtcagtgaaaccacagccactagacggggagcaactcaaggtggggcccggggtgaggagctggagcctgagcccccagtggagaagtgagtgggggtctccagctaggaaggaaagggtgggaggtggagagcagccccagggggcagtcactaagccccatgcagggcagaatgccaggaacacaggctcca

SEQ ID NO: 14652 - DNA, 311 bp, Homo sapiens
ggtactcacaagttaacaaacttcaaaatgctatttgaaagggaaactaataacattaaaaagaggtcacagtactgtttgaaaatctacaaaggagtcatgatctttgttcaaggaagtaaaatattaaggaaatttgtgttagttgagttcttgactgaacatgtgctatgaatttctgattgtggaagctgcttcctattcgaaaataaaataaaactctcttggtatgcaaatgataagaatatgttttggtatctaacaatatctaaaagcaaactctctgcaaagtatcccagaatggtttactt

SEQ ID NO: 14653 - DNA, 405 bp, Homo sapiens
attgttatccgaaatagagaaataactcctgttaatcaagaaaaagacagaaacttcaatgggaaaaaaaggaccaatgaaagagacaaactaccatagatcagatttcttcccatagctaaacagtatacaaagaaacttcatatttataattatacaaatgcaaatcaaggcagtgagtcattactcttatcagaaagactctaatttaaaaggataaacacaacaattattagaaaatgtgcatagtgttaactttcactcacttgtagtgaaaagtagtctggaaatattttatacatcatagagaaattccgagaatcatatacaggtagatgatgataaggaatatggtattgcttgtggtgacagtcatttggtggcactctcatgattggtggcaat

SEQ ID NO: 14654 - DNA, 425 bp, Homo sapiens
aagctacttcatagagctgacattctagggagaagatagacatggcagatttaattatacacatatctttttcactgtattagattttttcagattataaaattatagtaataaaatagcaatatcaaatattactgaaatacataacataggaaaaaatatgccctgtcaattcatcctccctccccagacgtagccactgtcaaccagtttgtgcacgtttttgtaacttttaaaaatatacatgcaatgtatttttaaagcataaaaggggaatcatacacgtctgaattttgttttttagcttcatatatctgggatatcctctcacatgaacacaaggaaatctacctcattctttttaatgtctgaataatatttcatgctatggatgtattatagtttatttgactaatatcttgttg

SEQ ID NO: 14655 - DNA, 388 bp, Homo sapiens
agaatactaggtattaagtaaatattgtttgagtagataaaagacattagtgttaagcaataaccctacattcttaaaaaagagagagttttattaaattgctaggaacttaaaatttttggatctcacattccaaatgcataacacaagattttgctttcagtgtgtatcactcaaaattaagctagtaacaggtaaactagctatgttccctattcttatttcttggatatgaggagaggaaacacatgcagcaggaaagaaaaaggtgactaacaattactaaatttcgagagtaaattggattgttttgctctgtgcaactataaaatggtgattaacaaacaggtgctaaatgttaatgaagtatatgagattaaaaataaac

SEQ ID NO: 14656 - DNA, 388 bp, Homo sapiens
  misc_feature 388: n = A,T,C or G
gatttttgtggtgagattctctcccacgccacaagacatttcctgctcggaaccttgtttactaattgtaagtactttacaagtaagaacttgatttaaaaacttagcattcaaaaaaaaaaaacctttttttacagcttattgaattctctggtttttttctaaccaggtaatatttggagttgcacctaaaaaactaaggtttcttaatctaatggctttaaattaatcctttaagccaaattcaccatttttttgttaacctttttgccaaaggccaggtttttcaaagaagggaaaaaccccacccttgaaccctcatcattggcggttttcggcgccaaacccatattatccttgtgtttaagaaccaggaccattatttccn

SEQ ID NO: 14657 - DNA, 421 bp, Homo sapiens
ccatcgattcgaattcggcacgaggttgccatactcttgcatacacaatcggttatctagtttttgattgtttgtgtgtatggtgtgtgctgtctctctgaccagatttcaggttcctgaggcgagcctgcagctcatactgctcatctgtcctctcctgtggtgggtgctcagggcctctcactgttagttactccctcctttctgcccagttctgcactcaactagtagaagcagccatcctttccccaagcaggaaatagtagtggtcgcccttaagagcagtgtgagggcagaagattaagggaggggaagagtccctggaactggaagaaggtaaatactttgccttgagagggcgccgaatcattttaccacaatagtaaatggaaaaagtgtcaaaggttgggactacgtttag

SEQ ID NO: 14658 - DNA, 415 bp, Homo sapiens
cgttgctgtcggccattctttggcgagattatcatttcttgctgcaaagatgatttgagacactaactacgttgttaaatgccccaaaattaccatgatttccatcatagtttaagtactcagtttcattattgttggtctcaaattcagagatgaataggaatgatggataggatttatttaagtatatatcttaggtatacatttatttagtgcgggctgattaatgtgaaagttaaggtataaaacctagagacaactttcagggaaaaaaaaaagatctcttattaaatgttttagaagtagggattcccattctatattgaaaataacataatttcaccacttggttattataattttttggggttgggtgaacatttattaaaacaaatgtgtgtggtctgacaaaaag

SEQ ID NO: 14659 - DNA, 417 bp, Homo sapiens
ggcacgagggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctagttacagccccagcagtaccagttgtgtggactgggagggaggctatcacgtacatactccaagcctccaagcctgtttccccttctgacacaggatcttttgtggctggtatagagtgggcactcaataaatgctgtctgtcgtctggctggatgcctcatgggcctgagaattgaatagaattacagtgatagaagcatgctggtattgaagtg

SEQ ID NO: 14660 - DNA, 203 bp, Homo sapiens
gggtaaatcttcaggtaagtgttcctggtgcctatgttgtgaaacacaaaaaataaccgaaaaatttaagggggcggttttttttgggggccccaagatgggaatatcctttgggggggtggggcccaccccccaactgagggtggggaaaaaaagggttttttttgaaaattcggggggcttctggtttgttttgacccatt

SEQ ID NO: 14661 - DNA, 411 bp, Homo sapiens
cgttgctgtcgaaaaaagaaccccgtgtgttgtaaatcaaggaaaaatgttgggtaacagactatgacttgactttgtgcttatatcatgattgtatttaattttattataagttggttaaatatttgagactttggggaaattaaacttgtcaagctgtcaacttatcagtttggatttatggtttcctatttcattttgtagatattgaaaatacatgtcaatatctgtgtatttcatgtcaaggaagctgtgtattggtatcaggattgagggaatacatgatcaacaaatacttttccaagtttcagtgtcacagattgcatatggcatgataatacatcacattcatttccctcaagtttgtttttttttttgacagggagttaacaaaaaatgtgcaaatggcca

SEQ ID NO: 14662 - DNA, 383 bp, Homo sapiens
attcacccatccacccatctactcatccatccatccaaccatgcatccatccatccacccatccacccattcatccatccatccacccaaccaaccatccaccttttcatctatccacccacttgtccacccacccattcctccattcatcattcaaccctctcttcctaccatcactgtttcatccatgaagatttataaagaagtgtaacatttggagtttataaaccagtatttgagacctaattctaattctttccgcctgtgcaatcttggacaaatagttaaaactatctacattttttgtttattctttggcaaaatgggagagagtgcttatctttacattatgaaactactatgagaaagagatgattcagctg

SEQ ID NO: 14663 - DNA, 407 bp, Homo sapiens
  misc_feature 407: n = A,T,C or G
gattcgaattccgttgctgtcgagcagccaccagagattgtcatgaaaaatgaaaagtcaaagaaaaataagaagaaatcatagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaan

SEQ ID NO: 14664 - DNA, 237 bp, Homo sapiens
atttacgtgccatgattttattccaaccaaaaagatatttggaaaatatttaagaattattgctgattattgaaatctagaacactaataccagtgaatattttgtataccctaatacttctctgatcacttacaagccaataattagccattcacgatacagaagacagacagggtagatgtgggggggcggttttttgggtaattccggaaagagagaaaactttgggagggtga

SEQ ID NO: 14665 - DNA, 376 bp, Homo sapiens
ctccatatatatatatcaatacattttctaagggttgaaactaagttttcactgacatttatataaataacctaaaatcttggcactaggattatttacaaaggtaaaacctgaattacaaatatttggcaaggagaaaattatactttctgtctttcttcccaaatcaaaatcatcttctatggggcggcatccccacctcagctgtgtgaacggtggccccagaaaaaataaggtcaaaaaaaattaaaaaaaaataatcttctggccgggagcaatggctcaatgcctgtaatcccagcactttgggaggctgaggcgggcggattacctgaggtcaggagtttgagaccagtctggccaacatggtgaaacc

SEQ ID NO: 14666 - DNA, 158 bp, Homo sapiens
tttttattatctcctttctacttttttggcttactttttgttctttttctcaccttcctgcttggatgattaattaatttttattaattcttttagtcctattttttttcagtgattaaggccatgaatttttctgtgtgcaaactatatcctgagac

SEQ ID NO: 14667 - DNA, 406 bp, Homo sapiens
ggcacgagaggaggcaagtcaatcttttttatttccttataaaattaactcttcaaaagctgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagattt

SEQ ID NO: 14668 - DNA, 374 bp, Homo sapiens
accaccacgcttcaattcaatctaaatcaattcaacaaatctgtgctgaaagtataacatttagttttcttagacaccaaatgaacaatacaaaatccctcaagggacttagaacattcaagttttctatatctgtggttctaagtctgttaccaacttccaggactctgcttctttccctctgcccattaacaatgcggtgttaaaagtgacttcctaccactatgtttcttacagctgattcaaccactcatctcatagccaggcatgaaagaaaggagcatacccctaaccgagaactattttttagatggtagtcatatatttatttcatatttagtaagtattatttcaggtcttattaattaaaggaa

SEQ ID NO: 14669 - DNA, 402 bp, Homo sapiens
cgttgctgtcggccaattcagggtctcaagaaagaacagcccacaggattgacactgaaccttaacaaagttaacaggaccaagctgcagagagggtgctaggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctagttacagccccagcagtaccagttgtgtggactgggagggaggctatcacgtacatactccaagcctccaagcctgtttccccttctgacacaggatcttttgtggct

SEQ ID NO: 14670 - DNA, 399 bp, Homo sapiens
ggcacgagccttcgctaccctgtctgcacgtcccagcacccaggtacccagcacaggtctggcgagagggtagagatggtggacctcagccagaagtgggccccactgcagcccacacttctctttacagccgaggccagactcttggggtgaggacaactgggagggcctcgagactgacagtcgtaagtgcttcccctgggtgggctgaagactagggctccccgactagcccgcccctacaggcccccggcaggcactggctggagagctgagaccggggctccccttcctgacgccaggacaggtcaaggctgagctggcccggaagaagcgcgaggagcggcggcgggagatggaggccaaacgcgccgagaggaaagtgggcaagggccccag

SEQ ID NO: 14671 - DNA, 403 bp, Homo sapiens
catcattcgcgcggccgcgaattcttccgacagcaacggttccttactaaaagaaataatcaggaataaaaaaaagaaataacattgttggggagaagagaagggaattaacatttataatacttttcttgcttatttctagtgttttcaaatttcctgtggagagcaaaatacttctacattaaaaaagcttttattgtctttgttgaaaataagatacaagaagtagactttaatttgaaaaaatataatgtagtgaattagattaaaatgtttatgtatgaggaaaataggcccagcatggtggctcatgcctgtaatcataacgctttgggaggccaaggcaagaggattgcctgagcccaggagttcaagaccagtctaggcaatgtggcaaaatcct

SEQ ID NO: 14672 - DNA, 377 bp, Homo sapiens
aggagacaagggtacagactgtgagtctagtcagaagtgatgcacatggctcagtggatttaggcaagtcatttcagtgtttgtacaatgggaatagtaatataatacatacttctgagaattatataaaaaatgtatgtaagatacctgtgatcatttctctttacccctaactatactataagtttctgagagagagggaaaaaaaaacataccttatacatatctttatattcctattggggcttaaatactttgcacagtgtgtgattaataaatacatgtgcataagtgtaagcatgtgtcagcatgtgtgtgtcagcatgtaagtgtgtgtgtgttcagaagatttaggtgtcttagaatagagctgataa

SEQ ID NO: 14673 - DNA, 402 bp, Homo sapiens
cgttgctgtcgtagcgcgcgaggccctcggtcggacgggacgctcgggattcagggactgcctcggcacacgggaagttgccctacaggcgcgggagaaagcgcaggcggcggcttagcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgagga

SEQ ID NO: 14674 - DNA, 406 bp, Homo sapiens
ggcacgagcctcttcgaagcccatgttattgaccgactgaagctgctggtgctgtacaggggagaggatgatgagctgctacagcgggcagctgccgggggcttggccatgcttacctccatgcggcccacgctctgcagccgcattccccaagtgaccacacactggctggagatcctgcaggccctgcttctgagctccaaccaggagctgcagcaccggggtgctgtggtggtgctgaacatggtggaggcctcgagggagattgccagcaccctgaaggagagcgagatgatggagatcttgtcagtgctagctaaaggtgaccacagccctggtccaagggctgctgcagcctgcctggacaaagcagaggaatatgggcttatccaacccacccaagaag

SEQ ID NO: 14675 - DNA, 363 bp, Homo sapiens
gcaacacccttctgatgacatttcccattaacctcagaacctattgcaagagtatatacctctgttaaacaagcagaatatcaaccaaacagcaataaaggaagattaggttgaaaaagtgcacatcagcctcccttggaactctgaaatgtagattttatggaaaaaataacagctatttttaaaaaaataatttttgtttcgagcaagtaaaaaatatttatctcttagtatattaaattacagattgaatatggcatggttagtctgtgaattctcacagtattataagtttatgaaatagactcttctcaagaattaaaatagaagttctatgggccaggcaagggggctcacccctgg

SEQ ID NO: 14676 - DNA, 370 bp, Homo sapiens
  misc_feature 336: n = A,T,C or G
ataacaacagtaataaggaaaacaatataacaataacaattctaaaacttcatattgtccatgggtctgtatctctctgtgcttatgcagccatattgtcaaaaaatatatatgctgtctctaatttatgcatcatatattttttaaattatcgtagttaattttgtacctaagaagtaaacctaatcgttaagtttaaaagacaacagcaaaggagatcttttaaatattcattttactggaactttattgatcatttgacatttttgcagatttcctccttgaaatccttttatttaaatgatattaattattggcttctttttgattgctttntaatgactttagattatattcttaagaactttta

SEQ ID NO: 14677 - DNA, 316 bp, Homo sapiens
cattggttctaccaagcataagcaaatcaaacaactcattgagagaatgtcatcagccaataaaataagaaactgctcccaggccctgaatcagcttattaaaattgacctctgggactagcttctcctaatacataaaattataaaaaagacttagacacagaacctcaagtctgttctaccaggaaattttacacaagtattccagaaatcaaccaatcattctaacccattagtggtattcagtaagattgaaagtattcaataaaatcagaacaaaatgtctcatacaagatttcctggcagggcatggtgg

SEQ ID NO: 14678 - DNA, 369 bp, Homo sapiens
  misc_feature 342: n = A,T,C or G
gatatttttcttctgtttttagtatggcagtatacaaaaatgtatatattgattttttatgataaaaatttgatcacacaaaattaataatatttgtaccatcaaattgtcttacttctaataacagaaagaagtgtcttttgaattactagaatacttttatttttgagcgcttaaaaattttttcaacatttatactgaacgcttcatttgcttattgcattgcatcagctaaaatctccaaaaatattgttgaataatactgaggatggcagatatcaatctttttctgacagcaatgaaaattcggattgcattataaactatgtttgctcctagttntgcggcaaaatgtatttatcaattttc

SEQ ID NO: 14679 - DNA, 398 bp, Homo sapiens
cgttgctgtcggtgcatgcctgtaatcccagctacttgggaggctgaggcatgaacatcgcttgaacctgggaggcagaggttgcagtgagccaagattgcaccgctgcactctagcctaggtgacggagtgagattgtgtctccaaaaaaaaaaattttttctttgcgactgtattcctaattttatctacatacataattcacttgccactcttgactgtcttacttattctgtttgcaaattcatgtcatggtttatgtatcacagtgcagtcccatgagttttttagacaaaggattagtggataagccaagagacctatacccttcactatataggatgcaggtgtttcaaatgctggatgtaagtggtaggcatggtggctcacacctgtag

SEQ ID NO: 14680 - DNA, 371 bp, Homo sapiens
aggtagataccacttttttcacaattactaaaagccaggcaaattactagtattttacatcatcataactcattaatccctcacaaagtcctataaatttagtaatgaaattaaaatcccctgggagtcagaaacatcccatttgtgagaaatacacttttcaatttatgccaaccaaaagcagaataaaattttaatttatgaatttttaagatgagaaaagtggggcttagcaatgctaactaatatgtgcaagtttgtgcagttataaggaatctgattcataatcacttttctccattgcctccacggattaaaaaggtgttcccagccctgcagtttttcttacagagctcagttccttaactacc

SEQ ID NO: 14681 - DNA, 396 bp, Homo sapiens
  misc_feature 396: n = A,T,C or G
ggcacgaggatcagtcaaggatgacgtgagggtttgctgggagcaccaggaatcctggagaaggtagtggcaagagggtgcagcaagctcagctgggcggggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagtttgn

SEQ ID NO: 14682 - DNA, 396 bp, Homo sapiens
cgttgctgtcggcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagttggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtg

SEQ ID NO: 14683 - DNA, 395 bp, Homo sapiens
cggcggcctacggttgcgagatgacgacagaaggggattaaattcctttgttcatactcataaatagcactaaagtgttataacattttcatttacctatttttagttccttcattttaacttaataaaaatcttggattgatattctttgtttttttttttttttttgggggaggggggttgtttttttaccccgggggggatgacgggggtttttttttggtttcttggaaacccccccccccgggttaacccctttttcctggtttaacctgccaagggggggggaacgggggccccccccccccccccggggaaattttttgggtttttaagaaagaaagggggtctcccccttggtcccagggggggtataatcttctgccccttggaac

SEQ ID NO: 14684 - DNA, 396 bp, Homo sapiens
tcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggag

SEQ ID NO: 14685 - DNA, 393 bp, Homo sapiens
  misc_feature 393: n = A,T,C or G
cgttgctgtcggacgccggtgcagtctcgaaccatccctctgttcatgcgaaacaaagatgtcgctgcagaagcggccacaggtagcggcaaaacactcgcttttgtcatccccatcctggaaattcttctgagacgagaagagaagctaaaaaagagtcaggttggagccataatcatcacccccactcgagagctggccattcaaatagacgaggtcctgtcgcatttcacgaagcacttccccgagttcagccagattctttggatcggaggcaggaatcctggagaagatggtgagaggtttaagcatcaaggtgggaacatcattgtggccactccaggccgcttggaggacatgttccggaggaaggccgaaggcttggatctggcn

SEQ ID NO: 14686 - DNA, 369 bp, Homo sapiens
gaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccaag

SEQ ID NO: 14687 - DNA, 358 bp, Homo sapiens
ggatttcaccatggtggccaggctggtctccaactcctggcctccaatgatcctcctgcctcagcctcccaaagtgctgggattataggcatgagccaccgtgcccagctgctaactagaaatgtaaagtgcacagagtggtagtgctggtaataattctagagtataaaaacaatttaaaattttttggagaatttgtttttcagatttgaaaagaaaaggggaatgatacacatatctgcttaaaacaatgatacaggaaaggttttttttaaaacaggctaaaaattttgccttcctttctaattctaaagatgatggaaatgaagaccattatgtgggccagggcggtgggtca

SEQ ID NO: 14688 - DNA, 175 bp, Homo sapiens
cactgctttgtaagacttttcttattttttcatatgtacatttgacttttccagctaggctgtaagttccctaagggcagggtgcatattttccatatgttttggcacctatactaagcctgggtatatagtaagcaattaataatatttgttaaggctgggtgtggtggcttat

SEQ ID NO: 14689 - DNA, 172 bp, Homo sapiens
tgtgtcatgggaagaagttgaagggttttagttagggagagtcataataaaggttgcagtttaacaatgtcattcttgaggaataccaggtaaacttacagatcagacacttaatttatttctacttgctccgaaaactccactgacatgagcatagagagtcaaataaagg

SEQ ID NO: 14690 - DNA, 172 bp, Homo sapiens
ggaacctgaaatgagaaaagggtagtgaaggaagacttgatgtccttcataactggcctgcatcctgcccagcccctcctttctttccagaagcccaccagtggcccagagtggaagggtgggagtcagaccagtccaaggttgctaattaagactggactgccaggcacgg

SEQ ID NO: 14691 - DNA, 386 bp, Homo sapiens
cgttgctgtcgtggagtgacagtttccgcccacccctcagcagtgcctgggctcacctctccacccacctccccacacagccagaggcaggccctcagccgcaatcagtaacattcagtgaggacatgtgtttatcatgtgttgtgggtgggtgcagtgagttctctattcaggtaggagtggaagctggctcagggctcatccagtccaatgtcccacaggtatagaagtgccctgataaaatctcagagctggctgtccagtcaagatttgcatacctccagaaatggggctcttactacccctcacagtagcccattctactgttgggcacctccaatggtcagcattttctttccggcagcctctttcttgggctggggggg

SEQ ID NO: 14692 - DNA, 278 bp, Homo sapiens
gaaatatcagcctaaacgtagtttatgtttaggaagcaacaaccgtaaatagtcccacatccaaacggagtggatttaggtttcactttttcaaggaaaaaccatcaaagaatttttccacatacttataaaccatcccacgtatagaatccatttttactgacacaaatttagtaccaataaacgactcttcttctcaatttgttttatttaacaataagtcttgaacgtcattcccagttaacattttgaagagtttcctctctttcgttctgttt

SEQ ID NO: 14693 - DNA, 385 bp, Homo sapiens
cgttgctgtcgctggaaagtgggataatactttttacctcatggacttgtcaggaggattcattaaaacgactcgcataaagcctatgccacatggtagatgccaattcagggtctcaagaaagaacagcccacaggattgacactgaaccttaacaaagttaacaggaccaagctgcagagagggtgctaggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctaa

SEQ ID NO: 14694 - DNA, 363 bp, Homo sapiens
ggtttgaaaagtctgttctaatttcatttcgatgtgacttagagaaaaatactcccccgtgcctcatgcccacactctgggcagtgccacccgcagctcggcaattgccaccttccttgctgtggtttcccagccttgggccctgcccagacattggtctgaggctgcctggtgctcttccccaccaccctgggggcccaggtttctcttccccctgcagatccagaggcgtaaaactacatttggtaacctggtttgtcatgaaagtggacatttgactttttcttaaaaatgtttgggttatggctgggtgcggcggctcacgcctgtaatcccagcactttgggaggctgaggcaggcgg

SEQ ID NO: 14695 - DNA, 359 bp, Homo sapiens
tataaccatttctcctcacaattatactagagaacttagccaagctaatcacaaaataacaagaaattgtaggttataaaatggaataaggaaataaaactggcattacttgcagagaaaatgactacatgttttgagaaccccaaaatctgcagataaactgttagaattgacaaggctatttagcttcctatgaagttgatatacaaatatcaattgtttgttaacataagagcaataaagaaacaaagtgaaaattattaaaaggcaccattcacaacattatacacaaaatcaaataattgtaacaatgtaagaaatcaacagacacatacacaaaaaataattattaagataag

SEQ ID NO: 14696 - DNA, 332 bp, Homo sapiens
tccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcacagagcatgagtaagccggaagcagagcaggagagagaatggagcatgtgtgcaaagagggcggtgagatgctgagagtaatggggctggcccaagatgaagtgagaggaagcaaagtgagacagaggg

SEQ ID NO: 14697 - DNA, 330 bp, Homo sapiens
  misc_feature 330: n = A,T,C or G
caaagcttactactcttagtgaatttgagctttcctcccttctcaacgcttatggtttgtataagtaccatgaagagtcatgggaattttgttccttttatttatgagatatatattcaatatatattcatcttgcacatgtatatacatcctacttgcagatttaaccttgacttgaaatttgaaatatttaggaagaagaaaggaaacgtcaagaggaaatagaacgccagcgtcgagaaagaagatatattttgcctgatgaaccggccatcattggacattcaaattggggctgcaaaaaagggcccggtatgaactgaaacatcn

SEQ ID NO: 14698 - DNA, 386 bp, Homo sapiens
cgttgctgtcgaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagag

SEQ ID NO: 14699 - DNA, 387 bp, Homo sapiens
cgttgctgtcggagatcctgtgtacaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgact

SEQ ID NO: 14700 - DNA, 352 bp, Homo sapiens
gttgagaagctgggaatggtggtggaacctaaaagacttccaactctgaggaaattgtggtagaaatggaagcagtataacctatgattgaacttaaccgatgtaggtgattgagattgtatttgcagagacaatgcttaaagaaataaaagaaacccagacataaaaactgaagctttaatggagatacataaatacataggaccttggaaaacaaatgaagtaatataactgcatataatttgtttacatatataaaacataggaaaatggaaatacagtgtattcttaagtgtacatttgtgtgtgcgaaatttattgagtgcttttactttacataaaccgcggaaag

SEQ ID NO: 14701 - DNA, 350 bp, Homo sapiens
aagtcggcagagcaaggacttgaagtaagctggaggtaagctggagtgtgaagtgtgaaatgaactgtatgtgccccttgcaagggtgagcagccacagtgccagctgatgttaccttgtcagaatgtagcttcagtattgctatggctttgtttttctttcaacttgcaaatgctgataactaatacaaaattttaaactgttgtctgcaaacatagtcttggtccaaaagctccttcagctgataagcaacttcagcaaagtctcaggatataaaatcaatgtgcaaaaataagtagcattcctacacaccaacaacagtcaagttgagagccaaatcaggaatgcaa

SEQ ID NO: 14702 - DNA, 351 bp, Homo sapiens
ttaatgttcaaacaacccatagagtggctatcattactcagattttatcttagagaaatcaaagctctaataattcaggctacttttgaaaatttattcatcttcttatgactagaaacaaatatttcaagcccaaaagataaagatttaaagtaaaagaagtcttaaagaagaggcagcacaatacagtgctgtagtaaccttttgtgagcatcagactcaccagtggagctttctgaaaatcacatgcccagctctcacaacttggggagactgtgattcattagatctggagtgatgtcctgcgtatactgatgtagtgaaaagaatatgagctttgcattcccagtt

SEQ ID NO: 14703 - DNA, 351 bp, Homo sapiens
atgtggaaattacaaatgcatcaaagtattctaactagtgtttagaaatctaaaaatgaaaatattttgcaattatgaagcaaagatgactgacttcaacaaaattgcatgctttcaaagttcacaaaagtatcaagttttgactatgcaaatgcaagaagcactaagagtaacgataagctagcacctatcagagaggtatttcaaactatttacagctaacaccagtctaatctttaaaaaaattaaatataggtcagtcatggtgactcacacctgtaatcccagcacttcatgagcccaaggcaggaggatcacttgagcccatgagttcaagaccagcctgggcaa

SEQ ID NO: 14704 - DNA, 378 bp, Homo sapiens
cgttgctgtcgggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatcccccggggaggtgacagaggtagt

SEQ ID NO: 14705 - DNA, 357 bp, Homo sapiens
  misc_feature 357: n = A,T,C or G
cgggtaatatttttagtagatacagggttttgccatgctgcctaagctggtctcaaactcctggactcaagcaatccacctgccccagcctcccaaagtgctggggatacaggcatgagccactgagcccggccttaagacatttttcttacgagggattttttagccctgagggaaatttatcatgaaagcaatagagttcagagcaagaactctggaatcagagctcagatttgattctggataaaacctgaagagttatataaccttggagaagctaactgccattttgaaccatagtttcctcacgtgtgaaatgggtttcatgttaatatatataactcatggattataggn

SEQ ID NO: 14706 - DNA, 351 bp, Homo sapiens
tattcaatttcctctgttaatggttcctcaagcataatctgagacctcccccccacccgccaacagggcctggagatcataactatttttattataatgtttatgcatttttgtctttttcattgtgctgacatttgtgaagaggaaaacggctggttccttaccacgagtcaaaggcatagcagaaaattgttttactagtcatggtattttttttttttttttactactatccactcacaaaaaaaaaaaattttagttccactgaaaaatacttttggggaacacccaaaaatttttatttttattaaatcttgcccctggggcactttaaaaaaataaattttttgg

SEQ ID NO: 14707 - DNA, 352 bp, Homo sapiens
gaataaatgtgttgaaatttgtctttattcacgagatcattagaggctaagtcatggcaacacgtgtagttcaattcaattttttttgtgtaaaattttgttgagctgcatccatccgcatatgtaacactaatttggtaacagcttctttatactaagccagaattaatttgtcctcatggttttgttttaaatgtgtgagctgtattatatcacatttgaacaagtaatatagagaatataaatttagtttagagaaagaaaagtacaggcacactaaaaatgaattaggatctggcagctgacactgattaacaggttgagcaaattcaactagacctaaatctctgtg

SEQ ID NO: 14708 - DNA, 353 bp, Homo sapiens
acccagtatgtaaataccacttcccactacaataaaagagggctcttctgagacaagtttaattccagatctagggaagacaatgtataaggtgaggcagtaaaatcatgtcttactagagaaaaacgattaagtgaaaaggacaaaaaccactgggattaagtgaaaaggacaaatacgaaggaagatgctcctactggcccaaaatggatcttttaatcatcaataagaactgattaaagttgattatagattaaaaaataaaatccactggtaaccatggaaagataagggtgaagtttcatttatttgtacaaggaataaatggatggcagaattagaatatcactggt

SEQ ID NO: 14709 - DNA, 350 bp, Homo sapiens
ataatcaaatagcccagaactggggccaagccaattctcgtcattgacaacatattcgggattgtccatgggttttcatactgaaacacaaagacaacaaaatttaagtaaaatactatgaattcatactttgaataactatatacatacattagaaaaatatacttcatcaacttcagtcagaagctacataaactttaaatttagcacattaaattgaattttaaaatccattctgttctttttacagatatctccctaaaatcttctttcaagaatacagaagatggctgggcatgatggctcacgcctataatccctgcactttcagaggctgaggcgggatgaac

SEQ ID NO: 14710 - DNA, 350 bp, Homo sapiens
  misc_feature 59: n = A,T,C or G
gacagggctgaagaacacaggtcgctgcatttagaaaggaggcggggtcagaggaatanaaagggacagggctgaagaacacaggtcgctgcatttagaacggaggcggggtcaaaggaatagaaagggacaggactgaagaacagaggtcgctgcatttagaaaggaggcggggtcagaggaatagaatgggtcagggctgaagaacacaggtcgctgcatttagaaaggaggcggagtcacaggaatataaagggacagggctgaaaaacacaggtcgctgcatttaaaaaggacgcggggacagaggaatagaaagggacagggctgaagaacacaggtcgctgcat

SEQ ID NO: 14711 - DNA, 380 bp, Homo sapiens
cgttgctgtcgacctgttttttctttttttctcaacagcttatttcattttttttttttaattaaaagtttacttttacatgttttgaatgttggaatattggcttatatggggactttttggttttattaaggtttgccaaattaataacaattttcttatttttaaagggtctatccatgttagttcagctatcactgaagaccaaaagaaaagtgaaaaagggcgaccgaacattgcaaaaattgaagacatcaaagttttacaagaaaataatgaaggactgagagcatttttactcactattgagaatgaacttaaaaatgaaaaggaagaaaaagccgaattaaataaacagattgttcattttcagcaggaac

SEQ ID NO: 14712 - DNA, 355 bp, Homo sapiens
gtgccccacgaacgaaagtgtcttcccatcagtccctgcactgggaccggggatcctggtgtcccttgttcgagctcagggtgtgcctcagccgctaagtgaaccccaaggggggctttgggcgcacaaagcccatgaggggaaggtgagttttgaggggagaggtgaggcacctgtcacagaaaaagaaagaaaaaacccgcgccgtggagaggtggggcctgggtcccccacggatgaaagtgccttcccatcagcccctgtgctgggtaccggggaacctggggttcctggtttgagctcatggagagccttgggccactaagggtaccccaacgcggtggaaagcccatgg

SEQ ID NO: 14713 - DNA, 381 bp, Homo sapiens
ggcacgaggggaagtgtgatgacgtcttgcggctcctcatggccgagctgggcttggagatccccgcctatagcaggtggcaggatcccattttctcactggcgactcccctgcgtgctggtgaagaaggcagccacagtcggaagtcgctgtgcagaagcagagaggaggccccgcctggggaccggggtgcaccgcttagctcggcccccatcctagggggctggtttggcaggggctgcacaaaacgcacaaaaaggaagaaagtgacgtaatcacgtgctcgatgaagaacagttggcactttgcagatggccagtgtcacggtgaaggctgggttgcccccacgggtctagggagaacgaactctttggggatgac

SEQ ID NO: 14714 - DNA, 347 bp, Homo sapiens
  misc_feature 347: n = A,T,C or G
atagtctgtcacttaccattgtttctgcaagccaagggcattttttatgattttacagttacctaatttatagtttataatataggaaagttcatttattctctaactatatgagccttaaatatcttggagatttttcctatgatttgccccagaaattaaaagcaattcagggggaatgaagaatgaaatagagaaataaaggaagtctgaaaattcagaaaataaaagtatagtttgggcaaagcaactctaacaatattatcatgagctatctatctttttcaataacaataataactcatggtaaagctctatttttttctcataaggctactttgaaatgn

SEQ ID NO: 14715 - DNA, 343 bp, Homo sapiens
  misc_feature 343: n = A,T,C or G
gaaccaatcttgaatagggaagtgatgctacaaaaatgctaaaaaatgaattaatataatgcaaatgtcagtttagtaaatataaataatgatgcttatctatatggaaagaaggcaaaatataaataggtagtctattcatagatattacattgatccaggtattaagaacatgaaatcattaggctctattaaaagaaaaattcattgtaattcatacttattttctaatcacttgtaatagaatttttaatagtctatttttcagaacaattttaggctcacagcaaatacaatagaattttagttatacaattcatacatgaatactatttccttgatn

SEQ ID NO: 14716 - DNA, 342 bp, Homo sapiens
  misc_feature 342: n = A,T,C or G
tgatgaattatgaaggaaggacatttattttgagaatcatgagcattataatatttattgaggattagaattttgttatgtggaggtgctactacctcctcatgagccacttctgcactcaatctcagtaagaagaaaatgattaatttgtaaaatattaaattatcatgattttttcacttttctgtcggttttttctgttaatgtcaggtagcttatctttagtctttatgattaaaaatgggagaaagatatcatattaaaaatgcagaggctgggcacggtggctcacacgtgtaatcccagctttgggaggccgaggtgggcagatcacctgaggtn

SEQ ID NO: 14717 - DNA, 350 bp, Homo sapiens
caagcatgagacacacatctggcagcttaacatttaaattacgagggggaaaccctcacttcagtagtaattttctcaaagaaaagaatagggaatggattacaactaaatttaatttctttttaaattttcatcttgtctaattgcaggcatttttctgggttctttgtattcatatattttcacacatattttctgtagattttattcatctttaatttgagatgcttctcactattagagctcttgaaaaattgtggtatattttacatagaaaattatctcgagacatctatctgatctcaagtaatatagacatggcatagaaaatacaaggaacatggttttct

SEQ ID NO: 14718 - DNA, 345 bp, Homo sapiens
ccatcaagcattttgagcaaagccaaaaatattatgaagaaaataaaagaatgaataactatcagaataagaatgtgtggagatctgactaaataatatctctgttttattatagaaggaaatgtaaatttatgtggaagagtgctttaaactgtaggaataggacttccaagaaggtatattttggcacagttgccaagttcatgacaatcaagtaggtcgccttggaataaatgaaggaaagaaagctctctgccaatctgcaatcgcaccccttactcctactgaactggcacatatactcacagatattgctagattttagggtactgagggacattgatt

SEQ ID NO: 14719 - DNA, 347 bp, Homo sapiens
agattgaaaactaacatatcaaatataaaccacataaccataaatgttttattttacgttcaactactgttttctgtttggtgaggaaacaaaagtcagggcaagagggtgccaataaggagaaagcagaagggacaagaaattggaggcttctgtaacaaagaacaactagaatgtgaatagagaaatgaataaataccgaagaaagatcgacttggctctttgaagaggcccctggattaaggccgtggaagagatcgagtactggaagattgtcgtcacaacggagaattgattgtcataaaagacgacgctagttgctgcaagtcatacatgtcactggctgg

SEQ ID NO: 14720 - DNA, 371 bp, Homo sapiens
tacggttgcgagatgacaacagacgggcaagcataagtacgctgaaggggcatctgacaaggctattgatgtcctcatagaaaggaataagcatactgggacacacttttagcccttatgacttgctgcctggaatgtgtccatgacgcctggagatgcaggagcgtgaagatgcacagcaagcagggagagaagctgggtctttgaccactatcttgagcagctgtgccagccccaggctgcatccacttcttgttattgggaaggacaaagccctatttacagacaagtctctattccatgcagcttaatgcaatcctgactcataaagtacctccaaaccaccgctccccagttgttccatgtcaggt

SEQ ID NO: 14721 - DNA, 317 bp, Homo sapiens
tagttaaatataaatgggtaattaactttccaaaaagaataaaacagtcaatctctctgcacacacacacaagatgcttttcttaattttttctgtgaatgacttgacttgatatttaggttttaattttcttgaacaacttaggtgttgcaaaaataaaaactgttgtaataaaagttttatggcttggagagtcctacttttcacagcaaagctgagggagaacggaaaacacatagctttgatgggattcttcataaaatagcttgttttttgtgctgctgaaaatagtattgatggcttggagatgtcacaaa

SEQ ID NO: 14722 - DNA, 315 bp, Homo sapiens
gtgtatcacatatctagacttcttgatggaatattgaatttgaatacttatactataccaacatctcactaaattaactaatgaatactgaattttagaatgcgttacttgatttactgtattatcagtaagtagccctaatttatgtacagaaatttaaatgtatgaattttaatcacatttatatcactttatgaacacttaaaagtacattcatgacccaccagtgggccacaaatgctactttgatctacattgagtttgttacatacatatccttgaaccctataatggattccatttagtcttaccggg

SEQ ID NO: 14723 - DNA, 293 bp, Homo sapiens
aaaaaaagcttaatagtcataatatatatgggatttttacaaaagaaaaacaccaaaatagaaacatgtataaaggaaattaaaaggaaatcaccaaagacaaaataagaaacccctcaaaaaacagcaaattaaaatgagacatttttgggttgggcgtggtggctcacgcctgaaatcccagcactttggcaggccgaagtggctagatcccttgaggccaggtgtttgggacgagcctggccaatatggcgaaacccctctttactaaaaatacaaatattagccagtgg

SEQ ID NO: 14724 - DNA, 343 bp, Homo sapiens
atatataaactacaatcagagcactgttctgtaattacaggcttttacatctctctctctcctctagaacaattctctctttcaggataggaactgtaacttattagcagttacatcatcagagctagcagagtctggtgaattgtaggcattaaatatgttttggttgaataaatgaatgaaatatacattccattcctaccccaaaccagtataattttcttacacctctattactcaacttcctcacaaggtctgccagtcaagagtcttagcagccacaacagctccttcaagttaggatcatttgaggagagtaaagtgatgacttaaaaaggtatgg

SEQ ID NO: 14725 - DNA, 375 bp, Homo sapiens
cgttgctgtcggaaatggtaaatgatgtacaagaattgccagaagagtcaaaactgcattattaataattgtgaaaaattacaagcaaaacagctcaaattcatggaagattaataaataggaggtgggatagttatgtaataaattattataccgaaacttaaatagatgaattagagcctcatgagtcaaccaggataaattttttaaaagttcagagtaataaataaggcgcaggcttacatttataatataatatctgaaaacttaaatactaaatacttatccaacataggtaataatagttcaaacatgcatggaatggaaaaacaaattcagggtagtggtaatctctgggaaggaatgagtgaattt

SEQ ID NO: 14726 - DNA, 343 bp, Homo sapiens
agggtggagcctgccctcctccacctgacacccccaaccaggcctggggctcggtgtctccagctccaagtcttcccctctccaacagccacttaaaggcctccctctggctcttctcagagaagaaaatcaaaagaaggagagagggaggaaaggcagtagttcagggcatggattcaaatctgcatgtaggagatggaaaagcaaggtaggagatgggcagagacacaggaagagcaggagatgtagggtgtggccttagcacttgctgggaggtaggggtgggacaactgagtgaggagctggcttagagagcagactgtggagtttagtcctgatggtg

SEQ ID NO: 14727 - DNA, 363 bp, Homo sapiens
tctacacttggattaagacaagacaagagacttcgatgtgacatgacgcaccacattaggatagcggagtaaaggatgcttgatatgagacagtggctatgctatagtgttattctaatccaataggagctgaagcagacccttttgaaacatcctgtgcgatagttttatgattgacggacatgaggcgcagtgggaagtttttttctttcctaaaaacagattgagagagtctcaatctcaagggccagttaagaaactcatgggtgagcctgtaatcccagcactttgggaggctgaggcaggcagatcacttgaggtcaggaaatcaagaccagcctggccaacatggtgaaaccttgt

SEQ ID NO: 14728 - DNA, 335 bp, Homo sapiens
aggctttcagaaataaccaagaacatcaaaaataaagaggacttttacaagtgaaaaatgcagtaatcaaaaatgaactcaaaagagagattaaatagattagacacaactgaagagaaacttagtaagtgagaagctctatcagaagaaattatgcctaatacatggagacaaagaaatggaaaatattcaagaggagttaggaaacgtgtaggaaagaatgaacagctttaatgtatgttgaattgatatgcaagaaataggaaatgcaggcccggtgcaatggctcatgcctgtaattctagcactttgggaagctgaggtgggtggatcac

SEQ ID NO: 14729 - DNA, 340 bp, Homo sapiens
cattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgacaaaatgtctaaggcctttacagaaacatttttagtaatgaggatgagaactttttcaaatagca

SEQ ID NO: 14730 - DNA, 258 bp, Homo sapiens
cacaaattgctctttgcttaaagatcttcttttgttttgtttaacttttctagtgcattgtatatcttgtctaaattaaatccaattacgttaacaacatttaataaacattttcctcctgtgttcaaaagtgattttgtttatacttcatcagggcgttcagtggttgggcagatcaagaatactatatttaggccaggcacggtggcctgtaatcccagcactttggggggccaaggcaggcgaatcacttgaagc

SEQ ID NO: 14731 - DNA, 337 bp, Homo sapiens
atttaaagaaatgaagatatgtccctatttctgtactgtataatttcaattgtttttcgcttgctctaaagttcttatcatcaataattatgtaacactattatatactcactatgacacttttaagaatggaaaaactattcttaggcatattttatttttaaaaacttcttaactatataatagaagagcagagatttttgcttcttttttaaacatttactggctgaatatttttcaatgacacttactatttgtataagtttcaaaccagatttgattccaggccaccagaatgaaatcattacctgagtcaacaggattacctataggcccg

SEQ ID NO: 14732 - DNA, 340 bp, Homo sapiens
cgggggcagcaacaagggccaacagccctggtgctggtcagagatccacaaaactgtcaccttcactaactggtatgtggtgatgttggaacctcaaagcactcaatgtctccttttcttccagaaagggccaaaatgacctcctaatgacagatttcctatcaagggcatattcctggtccctaatataaaaaatcaagagttatttcaattattcaccccccaccttccctgaatattccagatgtcactaaggaaagtctaagatgtggaacttttgctgcaacttactggaaacattcgtccgttactcacttaaattattcaagcaaattagggg

SEQ ID NO: 14733 - DNA, 339 bp, Homo sapiens
aacactaatatttatatgtaataagtctaaaaaatagacaccaacagccagaaactgagtagaacatcaaatctaatgaaagacaaagacttcaaggtataagaacagattaagtgcaggctgaatccaaaatggactatataaactaggaagcaaggtataagatactattcttagattcacaggaactgaaataaaacatctaactctcaacttataattcatatagcactaaactaggttctaatgtttttattcctataaaaaagtgtgttcaaacaaaactcattattgttgatgggaacaacaactgtgccttacagctcaaacttatgtaag

SEQ ID NO: 14734 - DNA, 339 bp, Homo sapiens
  misc_feature 265: n = A,T,C or G
cctcctttgttactagtttggagcagatccttgcagacgttttcctctgcattcacatgcatgcaaatgtacttctgaatgcgcacgtatgtctttatatacagatagcttttaacaaatagcaggtggggccggcactgtggctcacacctgtaattccaggactttgggaggctgaggcggggggatcacttgaggccagaagttggagaccagcctggccaacatggtgaaacaccatctctactaaaaatacaaaaattanctgggcgtggtggcgggtgtctgtagtcccagctactcaagaggctgatgcaggaaaatcgcttgaacccaagg

SEQ ID NO: 14735 - DNA, 337 bp, Homo sapiens
ctgacttctctaccctgctcatattttcccccaacccatccctcttcccaccttttagtttttgaatccgactaaaggaactgaattccaagagtccaataaattaaagaaaaaaaagtcatacaatccctacatccaggaaataccaatgtaatattatgggcttttttttggtatgcgtttaagaaaatactatttacataaaaagttaaatatccaatgttttgcttttaacttaatgtcattaaattaaataaacactaagtttacacatttatttaaaagtaccaaggtacttttaatgaatataagataatttacttgactactgctttaa

SEQ ID NO: 14736 - DNA, 338 bp, Homo sapiens
aaatcctatatttctggtttcggacattttggctattaaacaggaatactccaaactatctctttcaaaccaattatttttcaattttataaatcttccaaataagcaaaagcaaccacaaccataagaacaaagaatatggctacatttatatagtatgttctttttcaaataatttgtaaaggcaaatttgaaagctctagttgtttacacgttatcagtgatgagataaaaatgttagcataaaaatttggaaagcattaaatataataggaattagagattgattatgtcaatctgatcagtaaatcatgctgatttactgaaaacaaattaca

SEQ ID NO: 14737 - DNA, 337 bp, Homo sapiens
tgaccttttgatcccaccatgggactgttccccagccctaagcccctgaaatggggggaaagagaaccctcctttccttgtgcccactctatgatcttttgaacatgggttacctcccttcgcggcttttggaacataaggcaagcacaagctcttgagtctctagtttctgctgtcatctactcttcctgcctctggcacctcccagctcctgacttcctcctgcttacccctggagccagagacgtggctgggaagagcccctggcctttgaagccagaggtggtggtgaccaggggcaacaggccactgtgctcctggatgcgtggtctgccag

SEQ ID NO: 14738 - DNA, 338 bp, Homo sapiens
tataacagaacacattttgaagcacaaagtgacaggaagttcggcaggtttctcaggcctcatttttgaggtatcctcttggttttggggcctcatctggcattgcttgctcaggccaggcccagcaagcggggtgtagggcagggcacacactggctacgggggtctctgcagcaggacagagggggctccctacttttatttttcctggggggctccttgactgctttggcaagctgatactcggcgttatctggtgtgttttataattttttttaggatgtgtgtgttcttcccttggagggggtgccgtctttaatttttctgcgggggggttt

SEQ ID NO: 14739 - DNA, 329 bp, Homo sapiens
gaagaatgaggatcaaaaggtaaaatactttataaattaatttttcttttccttatcctccgtgactgctataaagactgtgaaaggtgaaggctaatggagtagaacttccttacatccacaatgtatgggatctactgtagtctacacagttgacagtgtaacataagccttactagatcagttcattattataattctatggccaccatctgtccctactcatagtaagtttacagagacgataaaagatctaatttcagttctaccgatcccattggctttataaacccttaactgaagcttagcaaaaggattagtagaaaacg

SEQ ID NO: 14740 - DNA, 332 bp, Homo sapiens
ggcagccttcatgacccacatgtgaatgtgtcttatatcaaatattatgtttaatttaattatgtgcaattgaggtagaataaaagaagaaaaaaaagactaggacaagtggaaaagaaagagtagcacagtacatttacagcagttggaaattatacattttgcataagaggtaatcaggatatagactaagcagcacttacaaagatattccaaacaaaactaatgtgcaaacaaaatagaaggtatctctaccactttctctcattcatttaatagtttagttatcatccaataaaaatttaagacacggccgggcgcggtggctcatg

SEQ ID NO: 14741 - DNA, 302 bp, Homo sapiens
acccacctcagcctcccagcgtgctgggattccaggtgtgagccactgcacccagccaggtgtgatttttaggcggaatcttaacacagtattgaaagatttcttcaaaccagaagaaaagcaggtatctgaaacattttagtgctggccacagagttggagatgaacagggaagctgaggatcggcccgacggctggcagcaaatgagaggagacccgagcgccaaacattgacatgacttctgttggtcatgcggcctcttggaaaatgtttttccatgaactgttgtttagaaatgtct

SEQ ID NO: 14742 - DNA, 331 bp, Homo sapiens
gagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaacaaaactgtccaagtttgtttaacgtaatgtgtttcaacttatttgact

SEQ ID NO: 14743 - DNA, 329 bp, Homo sapiens
ggaccttttgatcccatcatgggactgctgcccagccctataccactgaaatggggggaaatagaagccttctttccttgttgccactcttgtatcttttgaacatgggttacctgccttcgcgtcttttggaacaaaagggaatcataagctcttgagtctctgttttctgctgtcatctactcttcctgcctctggcacctcccagctcctgactttctcctgcttccccctggagccagagacgtggctgggaagagcccctggcctttgaagccagtggcggtggtgaccaggggcaacaggccactgtgctcctggatgcgtgg

SEQ ID NO: 14744 - DNA, 323 bp, Homo sapiens
gggggggcggtaaacgacagaagggaactgttgtatttttaatagacaatttcacgacgttggcgaggctggtcttgaacccctgacctcaggtgatccacccgcctcagcctctcaaagcgctgggacaggcgtgagacaccgtgctgggacagtagtaacttctaatggataatgtatgcgtggggtggaaaggggagtaccagtatttttatttctaacacatatacaaaacaccagcttgctgttcaccctgaagaaccctgggcacagagcttattcatattatcgtgccatcgtgccctatgcattcttcaatgggc

SEQ ID NO: 14745 - DNA, 328 bp, Homo sapiens
atccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggt

SEQ ID NO: 14746 - DNA, 323 bp, Homo sapiens
gagagaggacagagaggcgggtcacagcttgacctgggttggtcctttccagctttgggtcatagagaggaatttggcttttcctttaagtgcaatgggaaattgttgtaagattttgagcagggctgcaccattatttgacttatgtgttaacagcgtgagagttaagaatttgctgctaggccaggcgcagtggctcacgcctataatcccaacattttgggaggccgaggtggtacacttgaggtcaggagttcgagaccagtctggccaacatggcaaaaccctgtctctactgaaaaatacaaagattaggttgggca

SEQ ID NO: 14747 - DNA, 135 bp, Homo sapiens
ggaacctgaaatgagaaaagggtagtgaaggaagacttgatgtccttcataactggcctgcatcctgcccagcccctcctttctttccagaagcccaccagtggcccagagtggaagggtgggagtcagaccagt

SEQ ID NO: 14748 - DNA, 318 bp, Homo sapiens
ttgcctacaattctaccacgtattttctataagcatgcaaatctagtataggtagaggatattacaggctaattaatctcttggcatctggtctacccaggcccagtgctttgttcttgaacaaacaaataaaaaaaaaacacagagaaataaccatgcaaatatgagaaatgttgcagaaatttgaaattgagacagcttcctcttttctataggatttttttttaggggaaaacaatctctatattcagtcttatatattacctgccttcaaaaaatcaaaacattgaaagttaagcaaaattcctgtcagaaagg

SEQ ID NO: 14749 - DNA, 292 bp, Homo sapiens
aaatggacgaaggaggaaaaagaaaggagaagagtttgaagacagaagaaattaaggaaagtaaactaaagcaattgaaactatttggcaatcctttccctctcaactctaaggcttattctaaattaggggttttctagatatacaatcatgtcatctgcaaacagggacaatttgacttcctcttttcctaattgaacaccctaaattaggaaagttaaacacctaaaatgtcaacactttcatttaaagaatgtgggagagccgggtgcaagtggcccacacctataat

SEQ ID NO: 14750 - DNA, 324 bp, Homo sapiens
gggaggggcgggagggaggataggagagcaccacacatagtcaggggaggctttcaaaagagtcttgactctaagaatacccaaaaagaaaggtaatgcaaatttcaaacataccacatgcattttcttttccttcccaaatcccactaaggctattttttttaaatccaggttctagtcctggttttgtcatgaccttaatttacccttcacctaatcacctttgactcagtttcttcatctataaactgaggggcttggcctcactgagttctaatgtcctttatacatttaatcttctatgagtctaagatgcaatttctc

SEQ ID NO: 14751 - DNA, 325 bp, Homo sapiens
tcacagtcaccacagcttcgttgcacatcttatttcttttgataatccttcaggtttttttttaaagacaatattgtacctttattttaattattatacatttcttacattgtcttatgattctgatggttcttcagtgatccactgaaaacacctttataatcactgaataggatattaaagaagtgtttttcttgactttatcacattgcttttggatctttgaaactggagagaaaagtcgggcacagtggctcatgcctgtaatcccaacactttgagaggccaacaagtttgagtccaggagttcaagacaccctgggca

SEQ ID NO: 14752 - DNA, 322 bp, Homo sapiens
aaggtggctttactaatcgatattcttatactgacaagtgctcaaacatggcgtggcaaagccttcattaagcactgattagcagttaatctgtctttcaggcagctaactttgctgagtaaatgtaccaatgacccctaaaaatgctacaataattttatttaaataattgcaagtcttaggaacacctctaaatcataaaaagaaaatgaaaaaatagaatgggtgacactaacaatgtgtattttttgttcattgctaaaaaaaaaatgaaggtacggtgtcaagtttcatgggtgactttttcttcttagtcggaaat

SEQ ID NO: 14753 - DNA, 319 bp, Homo sapiens
ggctagagtacagtggcatgatctcggctcactgcaacctccacctcctgggttcaagcagttctctgcctcagcctcccaagtagctgagattacaggcttcggccaccactcccggctaattttttttgcatttttagtagagatgggggtcctcccccgtgcctcccctaccactcatttcgatcccctcaaattcatcttctccctgcttctgtggctacattatcctgacctgacggaatatcgttctgcatggctcgcttcccgatattttccccttgcacatcaccggttactcatgttattgcccctcgag

SEQ ID NO: 14754 - DNA, 322 bp, Homo sapiens
tcagctaattcactcttttcttctttctggtaaggaaattgaggcttcagggtgattttgtgactttccagacatctgtagtggaagaactaggtctaggcccaaatcatttaattactagctgagcgacctgcacacaactgcaagaaattgttccatcacaaaacttcaggatgattggggttctctctttttctctcttttattccaagcttaaaaaaaaaaatctgctgaacgtcccactggagctgaaattgtagaagacaactagctctttaattatgatgtgcagggagctgcttttacttttcacttggctctg

SEQ ID NO: 14755 - DNA, 321 bp, Homo sapiens
accctactacttgagaaattagctgctcaatattgacatggacactgagaagaaaaatacattttggcataaaattaggaagaataaaattttattatgggaggcttcatattcaaaaacaactaaagcattttaaaatataccatttacaataacaaaaagagagttaactgctcggatcccattgaagttcatgaagttgatatactgtagcaatcaaaattctcaagattaatatttcatgacagaatacctggatttagggccaggcgaggtggctcacgcctgtaatcccagcactttgggaagccaaggccggcc

SEQ ID NO: 14756 - DNA, 321 bp, Homo sapiens
taaatgtctactaccatgtttaacattatatttgaccagtattcattgaacagcaacagaaaaaaaatatagaatatataagcaatgttctcaaaaatctattagcagtaaaataaaatatttttcttatagtgaaaaagtaatcaccatgataaagcaaattccaatataagtacagaaatatcatacaaaatattttacagtttttagttccattcctgttatgtatgttagtaaacaaaaattagaatattttaaagcctatgtatgacagttaactatcagaattattcttgtacattgagaacactagacagtagg

SEQ ID NO: 14757 - DNA, 322 bp, Homo sapiens
  misc_feature 322: n = A,T,C or G
gaggaaactactgtgtatatgtttttaaaacattttgaaatggtccatatacttacatataatttctgaattctgaaagaccaagatgattcttcaatagccacaggtcttggaccctgtttctcttaataactgtaactatagaacttgctcagtgccttactcttaggagaggcttcagaaatatttattgcatgcaattactgaatatatggcacatgtaacatctgttgtatcaacagataaacaggattctgagctgtttttttctccattgggcttcaggtacatagaaatggattgacggccgggcgtggtggcn

SEQ ID NO: 14758 - DNA, 334 bp, Homo sapiens
agaaggggggcaccctgccatgccactgctgcctgtgtatgtgcatcccacccttctccccgctgctgaaccaccactgtagttagaacattgtcggggacagagcccaccagccccgctcctgccagggcccactcctgtgctgaaattatcaccagcatgaaactagacatgaagaaaagcagacctagcccttccctgagtggccactcctgcccatgggaacacacacagagtgtgcacacagtcctgcaccaaccagtgccccacccctgcactaacatcactgctggttcacacacccacagttatggggaggggcgttttcccaagc

SEQ ID NO: 14759 - DNA, 322 bp, Homo sapiens
aggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcccaggaggg

SEQ ID NO: 14760 - DNA, 156 bp, Homo sapiens
tccggctgctatatttctattgagggatgcatttgccgtctgcctcctctttcttgttgtttgtgttagttgatttgttcgtttaggttctttaagtatgttttgttttcgtcttgtgtttggcttatcatgtattttggtggtcagggtgtcttg

SEQ ID NO: 14761 - DNA, 233 bp, Homo sapiens
tcttataggtgatttctgtcttataggtgattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttatttttttcctttgttcttttttacg

SEQ ID NO: 14762 - DNA, 317 bp, Homo sapiens
tcactcaaaggtttcattgtctgaaatatcagcctaaacgtagtttatgtttaggaagcaacaaccgtaaatagtcccacatccaaacggagtggatttaggtttcactttttcaaggaaaaaccatcaaataaattttccacatacttataaaccatcccacgtatagaatccatttttactgacacaaatttagtaccaataaacgactcttcttctcaatttgttttatttaacaataagtcttgaacgtcattcccagttaacattttgaagagtttcctctctttcgttctgctttagctgcaaagtattct

SEQ ID NO: 14763 - DNA, 314 bp, Homo sapiens
cagaggattaagttgagcatggggcctcattacagggcagggactctgtgactgcactgccactttcccataaagcctgccttggggatggggaataccacgtaggaaagagagtctttaaagtgttctggggacaggttttaaagttatttgaatgacttaagagctcgtgatgtcctttagatacaaaagattttcacgtggggaaggacattaaatttgttttttataaagttcactctggcgtctaatcatgtagaaagactagtaggtaagtcaactaaaaaactgttggatagtctaggaaagtggtt

SEQ ID NO: 14764 - DNA, 313 bp, Homo sapiens
  misc_feature 313: n = A,T,C or G
taatgttagaggactgtgaaagttggggaaagaagtttagtttgtaggtacttgtttttttgagcagggaattgtcttggctggaggtgaatgtcagataggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggcacctagaactcattggcaaatagaaactttcaaaagatataatcaggtn

SEQ ID NO: 14765 - DNA, 314 bp, Homo sapiens
  misc_feature 290: n = A,T,C or G
gtgccttcccatcagcccctgtgctgggtaccggggaacctggggttcctggtttgagctcagggagagccttgggccactaggggtaccccaacgcggtggaaagcccatgacaggaaggtgagctgtgagggaggagaggtgaggcactactggcagaaaagaaaaagaaaccacgccacggagagcgggacctgggtctcccatggaaaaaagtgccttcccatcagtccctgcgctgggccccgtggacccaggcgaccctggttctaggcctgggtgcacctcangcccgctaggtgtaccccaaagca

SEQ ID NO: 14766 - DNA, 312 bp, Homo sapiens
acagtcagaggtaaagaggtcactgatgatcttggtcagaggagtttcaggagcctgacagggacggaagccggcaagccccgaatcagggaaggagtgggaggtgagaacagatgatcaagggcagatgactcttgcaaggcgtggctgagaagcatagagacacagtgaggctcttgggggacaactggaaggcatggggcactttgattttaactcagggaaccctgagcttacctaagtgcagatggccagtcacagctgcaacccatagactaagaagccatgggccaggtgcagtggctcacacct

SEQ ID NO: 14767 - DNA, 314 bp, Homo sapiens
gcgtgtgtgagtgggtgcatgtgtgagtgggtgcgcgtgcgtgtgtgagtggatgcatgtgtgtgtatgagtgggtgcatgtgtgcgtgagtgggtgcatgtgtgcgtgagtggatgcatgtgtgcgtgtgtgagtggttgcatgtgtgcgtgtgttaatgggtgcatgtgtgcgtgtgagtgggtgcatgtatgtattcgtgggtgcatgtgtgcacgtgtgagtgggtatgcgtgcgtgtgtgagtgggtgcatgtgtgaatgggtgtgtgtgcgtgtgtgaatgagtgcatgtgtgcatgtgtgaatgggg

SEQ ID NO: 14768 - DNA, 307 bp, Homo sapiens
ggaggcggctgtggcattttgctcacattggatacctgattgggacatttatttaaaatgctacccattttcaaatttctgagccaacatcatgatttaattataccggcttcatcgcaagttttacaatccgataaagcaaggcccacttcattagctatttttttctttatataacatgccctaaacattcattttttcttgtgaaaaaatgaaatgcacaattttaataaaattctaattatgacggctgacattccaattaaaaacctgcatttttgtttagagggctctttaataatattag

SEQ ID NO: 14769 - DNA, 251 bp, Homo sapiens
gaacaatacttttctctaacatcgtacgaggaagaaaacaaacacatcagatattttcagcactaaaagagatggctttccccacatatatgtcaaagaaatatgcaagactactggattttgatctcatggttgcagcgggtgaataggtggccttttgtgatctcctacatcaccctggaagtgagacttcttcgggttcttctagagtcagattggtatcagaatggcatagcaacttaaccttgcag

SEQ ID NO: 14770 - DNA, 309 bp, Homo sapiens
tgacctggatcaactatgaacatttacatttattagttaacatctacattggctaaactgtagcatctgacttgatgtcatcctaaaataatatttccttcggagtattttcttcactctgtaattgctaactgctttcctatttgttttgtaacttatttccttaattagagaatatttttaaaaataaaatttgagcaaggattgtagatacctgagatttagtctgcctctgctttaaatcagtgtaccagtttgctaagtttgccataatgaagtaccacagagaacgagtagtttaaacggcag

SEQ ID NO: 14771 - DNA, 309 bp, Homo sapiens
gtgccttcccatcagcccctgtgctgggtaccggggaacctggggttcctggtttgagctcagggagagccttgggccactaggggtaccccaacgcggtggaaagcccatgagaggaaggtgagctgtgagggaggagaggtgaggcactattggcagaaaagaaaaagaaaccacgccacggagagcgggacctgggtctcccatggaaaaaagtgccttcccatcagtccctgcgctgggccccgtggacccaggcgaccctggttctaggcctgggtgcacctcaggcccgctaggtgtacccca

SEQ ID NO: 14772 - DNA, 306 bp, Homo sapiens
  misc_feature 291: n = A,T,C or G
ggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttanagatctgaagttctt

SEQ ID NO: 14773 - DNA, 283 bp, Homo sapiens
cattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaaatgtctaaggcctttacagaaacatttt

SEQ ID NO: 14774 - DNA, 282 bp, Homo sapiens
gagccaccgtgcctggcctcaccattgttaaaattatggaaatcgtgtttgcaaagcaggttggcctgtttggaaaagggtgtcataatttctcaggtaactccaaaaagagaaagctacgaaaattaccttaatacattcattacagtctcagtataagattatagcttcctctcccaaagcgtaaccacaacctgacgcaggatgagttggtttgaaaataccgcatacaatatcctcttgagtagaatcataatttagaactctaaaaatgaccggaaa

SEQ ID NO: 14775 - DNA, 380 bp, Homo sapiens
atggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggaaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaaagaaaaagaattcct

SEQ ID NO: 14776 - DNA, 353 bp, Homo sapiens
ctgatttggagctggctgacaggaagtgcttcaaccccacaggagtatgctgatgtaaaacagagaagaattcagttcccacaacagaaagcaaaggctttagccttattttatgccagactagctgactccagggaccatgatctgtgtttctctgaaaatcattctactttctaatttctctaaacctacaaaaacttttctcctcctcttctcttttatcttcctcctctataacaaccaggcctttgaaggtatcaggggtgggaaagaaaaggtgctaatagggtaatatgtattgaaagaagtcgatgaaataaatttttaaaaacatcaagtaaaataggcaacac

SEQ ID NO: 14777 - DNA, 347 bp, Homo sapiens
  misc_feature 51: n = A,T,C or G
tccacgggatacctgggcactggtgcactgcacctgactggtggaaagtantactcaccgccatgcaccagcctccctcgccccagtgaaccctgccaaccccaccacctccagagcctcacccctgcaccaacactgccgcaagagtgaaactaggaagggagaacaatggacctcccctaccctgagcagccaccccacctgagtgatcatgcacagagggcaggcacagacctgcacccgccagcacccgacccccatgctaataccaccaccagcacagtagccagcaggggccctcaaagcagtattgcctctgctgctgctgtgaatgcctgcagggaggc

SEQ ID NO: 14778 - DNA, 176 bp, Homo sapiens
tgggaacaatccaaagagtctaagtttcttttccatccagcgtgagtttcctatttagtgaagtaaagctcaacttttatcaatagtttcattctcttgtggtatgtaaaacctacacacactcagaggcacccagaggaaactacactctgaggtattagtaaattctctgcaag

SEQ ID NO: 14779 - DNA, 334 bp, Homo sapiens
ggagtcggactgggagtgaaacccagctcaattcctaataggttgaagatatgattacctcaatgcagtctgcttatcagaaaggcatatcatatcatccggatgttttatatacaatggttggcatacaacaaaagactgttagatatggaaggaagcaagaaaatgtgaccaaatcaagagaaaacaaaaccaaataaagaatatccagataattgagttagcaaatgagaaccttaaaataactgattaacaagttttagatgataaaagaaaagagaacttccgttggaatctgcagaaatggtgtaaaatgaatattctacaactggag

SEQ ID NO: 14780 - DNA, 331 bp, Homo sapiens
tccgataaagcaagtcccacttcattagttttttttttctttatataatatgtcctaaacattcattttttcatgtgaaaaaatgaaatgcagaattttaataaaatcctaattatgatggctgacatcacaattaaaatcctgcatttttgtttaaagggctctttaataatattaaatcttagcactcaagagtcttcgtacatcattgaaatcttttggtcttgttattggaatattcttcacgtaagtatatcatagctaactgaatttatttctaagtatttttacagttttatttcatattttgacattgtgaattggttttttt

SEQ ID NO: 14781 - DNA, 434 bp, Homo sapiens
atatctacatagatctttttgcatgattccaccgattccatccgcacgaattccgttgctgtcgcctaatgtaacaaaactattatctggaagagccaaaatttgaactcagatctctctggccctactaaatgcatcaccataaattatttcatgggcaatctttccctgcaccttaattgatttatttctgccaaatgtatgtgttcctacatctttatggaatattctgacatgggaatgcccccaggtctgtgaagactggcttctctggggttggatcaataaatgaaggaaaattttgcagggggttatacaagatggggggttgaagggggacaaattggtcaatatagctcccttcaaaacaaaaccctcagtatatctttgtgatgccaaactagagattatttcctttgtaaaaagcaaggacg

SEQ ID NO: 14782 - DNA, 423 bp, Homo sapiens
  misc_feature 423: n = A,T,C or G
cgttggtgtcggggaggagagcttggaagatgtcttatgtccaccccctgacaatgatgatgggggtaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgn

SEQ ID NO: 14783 - DNA, 426 bp, Homo sapiens
  misc_feature 60, 426: n = A,T,C or G
cgttggtggcgggggtagaacatatagaaattgaggtcatcgaaagtcaggaaattgaanctcaggagggggaggatgatacctttctaacagcccaagatggtgaggaaaaagaaaatgagaaagatataccaggttctggtgagggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggcgatgacctcctagaaacaggtaaaaatgtgagaattacagattctgaagcaagtaagccaaaagatgggcaggacgccattgcacagagcccggagaatgatagcaaggatn

SEQ ID NO: 14784 - DNA, 384 bp, Homo sapiens
catgcgccaccacacctggatattttttttttttgcattttcagcaaaaattggcctttgccatgttgcccaggctggcttcaatctcctgacctcaagggatcaaccaacctcctcctcccaagggggggggattataggtgggagccactacacctggacagaatttaccttattggaattggcaaaggggaagttcccaaaacagaccatgttctacaaacttgtgtattgtgggccaaggaattgatgcttttttggatccgcaggagcaacaaaattaccctcaccttgcctgggggcgggggctcacacctgtaatcccaccactttgggaggccaaggcaggaggatcacaaggtccagagataaaaaccatcctct

SEQ ID NO: 14785 - DNA, 413 bp, Homo sapiens
cgttgctgtcggatcatttgaagcaaacctcagaaatcactttattcctaaatatttaagtatgcatctctaacttattaaaatttttttggttttgttttttgtttttctgagacggaatttcgctcttgttgcccaggctggagtgcaatggcgcaatcttggctcgctgcaacctctgtctcccaggttcaagtgattctcctgtctctactaaaaaaacaaaaaaaatcagctgggtgtggtggcgggggcctgtaatctcaactactcgggaggttgaggcaggagaattgcttgaacctgggaggtggagattgcagtgagctgaaatcacgccactgcactcgagcctgggcaactgaacgagactctgtctcaaaaaaaaaaggccaggcattgggggttcatgt

SEQ ID NO: 14786 - DNA, 417 bp, Homo sapiens
  misc_feature 417: n = A,T,C or G
tacggctgctatgaagtctacagaagggtacccctgccaatgttacccttctcaatagcgttgcatttcttgaaagtcttttatcttaaaagttgtatgtggattttcaactttatgtttttattttaaaaaataagatgtgatgttatttttcaaagctcaaaactatgtttaccctataagttacaagcctcctgggccacatattcatttttaagaagcagagaattatgatgacatatggatttcaggacctctgagggaacttgcatggggggaccattaatattgtatgtgcggccgggcgcggtggctcacgcctgtaatcccagcacttgggaggccgaggcgggcggatcacgaggtcaggagatcgagaccatcccggctaaaacggtgaaaccccgtctctactan

SEQ ID NO: 14787 - DNA, 376 bp, Homo sapiens
  misc_feature 365: n = A,T,C or G
tacccctgccaatgttacccttctcaatagcgttgcatttcttgaaagtcttttatcttaaaagttgtatgtggattttcaactttatgtttttattttaaaaaataagatgtgatgttatttttcaaagctcaaaactatgtttaccctataagttacaagcctcctgggccacatattcatttttaagaagcagagaattatgatgacatatggatttcaggacctctgagggaacttgcatggggggaccattaatattgtatgtgcggccgggcgcggtggctcacgcctgtaatcccagcacttgggaggccgaggcgggcggatcacgaggtcaggagatcgagaccatcctcgctaanacggtgaaacc

SEQ ID NO: 14788 - DNA, 416 bp, Homo sapiens
  misc_feature 416: n = A,T,C or G
cgttgctgtcgcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatcctgaagttcagagtctcttctttctcagacaactggtaatagtaatcactatcatcatcatgtgacatccagaaagccacaaacagagcggtccttaccagtgacttgn

SEQ ID NO: 14789 - DNA, 407 bp, Homo sapiens
cgttgctgtcggggctgttgtgagagctataggcttggacgtaaaacaatgctagatgtggtgtctgctcctgagcttaaaagtagcttgagaaagacagtgatattatcagaaaagaatgtgcataatgaaaagttgaaacttttaaaaactcactcaaaactaagttttaaaaaagagccaccgcgcccagcctgagacgtgttttaaagactgacttttgtttcttttctagatataaatttagaaattgagaagtgtattttgaaaaggcataataagaaaaactatggcatataattattttaacttgccatatgaaaacctaaggcacagggaggtaactcgcctacaggtgcagccctaggaagtcagggagccaggattcactgtcagctgactgactc

SEQ ID NO: 14790 - DNA, 400 bp, Homo sapiens
ggcacgaggaatgaatgaagattgtcttattagctttggaggaagctgtcaggtgataggatggacagtatgttgggaaaggtctctctggcatgaagaggtggcatatggaaatggcatctgagctgagagcataggcgggcgagaagccagttgtgggcaaaatgctttctatgaacggaggaagtaagtgcaaaggccctggggtgggaatgtgcacaatgaaaccaacatggtgcagccgagcacggcagtgtggcccacaggaggctggacacccctttgccccagcccatgccttctgggcaggccacacccgctgtcctttctggctgtttagaggaagtagaaatcagatacagaaattcccacctctgttctttgttcctttgtctcagct

SEQ ID NO: 14791 - DNA, 416 bp, Homo sapiens
tacggctgcgttaagactacagaagggctcgaccccacgtcacgccttctagaaccctccacctcaggccgctcgggggcatgccgggatttgttgtgtgtagagggccgctgccgcgagggatgccgggatttgcagtccttccggactacaagcaaaatggctgcttctcgacctcttagctggggcttagggtgtctctggctggccaagagtatgacctaggttcaaatcctcactccgcaagtttcgtatctcagtttccacagtagtaaaatgagataataatagtacatataatcatagagttgatgtgcggagtacatgaatttaaacatctagagccagggcagggcggtggctcactcgtgtaatcccagcaatttggaaggtggaggcgggaggatctcttgagc

SEQ ID NO: 14792 - DNA, 417 bp, Homo sapiens
ggcacgagcctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttactgcccaggctggagtgcaatggtgcaatgatctcggctcactgcaacctctgcctcctgggttcaagtgattctccagcctcagcctcccgagtagctgggattatgggcgcccaccaccatgcccagctaatttttggatttttttttttaaaaaaaatggggtttcccccaggggggccaagtcttggcg

SEQ ID NO: 14793 - DNA, 387 bp, Homo sapiens
ctatgctttctggaactttgccctttagcaaagtaaattgctcatcatttccggaacatgcagtgttgtttcttgctcctgctcccttttcctggaatggctgcccctgttcctccacctgaaacatccttcttccttcttcaggtcccaagcaggttgtctactacccccatgggctttgcacacacctgcactgtagtatgtgttgcactgtgtggtcatggtttccaggttgattgcagacagcaagcctgggagtttctggagatctcaagagtgaggctccttcagctgtgtgcctccatgcctcacctattgcctcacctgcaacaggtgctcaacaagtgtttgctgttaagtaaaagtgaaggggtggtgacaaaaaca

SEQ ID NO: 14794 - DNA, 404 bp, Homo sapiens
gcttgccagtctttgctttgataggtggtttttgcttaggctacgataaattgtttcatcttttctaaagagggatgaggaagtatttactttgtgagattggaaaaccgtgtggttggtgtggaaaataagcatgttattaataaacagctagtcttgtgctccatactcttggatggaaggtagaaataaccttgcctctattgctgagatttaaaaaaataaaaagctaggctactacccgtgccttcctcgtccacaacacaggcacagggtggcaggtagtgatgagaaacaggctgccaagatggtccctggatgactaggaggtgtgtgatgtgcgtccagttgtctggatggggcaactggaatccttcattgtgtggttcatgcttgtgtgtgca

SEQ ID NO: 14795 - DNA, 416 bp, Homo sapiens
cagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaagg

SEQ ID NO: 14796 - DNA, 408 bp, Homo sapiens
ctctgcctcggccggtaaggccgaggacgaggttgaaggatggccgagaggagaccgagcgtgaggggtccgggggcgaggaggcgcagggagaagtccccagcgctgggggagaagagcctgccgaggaggactccgaggactggtgcgtgccctgcagcgactaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaaaccacacatgcccacggaatttgattttgatgatgagccag

SEQ ID NO: 14797 - DNA, 413 bp, Homo sapiens
  misc_feature 413: n = A,T,C or G
cgttgctgtcgccacaaagctattagtagttaatcatataaaacttacctgcttggagaagaacgttggaaaattttgctgctttagcaaaaacttgataaaagtgaggcatttgaaaaaaaggcatttgttgctgtggaactcacattgttaatcatcagtaggtttatatgtaaaaacttggaatggtcttgaaattctcaaaatgttataggaattatttttataaatggtttattttcttacatgctgttttgggttttctaccttactctttgtgcttaaaaggagaaaggtccttactaaaaccacttcccttgtttctttatagaatttacaacgggaatgattttaccaacgaaagctatggcaacccaggaattgactgtcaaaagaaaactgagtgggaatan

SEQ ID NO: 14798 - DNA, 164 bp, Homo sapiens
  misc_feature 7, 8, 84: n = A,T,C or G
tccttannaaatcactccctgacttaaattttaaatagtgccttgactatcttttacaggaaggaatagtattacatatatcanaattgtttcattcatttttaaataattggaaaactcttaaaaataccacaggaggctgggtaccgggggctcatgcctcg

SEQ ID NO: 14799 - DNA, 405 bp, Homo sapiens
  misc_feature 372: n = A,T,C or G
cgttgctgtcgggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgngagatcgggtatgactcaaaacaagtggatggt

SEQ ID NO: 14800 - DNA, 402 bp, Homo sapiens
  misc_feature 345: n = A,T,C or G
cgttgctgtcgcccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctantgaggttctgatgtcacttctggaaaagagctgagtgacagctgtgaaggcgccttt

SEQ ID NO: 14801 - DNA, 407 bp, Homo sapiens
gattcgaattccgttgctgtcgtggacatctaaggatggactcggtgtctcttaattcatttagtaaccagaagcccaaatgcaatgagtttctgctgacttgctagtcttagcaggaggttgtattttgaagacaggaaaatgcccccttctgctttcctttttttttttgggaaacaaagattggctttgttgcccaggcggaggggcgaaacaacaatttgggttttaccggaaacctcggtttcgggggttaaggcaattttccggcctaaccctccaagagtttgggagataccggcctggggccccccccccgggggagattttggtttttataaaaaaaaggggttaaccattgtggcagggcgggtctaaactcccagaccatgggaaccgccctcccg

SEQ ID NO: 14802 - DNA, 416 bp, Homo sapiens
  misc_feature 416: n = A,T,C or G
cgttgctgtcggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacn

SEQ ID NO: 14803 - DNA, 408 bp, Homo sapiens
ggcacgaggcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgt

SEQ ID NO: 14804 - DNA, 412 bp, Homo sapiens
  misc_feature 412: n = A,T,C or G
caaagaaggtacccctgggagcccatcggagaccccaggccccagcccagcaggacctgcaggggacgagccagccgagagcccatcggagaccccaggcccccgcccagcaggacctgcaggggacgagccggccgagagcccatcggagaccccaggcccccgcccagcaggacctgcaggggacgagccagccaagaccccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcn

SEQ ID NO: 14805 - DNA, 412 bp, Homo sapiens
cgttgctgtcgcccctcgcctcgtctctatggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggaatatgtccacgcctactttcgtgggcacagcccccagctggctggctcgagtaacttggggagctgaccatgac

SEQ ID NO: 14806 - DNA, 412 bp, Homo sapiens
ggcacgagcctcggcctcgctgtcttctgcagccgctactggaacctccacctcgactccagcggccccgacagcacggaagcatctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatgggattaaaaccggttctcagattatctccctccaaactctaaagaaggaatat

SEQ ID NO: 14807 - DNA, 385 bp, Homo sapiens
cgttgctgtcggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatg

SEQ ID NO: 14808 - DNA, 396 bp, Homo sapiens
  misc_feature 42: n = A,T,C or G
cgttgctgtcgggccatcttgtcttgtcttattcagggcagnggaagctttacccacttcctactcttcttcatgttattgaagcccagctaaaatgaaccaacttagaatataaaattattttaatatttcttcatctgacttctaatcccattgttctttttgctgtatctgaagatagtcccaacttctcaaatatgttattaatttctgggctgtaaaatgaatatggaagagggactcaaattttgtaaatgctgtggggttacaaatcaccaattgtcctctgcctctgtgttgcctcagcctaccgcaagacctccctacacacacacacacacagacacacacatccctgaagtcactctaaatatcagtaattatgaaagtggcccg

SEQ ID NO: 14809 - DNA, 393 bp, Homo sapiens
cgttgctgtcggtccatcttgtcttgtcttattcagggcagtggaagctttacccacttcctactcttcttcatgttatcgaaccccagctaaaatgaaccaacttagaatataaaattattttaatatttcttcatctgacttctaatcccattgttctttttgctgtatctgaagatacacccaacttctcaaatatgttattaatttctgggctgtaaaatgaatatggaagagggactcaaattttgtaaatgctgtggggttacaaatcaccaattgtcctctgcctctgtgttgcctcagcctaccgcaagacctccctacacacacacacacacagacacacacatccctgaagtcactctaaatatcagtaattatgaaggtggc

SEQ ID NO: 14810 - DNA, 392 bp, Homo sapiens
cgttgctgtcggccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctacagagcagcatatggaggcgggaatccaaagtgaaggtgcttgatatggcctacttcttttttggaatttcctgaccattaattaaagaattggatttgcaagtttgaaaactggaaaagcaagagatgggatgccataatagtaaacagccctt

SEQ ID NO: 14811 - DNA, 359 bp, Homo sapiens
tgggagagatataaacaaataaggaaaatagtttgcataactgacttagaacagaatactgaaatcagtccagcataatgcatgagcaagttagtaagaagattagattggctggcattgaggcaaatgtaaagttaatttggaatttggcagactatactgtggatataaaaaaatgactagagccagaccagccaggtttaaatcctagctcttccattcactgagcactcacacaagtcacttactctctgcacttacctcatccatagcactgttgcgaggattaaaggaggcaatgcttgtaaaattcttataacagttcctgtacataaaaaattatccataagggccgagcg

SEQ ID NO: 14812 - DNA, 355 bp, Homo sapiens
gtctttattgaatggaaaggtgtcatgtgagacacaaaaatataaaatctttagattgctttattttaaaaacaaataagatacttacattattaacagaagagcatactggtttcggtccataaaatctttgggaagggacaactgtaaaggaagttcttttaaagaaagagcaaaatattaaagatggagagtcatttacaggtaaaactataagacgcagagaaagttgttcttgaataacatagcatgcacaaaattttaccatagtcgtcaatatgaaggattttaatttctggctttcctatcttcttcttcaggatagcttccttcagcatagaattgctttccaatg

SEQ ID NO: 14813 - DNA, 357 bp, Homo sapiens
gtttccccagttgtctcataagagctttgtcatggttggtttgttagaatcagggtctcaatggagtagttgcattgcatttggcttattcatcttttaagtctcttctgtattttactagcctcctttcttttcttgccatttgtccagtagagtttttctattttagatattttattttgttttatccttgtggcgatgtgaattttatttccattggtgataaaggtcaatttaagctatgtgatttcttttggtatactttgaataagaaaatacagaatgacaacaaactactataaattcagtaacagattcaatttaatttgtatttcatgtgagcaaaacagctgaaaa

SEQ ID NO: 14814 - DNA, 360 bp, Homo sapiens
aggagaaacaacagagggatattttcataaactattaattctatcaactaagaacaaatcagcagaaacgttcacagctaccattaccagcattccatgtgagtataaagattctacaagacttacttcacgataatttagtatgattatttcttctacagtttttgctataagaggccgaaccccttcctgtcctaatctaaaaataccacagtacaccctccccaacatgaccgactcttcagcatataaaatgctaactaagcttttccgaatgcacaatttgggggttttcctttcttcttctttatacatgtctatattggttggcttttggtttggtttgtcatttttctacca

SEQ ID NO: 14815 - DNA, 384 bp, Homo sapiens
cgttgctgtcgggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacg

SEQ ID NO: 14816 - DNA, 369 bp, Homo sapiens
ctcgagcccacgtgacgccttctagaaccctccacctcaggccgctcgggggcatgccgggatttgttgtgtgtacagggccgctgccgcgagggatgccgggatttgcagtccttccggactacaagcaaaatggctgcttctcgacctcttagctggggcttagggtgtctctggctggccaagagtatgacctaggttcaaatcctcactccgcaagtttcgtatctcagtttccacagtagtaaaatgagataataatagtacatataatcatacagttgatgtgcggagtacatgaatttaaacatctagagccagggcagggcggtggctcactcgtgtaatcccagcaatttggaaggtggg

SEQ ID NO: 14817 - DNA, 355 bp, Homo sapiens
tggtgcagactaacaacagaggagagctcctaagctatggtaatgagtgacccttacaccagtggcttcagggaggggaggtggtgggattcctactgaagaggagaaggaatgagcagctggtaatggagtggaaaaacggggatgcagtgcaccctttcaaaagttggtgatgaccagcagtatgagagagagaaaatagtagtggagatgaggggtgggtataaaaaacaccccgaattttttttttagaaaaaaatggctttaaaaaagtatggtaaaaattttggtaacaatttggtgtttctattttagcaccattttgttataaatgttgttttttttttattcgcga

SEQ ID NO: 14818 - DNA, 363 bp, Homo sapiens
atctaaatttgtcagcaaattaaagagtttgagattgggaattgagataaagctatttagttcttttatgtttaaataatttacttcattctgaaatcttataaatggattctcaactttcaagtagtattctccagatagaagaagaggtggttgctgctcatgtagatctataaatatgcggtgtatgccttttgtgcttctttctccgaaaaggaccaccccctttttcccctcttccgatttcttgtcacctttctcgtccttggctgcatccatcccccttccgttatcccgtcttcgcgtcccgtcttttttctcctgctgtctatcactcttgcctgcttccccgtcggcttaccg

SEQ ID NO: 14819 - DNA, 356 bp, Homo sapiens
taaacgccagatggaagagatgcatatatcaggaagggtatgagggaaggggcatggggccagccactctccaggaacctgcatgcgttcagctactcagaagctcgtgacgggcaatgctaatatgaatatttatctcttttaagtcttatcatttttctatcatttcttgatgctaaaacctgctttataacacacagttgactcttgaacaatacaggttcgaactgcatgagtccacttatatgcactgttttttcaataaatatagcgagagtcttttggaaatttatgacaatttgaaggaactgtcagatggaccacatatggtaaaaatatcataagaattactaaag

SEQ ID NO: 14820 - DNA, 381 bp, Homo sapiens
cgttgctgtcgcctaaggtagcaaaactagtagctggaagagccaaaatttgaactcagatctctctggccctactaaatgcatcaccataaattatttcatgggcaatctttccctgcaccttaattgatttatttctgccaaatgtatgtgttcctagatctttatggaatattctgacatgggaatgcccccaggtctgtgaggactggcttctctggggttgtatcaatagatgaaggaaaattttgcagttgtttatacagtttggggggttgaggtggtacaatttgcacatttttgttcctttcatagcaaattcttcagttttctttgatgaggccaagcaataaattttttcctttcttacgagcaaatact

SEQ ID NO: 14821 - DNA, 377 bp, Homo sapiens
ggcacgaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctcttt

SEQ ID NO: 14822 - DNA, 397 bp, Homo sapiens
  misc_feature 397: n = A,T,C or G
cgttgctgtcggagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactgn

SEQ ID NO: 14823 - DNA, 396 bp, Homo sapiens
cgttgctgtcggaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgtcgcgggc

SEQ ID NO: 14824 - DNA, 386 bp, Homo sapiens
  misc_feature 386: n = A,T,C or G
cgttgctgtcgccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccaccgctgcccgccggccccctgaggtagtgcaggcccacgggcaccccagacactggaactccctgcctctgagccaccaactggaccn

SEQ ID NO: 14825 - DNA, 392 bp, Homo sapiens
  misc_feature 392: n = A,T,C or G
ggcacgaggcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccan

SEQ ID NO: 14826 - DNA, 261 bp, Homo sapiens
ctgactttccttatcaacatcccagaaagtcttcagctttaataatgcttcgccttccttgcttttctagaatcatattctaaaaagacaaagcaaaacagataaaccagtgtccctaatacaatatattcatttaaaacattctaacatcttgggatgctctgatacttggtcttatttttctaatctccttatatttaccatcaaaagtatatgtgttgagcatggtactagtataaaaagcacatagaccaatggaac

SEQ ID NO: 14827 - DNA, 331 bp, Homo sapiens
tacggctccgagacgacgacagaagggctgaaggaaaaacagatccctccttcttgtttgactttgtatagaatgaattttaatgtaactgagcccacctttagtatagctttttctcattataaatagaagtggttgccagtattcttgcttgccttttaaaatagcaaacatttagtgataaaaatcttgttctgttctctgtatgtcagtttattcatctgtaaagtagagacaataatagcatctatttattacaagcaattgttaaaattaaaaacaggctgggcgcggtggctcccgcctgcaatcccagcactctgggaggcca

SEQ ID NO: 14828 - DNA, 335 bp, Homo sapiens
caggtccgaagttggacccactattcctctggggcaaactgacattggcttgattgggcatggtggctaaggcctggctttatagcactccgttatgacctggaatgtgcatcacttcaacaacagatgcattcatcttacggtccaacatgaggaagacgtgtgtcatgttaaatacaaaaattatcctggcgtggtggcacatacctgcgatcccagctactcaagaggctgaggcaggagaatcacttgaacccaggaggcagaggctgcagtgagccaagattgcaccactgcactccagtctgggcgacagagagagagagactgtctca

SEQ ID NO: 14829 - DNA, 371 bp, Homo sapiens
taccgctgcgagaatacgacagaagggaaactatctgaactggctttattcactcttcagcatatttaagttggatttcaacctctgtcattccactgaaatcactcttgtcaacaaccttcatgttgtcaaattcaaaacacagtcttctgtcctccgtgctcattttttcaacagtccctgcttgccctttaaaggacttcttttgcttcagttacccttttaggtattgtcatagtcctctggtctctcatgagcaggatttggcagctccttgtattctatcagttcgccaaatagatatttgagatgacatcacaagttctcttgtctttctacttattttaaaagatggtatctacacatttttt

SEQ ID NO: 14830 - DNA, 331 bp, Homo sapiens
  misc_feature 331: n = A,T,C or G
gcactacacatagttatttctgaaaagaaatcagtatgtaaatagaaatccaacagaaatgataggtgtactatcaattctttattgttgggttcgaaagcaatcacttgaggttaaaagataattttaaaatattaatattctcatatttactattttggtcccaatgcatgtgtataccaaaatagtaatatgtagcacacatgatttaattgctcttttcaaaaacacttaaaaggaatctatgtttaaagaatattcacataatcatacaggcatggtggctcactcctgtaatcccagcactttgggaggccgaagtgggtggatn

SEQ ID NO: 14831 - DNA, 338 bp, Homo sapiens
  misc_feature 338: n = A,T,C or G
acaagggtaaggaattagtgtgctaatgttctctgcttacaaagtgggaagtcagttggctttctagggtggctgggacaaaatatgagacttaagcatgttgattaaagatacagaggtgaccagtagaagaactaagaatagtgatgtcactatgggggagaggggtagatgagctaaattcttgtctttcatagcagtaggttaaaagtaaatgtccaaagctgattagtaagaaatagcagttgagggcacggtggctcatgcctgtaatcccagcactttgggaggctgaggcaggtggatcacctgagttcaggagttgagactaacctggn

SEQ ID NO: 14832 - DNA, 343 bp, Homo sapiens
  misc_feature 343: n = A,T,C or G
gatatctgaaaaggaggttaatcgatagcttttacatagtacaactgctttatcctttcaaaagcagatacgtcaatcaaaacttgatatttatttatctatatttatgctgagttcccttaaaatgttttgtctttttccatataaccaatcatattatttcctaaaaataaacttaggtattgtcacagggatagtaacttctgctttccatattgtgtgtgtgtgtattttgttttgtttcgtttttttgagatggagtctcactctgtcgctaggctggagtacagtggcgctatcttggctgggattacaggtgtgagccacggcgcccagcctgtcn

SEQ ID NO: 14833 - DNA, 344 bp, Homo sapiens
agaatcccagaagagaaatggaaatcataagagaaacaaattgaaattctagaactgaaaatataatatcagaaaagaaaaaaaaattactcaatggaaattagagatgattagacacttcgaaagaaagtatcagtctcactcacactgaagaacagagaataaaagatagaaaatattaaccagactgcagagaactgtgggacaatagcaagctgactgaaatatgtgtgattgaaataccagaaagaaaagagagagagagagcatgaagtaaaatatttttaaaagaaataggatttttaggccgggcgtggtggcttacacctataatcccagcactt

SEQ ID NO: 14834 - DNA, 332 bp, Homo sapiens
ctcgaccccacgtcacgccttctagaaccctccacctcaggccgctcgggggcatgccgggatttgttgtgtgtagagggccgctgccgcgagggatgccgggatttgcagtccttccggactacaagcaaaatggctgcttctcgacctcttagctggggcttagggtgtctctggctggccaagagtatgacctaggttcaaatcctcactccgcaagtttcgtatctcagtttccacagtagtaaaatgagataataatagtacatataatcatagagttgatgtgcggagtacatgaatttaaacatctagagccagggcagggcggt

SEQ ID NO: 14835 - DNA, 343 bp, Homo sapiens
ttctaattagtagaaataagggctaaggaatctttggatcactgaaatctaactattctttaattgaaatgtgggtatgtttctgacttatagtaagaactaaaatgaattctatttattctcaagtgagagcaaagagaaaaattttaaatggcataataaagagcttataaaacaaaatatgaggattttggaaaatcatttattgaaatagtactaggatatttagaagtatttagaagcttaaattaattggcttttctttatgacattatctctattacgataatattatattattttttaataaaggccctaatggaaatctcaaatagggttggtt

SEQ ID NO: 14836 - DNA, 375 bp, Homo sapiens
cgttgctgtcgatagagaggagataactttactaaaatcatacaacacagaattagattaatcctagcagagctaatctcagacctttactcagactttttctgtagctttagtctagaagttggcaattcatctattatttgtcactgattcctagcatgatttgtagcaaattctttattcttattgtgcctcagattctacctatataaaatatatgtgacttaaaatattcataaagataataagaacaacttcaatttctattttatttttacttacaatagttttcactttcacatacattaccctacttaattttccccatattatggatgaggaagttaaagctctatgtggtagatgtcacatcca

SEQ ID NO: 14837 - DNA, 141 bp, Homo sapiens
gaggaattaagtgagtaaaaaaggcaagctacagagtgggagaggatatcaaggatacatgtatctgacaaataatttatacagaatatatttttaaactctcaaaaatcaatacacaaaagacaagctaccctccaaaac

SEQ ID NO: 14838 - DNA, 327 bp, Homo sapiens
tcctcaaatatcttcttgtcctggaagcctaaagtgactccctacacagagggagtagaactgtcttgtggtttctcaagcacagctctctattttaatgcatatatgaagctgtctttcatctgtgcagatgtttgctctgccagactgtgagctccttgaaggtggggattttgtctggttgttttttccccagaataagaatgctgggtatatacatgtctagataatggtttagatggatggatagatggtgaatgaatggatgagtatatgtatgggggggtataaggaagggcctcgttttttctgccggaaacacactct

SEQ ID NO: 14839 - DNA, 344 bp, Homo sapiens
gcctctcactcataggaggggcccaggaaagagggaggaggcaagaaggggaaggagcacaaggagtgtgggtgaggggtgtaaccatgagggcaggcagggggcaggacggaaggcaggagggcctggccaggggaggcctcaggaggatgagcaggaggcgagaggagacagactatgaggccagagggagaccctcacctgagaatctcctttagcgtgcggtgcaggaatgcataattgtcatcgaatttgtaccaaggcatgaatggctgaccttcactgtacacaaagttttcccagcagtatgcaaattctgagacgaagaggcaggaagcagtcag

SEQ ID NO: 14840 - DNA, 321 bp, Homo sapiens
agtcatataacccaactatttaagtaattatcaagttgcttcacttctatgtgccttaaattcctcgtttgtttaatgagggttataacaacactgacctcataagggcattctgaagattagatgaatttatacgtaggtagtaattaaaacagtttttagtacacagaaaagtacttagtaatttttagctgttattattactagaagttcattcttttgttcattaattcatgaggcacaggtgcctttctcggtgtttggcatacataaaacaccataataaatgagagtccatattcttatgcagagtgagaagaa

SEQ ID NO: 14841 - DNA, 345 bp, Homo sapiens
  misc_feature 345: n = A,T,C or G
tacggttgttatagacgacacaaaggatcattaaattacattttaaaatgttaacaactacaagcagatacatctgggatattggttatgagaggatatcattttcttttcttaccataaataaatattatttattttattgaaattgtgcttttaagaatgctatagaaaattcaaaaggaggacaggtgcagtggctcatgcctgtaatcccagcactttgggaggccgaggcaggtggatcacctgaggtcaggaattctaaaccttgccagtatgggtgaaaccccgtctctactaaaaaatacaaaaagttaccaggcttggtggcatgcccctgtagan

SEQ ID NO: 14842 - DNA, 313 bp, Homo sapiens
gtagtcctagctattcatcaagctgaggtgggaggattgcttgagcctgaaaggtcaaggctgtagtgagtcatgatcatgccactgcactccagcctgggtgacacagcaagaccctgtctcaaaaaaataaaaaattaactaaataattttttctcagttttaattcctaatataaacaccaatagatataacaaactgaaacaaaagttctttagggtgcccaataatttttaagtgtgtaaggggattgtataaccaaaatatctgagaagcattaacttaaaactaataaaggagaaagactttatta

SEQ ID NO: 14843 - DNA, 313 bp, Homo sapiens
gttagtaaacataccattataatagcaatcataaaggtcccaagaaataaatctgacagctgtatcaaatatttgaggaaaaatgaacctttattaaaatcgttaaataatacttaaatatagataaatctgttattgaaaggaaggcaatgttataaaaattcagtcttcccaaattaatctataaattcccactcaaaataagtttgatcttgacagagtgattttttttttcttttttttttttaaaaagggagtctgactttgccccccaggcggaagggcaggggaacaaccacgcttaaatgaagtg

SEQ ID NO: 14844 - DNA, 326 bp, Homo sapiens
ccctgcatgcctcctcatcggcagttgagaccccactgctgcctgctccttcccattccattgcggggacctggacttgatctagccctgtctggtggacacacttttgtaggtgccaggagggaggaatctgctcctcctttctgcccccgacagcccccagccccagtggccactcactcccagcatgccttgcagctgcctgagtgggagactgtggtggactcggagctggggcagggaggacaagcttcttctggaagggcaatgggcagagggtgacctggtctttcacggtggtgtcaaggaccatagagccaggccac

SEQ ID NO: 14845 - DNA, 314 bp, Homo sapiens
gttcaaatctggtctcccacatgttagctaagagacctacaaattatgttatgttacctctctgtatctcagtcttctcatctggtaaattaagctcaataaggacagagactttgtttactgtcataaatatcatcagcacctagaaacatttgttgtactgaatgaatacctgtgcagtgaatgaagggaagaaatatttcataaatgttgtggtaagattcacgtgagttaaaacatataaagcactaagaatagccatggcacaagaaatgctccattaatggtaattattattatttcagcaggcaagg

SEQ ID NO: 14846 - DNA, 322 bp, Homo sapiens
ggaagttgggtcatatccatgaatctgtttctgcctagttaatatgtaaactttgacggaaatactttacgaaaaatttgatgtaacgctatttcaatttttagatacaaccattttaaaaatttgaataccacccaaaacccgatgaaatggattagggaaagataaaaaaacaaaacactaacaaaatacttgactcatctcacactttatagcccaagaaggctttaagtaaataaggtgtaccatgttttatgtaaaggctcggggtatgacagaaacacagtgtcccagctgatctcatagatatcaaacagacctt

SEQ ID NO: 14847 - DNA, 316 bp, Homo sapiens
  misc_feature 316: n = A,T,C or G
catgttctttttgccactaagcagcgtggcccacagcagtctcagtatccgctacgccctagtctgtccatctgtgagatgaagatgagagaaattgccacaggaccttgtagtgcactaacagcttggagttttttagccatgtaaagaattaaaatgaggatcatctctttatcataagattgcctcctcttgtaaagtaagtcactgaataagaaatgatttaccacagacaagcaaatgctgagagattttgtcaccaccaggcctgccctaaaagagttcctgaaggaagcactaaacatggagaggaacn

SEQ ID NO: 14848 - DNA, 291 bp, Homo sapiens
  misc_feature 286: n = A,T,C or G
cacaggatccagggaaaaaaaacaaccaaataatacttgaaggtaagtcccaagatgtcagctatgaagtaagcagtcagtccagattggagcagaagattggaaggtttcagggggactgcttccagggaaaaataaaaatgataaattattattttcattttccatgcaacaaatatctacggagaatatattatgctttgagcctgttagaggcactcaggctatagttatgaacaaaattaagtttctgacttcttgaaatttaccttctactgaaacttanagttt

SEQ ID NO: 14849 - DNA, 134 bp, Homo sapiens
gagggtaagaggggagccaggagtgggaagctggggaagccagagcagcagaggctggagcaaatcccgtgggaaagaaccaggaatgggtggttcctgagggagtggctcaaacaccctcgcaggggggtggg

SEQ ID NO: 14850 - DNA, 320 bp, Homo sapiens
  misc_feature 320: n = A,T,C or G
tcaggaatttatcaggctggttagactctttgtaacttgaaattagccatggttggagtatacacatggatattggaaaatactataaatcagaactattcctggttaatatgactacatatgaagaccaaagcacagtaagggtttctgttgttagacaaaatcaaacaaaagggaaatgttttttgacataaactatagaataagaagatatgaaacaaacataaatatacattgcatataataacaattattattactatttttgagaaggagtctcgctcttgtcgcccaggctggagtgcagtggcgcacgatcn

SEQ ID NO: 14851 - DNA, 324 bp, Homo sapiens
tcactgggccttaggtgactggaggcctggggtctggcggggccagaaggattaggccttcaggtggccaaggagacctggtagccagcttcaggacaactggaagtgaacaggtgatgaggtgggactctggactgagtccagccagaattccccagttcttggaatagaggtggtagggtggccagctaggatgcccgacaattcccagcaggtcctgctctgcctgtcacagcagacagacatggccagctgaaatggcacctgccaattgggattgaaaaataaaaatctggccaagcgcagtggctcgctcatgcctgt

SEQ ID NO: 14852 - DNA, 304 bp, Homo sapiens
tggggattgggttaacgtatataaaatattagatggtggtaagaagagctaataagtgtttgctaaatatataagcccagggccagcctggcttcctcctcatcctcctcctgctcacctggcctggaccccaacctctcccctagcactgagctcactgcccaggtcccacagcagcactccaggcctggactatttctacagccatctctctgcacctgtctttgtccgttgctgcagctacaacaaaatatcatacattgggtgctctggccaggcgcggtggctcacgcctgtaatccca

SEQ ID NO: 14853 - DNA, 315 bp, Homo sapiens
ggaaaagtagtgttgggggatttgctatatgagaagtcaaagcatactgaaatgctgcagtaatataaatggtgaacacaagaatagacagattgacgcctggagcaaagtagaatccagtaacagacccatttttatatcagaatttagtatatgataaagttggtgttttgcaacagttgggaaattataattcagtgtgttgtatagggataaatggctctttatttagaaagaaagatcctacttcacattcaaaataacttagatggattaaggaactaactaaaaaaacctataaaagcattagaagga

SEQ ID NO: 14854 - DNA, 270 bp, Homo sapiens
tacagacacaaatgaatgaagagacctgccttatggagggggaagagtgctccagtctgtgggaacagcaggcaggaagaccttcaggcaggaacatgcttgactcttccatctgagggtcagaaatgggggccctatgattgaagcccgtgaccagggagtgggtattagcaggaaatccaatgagaagggtaaccaggagccttccttttctcttcataaaaatttgtaggattgtcaccagaaatggggcctgatccagatcccaag

SEQ ID NO: 14855 - DNA, 336 bp, Homo sapiens
tattcctgttttgagacaaaagatcgctctgatgcccaggctgccattattggtggcttaatttgcttacattaaaggaatgactatatgttgtggctaaaactacctactttaacgactgaaaaaccaaacattctttgcaaaaccatgtatgataaagaaggtaaaaacatttttcattttctagacacttaaagacactgaatttaaagcagattaagtagcaaaaacattgtcagtaaaaatattgctgaataggacatgatgaggtagttattattcaaatcactgatggagactacacacacatatagttataaagacacatggtactgg

SEQ ID NO: 14856 - DNA, 376 bp, Homo sapiens
tctacaattgtgtggtactacctttatattgagctctttgctgatatttattatataatttattataaacaataattcataattttatagttcatcatctgatggtgttcaccttcattaaagactacataagtctaaattctaaagaaagttgcatgcagcatctcatgcctatagtcccagcaatttgggaggctgaggtgggaggatcacttcagcccaggagtttgagaccagcctggacaagatagtgagacctccatctctaaaataaaaaaaacaatagccaggcatgctggcgtgtgccggtggtcccaactacttatgaggctgaggtgggatgatctcttaaccctaagagtccaaggctacaatg

SEQ ID NO: 14857 - DNA, 402 bp, Homo sapiens
cgttgctgtcgagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaa

SEQ ID NO: 14858 - DNA, 395 bp, Homo sapiens
cgttgctgtcgcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaa

SEQ ID NO: 14859 - DNA, 384 bp, Homo sapiens
  misc_feature 384: n = A,T,C or G
cgttgctgtcggggagcacgttacgtccggacgcgtcggtggtagggctgggtctccgaacctgaaaccgggagcttcctgctcgtgttcgctgttgagaagctacccgcggggttgtagacttcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagatn

SEQ ID NO: 14860 - DNA, 437 bp, Homo sapiens
  misc_feature 29, 205, 208, 209, 210, 211, 212, 214, 219, 222: n = A,T,C or G
ctataatacagctacttgtcttttgcggntacatcgattcgaattcggcacgagcacacacacatttacacacgcaggactctggagccagagtagaggctgtggcccaggcactacctgctggctcccacctatggtttgggggccatacctgttccagctctgttcccagggtggggcagggaggtgggggttgggggagtantgnnnnncnttttnttntattcttttccctttgtgttttacgttttgacttacatctcatccctgattggctcgctcatatctttaaactggtgttgttatcacgtgctgcgtatcaactgaccttcatactcgcctctacctgtcctctctctctctcgtattaatagtttttttttttctagaatcttctgtaaatccgaggttatgatctgggtatgctcactatgacc

SEQ ID NO: 14861 - DNA, 450 bp, Homo sapiens
ggcacgagcagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgtgacacctccgggccgggcatctacagcccaggcatctacagctggtacacctccaggccgggcatctccaggccgggcatttccagcccaggcatctccagcccaggcatctccagcccgggcatcttcggctctggcatcactttccaggtcctcatccggcaggtcatcatccgccaggtcagcctcggtgacaacctccccaaccagagagtaccttggtagaacaaccg

SEQ ID NO: 14862 - DNA, 336 bp, Homo sapiens
gggagggcctattctcacgtggatggaggagggtaatgggacccacccaagtggggcataggacccccaagactctatggctttcactcaccattcattgcctatctcttcaccaacctgagtcacttcttagtttcatgtttctttctatatctctgagattataacatagctgacaagttcaatgaagtcttactaagggtagtattagtattgtgctcaacagttgacctggagcatctttcttaatcctttgagaggtgctgtgattgtctccactgtccaggaaagaaaactgaagattaaaaaggttttgggcctggcatgggggtcatg

SEQ ID NO: 14863 - DNA, 373 bp, Homo sapiens
  misc_feature 373: n = A,T,C or G
cgttgctgtcggccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcn

SEQ ID NO: 14864 - DNA, 349 bp, Homo sapiens
  misc_feature 325, 326, 327, 329, 330, 331, 332, 333, 334: n = A,T,C or G
accaatgggggggggcgagacaattactttacaaaaataaaaatgtaaactttctgcctttaatgtttagtgcttaaccaccaatctctgctcctgtctgtaaaagtcagacttcattaattttgctgacacagtaagttctcatggaaaatagtgacaacagccagcaatgtgaatagttacatcttggctctgtaaatatcaaaacagactttgctaagcagaaatcaatagacactcgatcaaatagtctggttctatttttttatttttattttaatttttttgagatggagccttgctctgtcgccccagatggagtgcnnngnnnnnntctcgggtccactgc

SEQ ID NO: 14865 - DNA, 328 bp, Homo sapiens
aggcacctgagagtcacttctgggcagaaagacaaacacatgaatacaagccataaatgaaaagaatcaaccagttacaccattaaaaatgtctgaatataatgccagtttctacgagtgtggagggtgcatctctgagatggtgaatttcttcccacctaaaagcagggtgacctaggaggaattcgtagtgtcctttcacttattttcagacaggctcaagattactttcaataaataagtataattgttcataatttgaagaatgtacttacctgatgacatgactttaaatgtcaaaaagctaaaagatcacacaccaacaccg

SEQ ID NO: 14866 - DNA, 338 bp, Homo sapiens
cttcgtgacctggactgaaaacattttcaagttctctatttcggtcaatacagcccctttaataattccccaaagcatctcccctttccgcctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgaggtcaggagttcaagaccagcctggccaacatggagaaaacccgcctctactaaaaaaacagaagttaaccccgcctcggcccgc

SEQ ID NO: 14867 - DNA, 355 bp, Homo sapiens
gtcattttatccattcaccttttaggacactttggttgtcaacagtgttttgcaactatgaatatagctgttatcttactcttttttaaaatgcactttaggtgtactcattccttaggttgagtacacctaaagtgcattttagatatactaatcatctctgtttctgtaatgtcattatcattaaaaacatctcattgtgttatatttatatgctcataattctttttttcttgtagtcaactgtaaatctcttaaggacttagaccatgtctaatacatctgtgtattcctggctcctaaactggatttcagagattatttttagctgaatgaatttgccaggcagtgtatg

SEQ ID NO: 14868 - DNA, 329 bp, Homo sapiens
atttacaataagtttacaatttacaataaagctttaaaagaacaacaaaaaattaaatatacctctattgcttgtacgtttttctacttttgatagaaacatggacatattaaatatttcacttttaactctagtataagaaagtcaataatgcaagagtgatgataaagagcaactctcacttggcatcatgatcagggagcaatagggagtgggtgactgcggtgacctaaagcatacaagccttgtctaaagtgaacagctgctctcagccctagctcataagtgccacagagtctacaggcctagacctgctgatccccagcatt

SEQ ID NO: 14869 - DNA, 335 bp, Homo sapiens
caaaacataaatgtattactcaaaatgttttatataggggcacaagagttctttgactgaagcagtttttattttaagttgtttggcctgaaaccattcctggcagcaaaaatctttttaaaagtcttcatgtgtagatttaagctatccttggcataaaataattaatatatctatatttcaaagagcagatggcagaaaggactataccgaaatatattttatttctgagcaccagcataaaaacaagagaaaaaaaaagaacagccagaatacagaggtttttagggctattctaagtgatactatactggtggagacatgtcattatatat

SEQ ID NO: 14870 - DNA, 124 bp, Homo sapiens
ctttcactacatattaaatgacactttataactaatataataggacaatcatcaatgcatatatagccagcccttcatatctgtgggttttgcatccaggattcaaccaaggaggaattgaaaa

SEQ ID NO: 14871 - DNA, 348 bp, Homo sapiens
cggggttgatagggaaccagcgcattgaatatccttcctttacattcatggtactactccctgatctcactatgatgacgtagggcacagccttacttaatgcacacagaatggggctctcaagccaaataggcgtctgaacagactggatctactagaacagaaattctagggactgaactttctgtgacacagagatggcttttttttttgagggtctcgttctgtcacccaggctggggggtggcacaatcttgactcactgcaacctccggctcctgggttcaagccattctcctgccttagcctcctgaatagctgggattacagatgtgcaccaccatccct

SEQ ID NO: 14872 - DNA, 337 bp, Homo sapiens
  misc_feature 314: n = A,T,C or G
atcgtatgaactacaactattaaaatgtgaaatgcatgatgcaaatagtgcacaaaaaaatagagtgaaaatgatgaatacagccataaaagacagccaaactccattttagcaataaagtaaaatataatctgctgtcaggggaaggtaatttgaagtacttgagatgttctttaatttaaaaatccaaaaatatttttagctttagttactataaaacatgtttaagcattttccatttgaaataaaattttaatttcatgctttgtcagtttccctaaataaatagaaaatagtaaaatatcgcatactanaaaaatcaacttctttggtaata

SEQ ID NO: 14873 - DNA, 358 bp, Homo sapiens
  misc_feature 307, 358: n = A,T,C or G
atctgataagattattttaaggacagaatgaagatttcctcttgaatgatttgctctgccctttatcaaaaagacatgtgtctgtccaccttaacatttctggtataaatataccttgtcctttaaaaattactgcataacattaaaatcacgagcattgctatacatcatcaacagtcaagccagagagccaaatcaggaatgaactcccattcacaattgccacaaaaagaatcaagtacctaggaatacagctaactatggaggtgaaagatctctatgaggagacctacaaaccactgctcanagaaatgagaaatgacacaaataattggaaaaacattccatgctcatgggn

SEQ ID NO: 14874 - DNA, 417 bp, Homo sapiens
cgttgctgtcggtaagagaaggagaaggagaagggattaagttttacctagtcacatagccaatgtcagattcctaactagtggccgggtccgtctgatccaatgatcactattctctcatttatggtgtagtcactgtgtggcttcaaccacagtggacctctctggacctaagtgccctcacttgtaaattaaaagaactgggttagggccaggcatggtggctcatgcctgtaaccacagcactttgggaggctgaggcaggtcggtcacttgagctcaggagttcaagaacagcctgggcaacgtggcaaaaccccgtctctaccaaaaatacaaaaaattagccaggtgtcatggtgtacatctgtggtcccagctactgggaggctgaggtgggaggatcacttaatcccg

SEQ ID NO: 14875 - DNA, 379 bp, Homo sapiens
cttcatgacctggactgagaacattttcaagttctctatttcggtcaatacagcccctttaataattccccaaagcatctcccctttccgcctgtgctacgactctcttgcacacgttttgtattcccacagatcacaaaatcacaaagcaccggagctggaagaatcttaagagataatccaaggccaggagcggtggctcacgcctgtaatcccaccactttgggaggccaaggcgggtgggattacctgaggtcaggagttcaagaccagcctggccaacatggtgaaaacccgtctctactaaaaatacaaaaattagccaagcctcggccggacacagtggctcacgcctgtcatctcagcactttcagaggcg

SEQ ID NO: 14876 - DNA, 382 bp, Homo sapiens
tacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacat

SEQ ID NO: 14877 - DNA, 328 bp, Homo sapiens
ttggactagagattgttgttacaagaactttaaaaataaaaaaataattaaaaagacttatttttctgtatcattcttactggttcatttgtttaataggacttaagacatgaaaaaatcaaactagtaaatttgcattcatacttgcttacctacttaaatatatagaagtaatgcagatagtggtaaaagtcttgagtagttcaaagaagtctaattgaaatactgtggattaaaattttattttctattatttcttttttcagataattactgatttttaaaatgtgttgattggccgggcgcggtggctcacgcctgtaatcct

SEQ ID NO: 14878 - DNA, 356 bp, Homo sapiens
tatctgccaaaatttgtttggtatatataacagcttttggagagattttcactgctatgcttttctttcttttatgctttgttatttggagttttaatttctcaaatgatcccttctttttagatttcaaattataacctatttcctgcaccattgctgacgcctggtgatccatgtcagaagtacttccaggtcagatacattttctcatatttcaatgcagagaagcagttgaatattaaaacttaaaaaaagataatgtttaatgttaaacttatgatttactaaaataacatgttttttaatttcattgttcttcactaatgtaatagaaaaatgaatcttggccgccgcgg

SEQ ID NO: 14879 - DNA, 374 bp, Homo sapiens
cgctgctgtcggcctggattacatatttagatcctatctctataaaaaatcaaaaattagccaggcatggcggggcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcatggccagttaagacaaaatgctatgactttgaaattcacagaaagaaataacagtttacattacgtcttcaggtattcacgatagaaataatctcctgaaaaacctgaatttcagagattcttagactggctgccaaaggatgacactagcg

SEQ ID NO: 14880 - DNA, 294 bp, Homo sapiens
gattttttggtacctttcttagggatatcatagtttgagataccatgaaagatgttcaggcagagccttttcaacgaaatcaccttgctgtggtcttcacagagtctagttaatagaagttttgcactggctgggtgtggtggctcactcccgtaatcccagcactttgggaggctgagacgggcggatcacttgagcccaggagttcgagaccagccctggcaatatggtgagttcttgtctctacagaaaacaacaatttacaaaaaataaataggcatggtggcacacccc

SEQ ID NO: 14881 - DNA, 358 bp, Homo sapiens
gagactgtgccactgcacttaagcctgggtgacagagtaagactctgtctcagacaatattgtgatgatattgttatttttgaaacttttataccgcagagaacagagagagactgcgacgtatataccctacaaagggctttttctctggtagagcctggaagggctagaagtaaacttttaaaaattcaagatagaatcgtgatgagcaagcctcatgcacatgcatgaggatggctactaccaaaaaggcagaagataacaagtgttggtgaggaagcagagaaactggaactctcatgcagtggggttgagaaggtaatatagtgcagccgcggctgggcgcagtggctcacgg

SEQ ID NO: 14882 - DNA, 377 bp, Homo sapiens
ggcattatgtctttcagataggatgatgctgattatgtttggaaatagctaatctttctaagaattgaaaattgttttctacatttttcatccacttacagatcaaagaagaaatctgttttatatatgtcaattttcctatagtggattgtcttaaaatagagcacgtttgatttacaccagatttatgttgtgacattagttacaaatttggtaaaaacatttctaattagagatgatcaggtaaatcttgacaactgttgagtaactgctagtaatgctcttgagatttattttttatttgatatcagatttataattcaagtaaatatctgagtagaagctaatgcaaagagataattactatattctaaggg

SEQ ID NO: 14883 - DNA, 355 bp, Homo sapiens
  misc_feature 355: n = A,T,C or G
aatggcacttaatcacttaaactaatttaaattaaataattggttatttaaatcatctttttcatttattctctactttatttgtttgtcttccctgcctgaagggaggagctaactgcattagaggtgttgaaattcaccgttagatgatccctgggctagaattttaaaggatgtggggatttatcaggtagggaatatagaggcaaggaagatgtaggtgtatgtactcattcgtatttaacttgtccagtttattaagtcatttgaattttgtcagaagctagatcacttctagtagtttttaacaaagtaattctcaaaaacccaaactattgatttggtttgcctcccn

SEQ ID NO: 14884 - DNA, 401 bp, Homo sapiens
cgttgctgtcggtttgcttcaggatgtttgatttaaaacagaggttcttccctttccggacagggtcagaatgacctgggttctctccaaggttgtgtacaagagctccacaccttctgttcagaagaccaaggacagtggcagatgccatggcctgttgtgaagcgaagttggaggagggagaattctacaacagatggtttcttggatatctggggcctgtccagctctagctttgaaaatgatgggccagaccttgaactggcatggatacaggcttaagtgccagaacaggaagtgaggtcctagggtgatgtctttggggcagctgctgctactcagctggtgggctggcaccgctagctttggcttcctatggtttggtgaggagattgtgtgtg

SEQ ID NO: 14885 - DNA, 387 bp, Homo sapiens
tacggctgttatatatacgacagaagggccatacagtaggaggaggggtacctaacctttcacaaacaacaacaaatgtgaaaagtcagtgacacactggacagaagaaacagtgagaccagcaggccatttaatctacattattctctccaggcttttaaaaataattatgccatcatgtgctttttgctgctattatgtcataattgccttacatctcaaatcattaattaaaatggattttaagagtacggaattggctgacttacaagatcacttattaatccgtgcccggatgtgttgtttcttgcttacagagacacccttgaccgttactctttcgcggaatcgttcacaatggcattcttacaacaacaggatatcgcg

SEQ ID NO: 14886 - DNA, 386 bp, Homo sapiens
  misc_feature 386: n = A,T,C or G
cgttgctgtcggcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaan

SEQ ID NO: 14887 - DNA, 380 bp, Homo sapiens
cgttgctgtcggcccttagattttggagacatcaggcagatgtctccaaaaatgattgtgatcaagaatctgaattataagattcacagtctgctccccaacccagtgctgccaactgtacagctgcgcctccacgaaggggcatatgccaggctcgtctgaccctggaatgaggatgtaggaagcaggcagagctccggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggg

SEQ ID NO: 14888 - DNA, 389 bp, Homo sapiens
  misc_feature 389: n = A,T,C or G
ccaggctggtcttgaactcctgacctcaagtgatccgcccacctcagcctccaaagtgagccaccgcacccggcctgttactctattttctacttactatttacaactgtcagaaggtaaatgacaacctgatttttgttgctttttaagtcacttatacctctcactagtgatacacatcttttttatttcagaaaatgttttattataattataacattttagtatttgttcttttcttttgctttggcttggttctttagaaccttctatttatgtatttgatcttcttgaactggcttctatggtagtctctttctctcaggactttttttttgttttgccactttcttcatttccatccaattttagaaattatcctcatttgn

SEQ ID NO: 14889 - DNA, 328 bp, Homo sapiens
gaggcaagctgcaagaaggccatggggacaatgtgcagagcaatgaagcctcctgcccatagtgactgtacccgcgacctggtggtgaccaggcaggcatttgcacctgctgggctccagagctccccttctttcttcactcggtgacagcaaaccaagacttgggtcacatcatttctgggtaagtatgcagagatgctgaaagaacagtgggagcaaaaagaacaatattcttgaacgtcttctgttttctctatgacccttagaaacccaaagaaaatttcacagtaggaaaataatccattgcacaaactgtatttttaaaggg

SEQ ID NO: 14890 - DNA, 374 bp, Homo sapiens
tacgcctgcgagaacacgacagaaggggttgtcagccacccgcagtgctctttctctgaaagtggtttggaagactggctaccatctgggtgcgaggaatcattagcagcgaggccaagtttgaggagcctgagaggagctgtgcgccaagaggagggtttttcttttccgagaatccagaggcccttattatctgcttgctttctcagctgaacccttgcccccggatcccccagcaaagccctctgaggcggattttgtattcatcttgtgattgatccttcagatatctgaacggtgcgatcctcggtcccgtgtgtaatcactattctccctcatagcctcgttctccttaacgcttcctcatctacgtg

SEQ ID NO: 14891 - DNA, 366 bp, Homo sapiens
ctttgtttcaaaaagcttatcccatctctaagaataacagtggtaacaacacaaaatattgttttaaaaggaagaaacaaatctaaacaagaagttccttactgcctataaaatctgaaactttcttttttttttttttagaaaaggggtttcctttttgcccccagggggggaagaattggggtaatttcaaataattgtaaatcactcctccgggtaccccccatttttccggcacatttccccgttttattttaggacaaaagcacgcccccccctccaccaaatatttttggcggggctcatacaccacacggctcatgtaacaacctccgcattatttataacatttatcttgtgttagca

SEQ ID NO: 14892 - DNA, 349 bp, Homo sapiens
accagtgagccatgctgctcctttaaataaaatgaggggtttggaagagaaaatgaagagaaatccttgggaaatttgagagaaatgagtaaagaaaaagaaaatatatccttttaccagagttttccttcttaaccctgacttggagttgctctttgctctggaggagagctctagatgggctgggagatttggatctcacttgcagtatttctcaaaagcagctgtgcaaacccaggcaagtcattctgcctctttgggtgacaatttcctcccttgaaaagtgaaaatgatgtctccctgtctgtcctatcagtgggtaaggaaaatcagatgaaatgatggctac

SEQ ID NO: 14893 - DNA, 345 bp, Homo sapiens
gttcatatacaggaatcaaatcacattgacacacatagtcactttgtcctatttaaattctcttttaattctttagattacatagagaagaaagactcagtttgctgctagtatttccttaaaacatctcaactctctctctctccctcttgaacagagcaaaggccagctctgattcagaattctcagctagcaacagtatctagctacaatttaacaacatcgtctgggaatggtatatatttttatatttatcttctattttggcaaatgatactggatttccatttatagtaatgatataaagtttccttaataaatgcatttatctaagtcaataattgg

SEQ ID NO: 14894 - DNA, 377 bp, Homo sapiens
ttgtaaaacctggaaggacaaggtttgggcatggcatcagagctgaatgaaagcttgccatcatggtgtactggaaagggacagatacatggtgaatgccactgttctggactttgtgttcattggtaataaatgaaggagctcaacttgtttttgcaagagggacatttgcaataattaatctagggacagagagatactgtaaagatcaatgattatgatttgggatccggcctcagattaaccagggctcaaaactctcttctttctcttaataaaagagagaatgtactgacttttcgaatgtactcgccttaacttcccagtatgttcttaatgtttaaggcatactgctctctcctcctaatcttgtaccc

SEQ ID NO: 14895 - DNA, 332 bp, Homo sapiens
  misc_feature 332: n = A,T,C or G
gactaaagaaaatcccaaaagccaataaataaatatttacatatatggtatataaaccttcatttgtccttgtgtcctggttcccaaaaatataaagggtaagtctgctcctctaattcactccaatctcagtccgaacactgaacttgtgtctaccacaggcccaatcctgctgtttgggtggagtgcctgacagtggggggagagagggaagtaaagtttttggtacctcaagcaaatgccaccttgtaatgaggctttctccctttggtcaccggcctgtaccctatattatttggagtctagaaggtccaagttctgaacaagattan

SEQ ID NO: 14896 - DNA, 416 bp, Homo sapiens
cgttgctgtcgaaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaag

SEQ ID NO: 14897 - DNA, 398 bp, Homo sapiens
aagacggcctacggttgcgagttgacgacagaagggagcctattttatgagataagtactattttgttaaaattttatatttaatatagataataaattgactaccccaaatggtggaatgcaaggatagcatattacaaggaaaatgttacaaacaactaacattaactagacaaaggatgaaataatcatttcaaaaaaggttgaggaggctatcagtaaaattcagtatctattactgataaaaatgttggaggaaaaagtgtatcagaaaatataatcatgggccagtcgcggtggctcacgcctgtaatcctaacactttgggaggccgaggtatgtgggtcacctgatgtcaagagattgaaaccagccttggccacgtaatgaaaaccctg

SEQ ID NO: 14898 - DNA, 409 bp, Homo sapiens
  misc_feature 45: n = A,T,C or G
cccgttaactccattatatgccaatagagcgagactccgtctcanaaaaaaaaaaaaaaaaagaaaaaaattcctttgaaaaaaaacccccccctcaaaggaaaccttttttttggggggggggtttttcaaaaaaaaaaattttgaaccctgttttttacccattggggaaaaggggggaacccggctggggcctcccccaaccggggggggggggggaaaaaaccccgggggcccccaaaaggccccccctaatgcccgctaggggcttccttttttgccccccatttttgggggaggggggatttttaataaaccccttggggcttcagccaaaaagggtaaaaagggaacccgttttcctggggcaaattcctgaaaaaaggtggtgaaaaagcccactttgggc

SEQ ID NO: 14899 - DNA, 381 bp, Homo sapiens
cgttgctgtcggcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtt

SEQ ID NO: 14900 - DNA, 334 bp, Homo sapiens
tgctcaaaccagctaacttttctaagatcctgtttccccatccataaactgaaataatcagagccctacctctttcagaataagtaaggagtgaatgaaatattccatatgacatgctcaacataatgcctgccacacagaagtattcaattagtacttaattcttgttatatttttatcattatttggatttaactatcttgctgagttgtttggaagccaaatgaggtcattgcctccaaacatttattagagatattgctatgtgctaagcattacaataggtgcaggagaatacaaacgtgaatgcctgcaaggaacttacaccagaagg

SEQ ID NO: 14901 - DNA, 418 bp, Homo sapiens
cgttggtggcgcaggcagatgtctccaaaaatgattgtgatcaagaatctgaattataagattgggagtcgggtccccaacccagtgctgccaactgtacagctgcgcctccacgaaggggcatatgccaggctcgtctgaccctggaatgaggatgtaggaagcaggcagagctccggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcctttcaaaaaaggagagctcttcttcaagataag

SEQ ID NO: 14902 - DNA, 385 bp, Homo sapiens
  misc_feature 385: n = A,T,C or G
cagaactggagcgtggcgatggcgttaaggttttgagggagcgagccacctagcggaggctgtccttcaccgcgggcgccaatggggagcagaaggactcggacacaggaccgccggggtcctgcttgtcctggggcagccacgagggagccctcgtcaggagcgccatgggccgaagctgcctgccctctgcacgtggatgtttctttggaacaaggggaaaaattatgactttcttattttgctttgacctgtgaatgacaccctggtctctggtgcctggggtgtgctctctgcagtgctgtcaggcacatgctggttccttcagcgctaggtgcttggcaccttcagtcttttgctgacgccatggtcgttcctggggccn

SEQ ID NO: 14903 - DNA, 407 bp, Homo sapiens
ggcacgagccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcaca

SEQ ID NO: 14904 - DNA, 374 bp, Homo sapiens
cagtctctactaaaagacagaaacaatacactgccaaaatgttaagttgaccaccgtgaaacttctctattggagtgtctgtttctttaagctgtgaatactgaaattatgccttgtctcctccccaccccagggggatgccgttttgcagtgtggacacgtgtttgaagcagttactaaactcgtcatcctggttaagaaggagaacattgtcaatgttgttcaaggaaggtaggtggcttcatcttcagctcaggaagtaattcaatgttaaaatgcttattaaggccgagcgtggtggctcatgcctataatcccagcactttgggaggctgaggtgagcagataacttgaggctaggagttcaagaccag

SEQ ID NO: 14905 - DNA, 333 bp, Homo sapiens
cagtctctactaaaagacagaaacaatacactgccaaaatgttaagttgaccaccgtgaaacttctctattggagtgtctgtttctttaagctgtgaatactgaaattatgccttgtctcctccccaccccagggggatgccgttttgcagtgtggacacgtgtttgaagcagttactaaactcgtcatcctggttaagaaggagaacattgtcaatgttgttcaaggaaggtaggtggcttcatcttcagctcaggaagtaattcaatgttaaaatgtttattaaggccgagcgtggtggctcatgcctataatcccagcactttgggaggg

SEQ ID NO: 14906 - DNA, 393 bp, Homo sapiens
ggcacgaggagaaggaaaacactggatttataagccacgtctgggaagttggaaaaggagaaagaagcaaaggaaggctctgaaccaaaggagcaggaagaccttcaagagaatgatgaggaaggctcacaagatgaagcctcggagactgactactcatcagctgatgagaacatcctcaccaaagcagatacactcaaagtaaaggatcggaagaagaagaagaagaaaggacaggaagcaggagtattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattg

SEQ ID NO: 14907 - DNA, 402 bp, Homo sapiens
cgttgctgtcgcaaggcgcgttcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagaa

SEQ ID NO: 14908 - DNA, 382 bp, Homo sapiens
cgttgctgtcggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagaagaggtcctgtcgcatttcacgaagcacttccccgagttcagccagattctttggatcggaggcag

SEQ ID NO: 14909 - DNA, 176 bp, Homo sapiens
ggcctacgtgttcttgcggtggcggagcggcggattagccttcgcggggcaaaatggagctcgaggccatgagcagatataccagcccagtgaacccagctgtcttcccccatctgaccgtggtgcttttggccattggcatgttcttcaccgcctgggtcttcgtttacgaggtc

SEQ ID NO: 14910 - DNA, 405 bp, Homo sapiens
  misc_feature 405: n = A,T,C or G
cgttgctgtcggaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaan

SEQ ID NO: 14911 - DNA, 406 bp, Homo sapiens
ctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaag

SEQ ID NO: 14912 - DNA, 320 bp, Homo sapiens
gttcactatgtaagttaaaatatcaaagagggatatacaactgaaaagtaaaagttcacctttctttcctttctcctacttctataatttgatcagtttagataaaatatctctgcttttcaaaattactctctagctggctcttgaggaaaaaaaatgggggtaggaggagctggggccttcccttatttatacaagccgatgaagaggtcctagacttttggagagtcacagtaaagaaagaaaaccagtcacctgatttaaacaaacaatatattcaggtttctgaatctagatttctagttccagtctttgaacag

SEQ ID NO: 14913 - DNA, 316 bp, Homo sapiens
tatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacatgaaaatacaaaaggaaatgaacagtgacaaggataaatgaatactgagtttacaaacagtgaatgtaatgtcctgtggggtctgaattatacatagaatacaaatgcacaataacaatgcgaaaggcagaaagaggtaaattcatttaaaggttacacagttctagcagtactga

SEQ ID NO: 14914 - DNA, 317 bp, Homo sapiens
tatctgctgtaatatttttatctgaggtagggataaaaacatcccatttctggactttacttggagaaccagctagaggtgaatatacgacccttcatgacctggactgaaaacattttcaagttctctatttcggtcaatacagcccctttaataattccccaaagcatctcccctttccacctgtgctacgactctcttgcacacgttttgtattcccacagatcacaaaatcacaaagcaccggagctggaagaatcttaagagataatccaaggccaggagcggtggctcacgcctgtaatcccaccactttg

SEQ ID NO: 14915 - DNA, 323 bp, Homo sapiens
  misc_feature 323: n = A,T,C or G
atctggttagtacaatgcacttaaatatgctgtgtgtgtgcgtgcgcgtgtgggtgagtatgaggcccatctttctctctgggcccattcttttcacagaattaacgtatgtacccatcagatttggtttaagatctatattatggtgaccacacaaatcacatcttgtctactgatctgactcctatgttattctgtctgaggttgctattgggctctgtgacctttgggaacttgcttgatttctctgccatttttatccctatctcagatgcgtattttgaaattttaatgtcattgttaatgtgaagaactcagccagn

SEQ ID NO: 14916 - DNA, 351 bp, Homo sapiens
tacggttgcgcgacgactacagaaggacacgaaattaaagcatatagaggtcaagtttttctccaatgttactgcgataacatatggcaaagacaaaattgtcaaccagggtatttgagttcagagaaaacactcttagtgaatatgttagagtgtgagagtcataaacagcacattgcttttacactgaacttctacacatatttgagcaactgggtgatttaaaaaaattattacacggatgatgaattattaagcaaatactgaactttttaaattggagatattttaatacttatataagaaattgcaggttttcacgtatcatagctttacatatcccacagaggg

SEQ ID NO: 14917 - DNA, 267 bp, Homo sapiens
ctactgtcattatgtctggctaacaggagaaactctgtgagtagctattaattaacaaagacaaagcacattaaagagaaaatggaaggagggagggaggaaggaaagtaaagtttgagaggaaaagaatatagattcctaagtcctggggataagtaatgaagccttatgcttgctatattttttctttctggaaatatatgaggtgtctgtggtgacagacgaaagaccattttacttgaacaaagagtttaaatacagacttga

SEQ ID NO: 14918 - DNA, 247 bp, Homo sapiens
tgggatatgtgtcgcttaaaggacattcttgctgctttgcagacagtggcttgaatgggtcaatggtttctcacgtgaaatcactcgaaagaatttcttggaaagaatggaatttaacacatatgtgtgggaggatttcaaatgatggaaagaaatagggttcaaaagagactgagctatatgctgcaaatcctgacactgggagtatacccgtacagtttgaagagggttaattcaatagaaaaat

SEQ ID NO: 14919 - DNA, 370 bp, Homo sapiens
tgtggactacgactgcgacatgacgacagacggggatgagtgtgatccatcctatcctcagatggaaggataaaaaacctatattcattacaattgatgagcaataactattatgagaaaacacaacatgccttcatggtaccagccctcgcaacaatacgcattcatttgatcgaactacgtccatagtgaggggcatgtattatagacccatagctaattcgtactcaatggggaaaatcgaaagcctttcctctagaataaggaacatgagaaagatgcccactttcatcccttttattcaacatagtattggaagtcctggctacaacaatcaaacaagagaaagtaagaaggagcatccaagttg

SEQ ID NO: 14920 - DNA, 356 bp, Homo sapiens
aggatgttagccaggaggatctcgaggacctgacctcatgattcacctgcctcggcctcccgaagtgctgggattatgggggtgagccaccacgcccagcccatttgtcctttttttaatcaaaagattttaaaagtacaagtactgccacagagtgcaggtctgcaaagtgtttcgactctacaaaagagtgtttgtattttaaaagttcaggaaccattttacggactaagacactgaggccctaggagatagggcttcttggccaagttgcagagccagctggggcccagggagtttaatccaagtggtgtgggtctccctttctctctgttcagggaagagcccccttcatc

SEQ ID NO: 14921 - DNA, 336 bp, Homo sapiens
  misc_feature 250: n = A,T,C or G
caggctcaccgattcacttcatccccgtcaccaggtacttgttagttaggtacacaaaattattcttgtggattcctgaaagtcttgtcacagtttgttatctgcagactctcacttatattcatctcaaagaaacgaacatgatcacctggtctagttcttccgacaagcctggacaatatagtaagatcccatatctataaaatgttttcaaaaaaattagctgggtgtgggggtgtgcacctgtggngcctgctattcaggaggctgaagtaggaggatcccttgagtccaacagttagaggctgtagtgaacagtgatggtgccactgcact

SEQ ID NO: 14922 - DNA, 342 bp, Homo sapiens
  misc_feature 294, 322: n = A,T,C or G
tattgttagttattgttgttaatctcttactgtgcctaatttataaattaaacttaatcattggtatgtatgactaggacaagacatagtacggtatatataggatttattattatttttggttttaggtatccattttaggttttaggtatccactggggatcttggaatgttttccctgcagataagggggggactactgtacattactttctccatgtaaatattgcccatgtaaatactgctgagaccagtagtatattatgattctatttactttcttatatgctttgntttccttctcaagttaattgcctgattntatgtttatttctttttatt

SEQ ID NO: 14923 - DNA, 412 bp, Homo sapiens
cgttgctgtcggggctgttgtgagagctagaggcttggtagtaaaacaatgctagatgtggtgtctgctcctgagcttaaaaatagcttgagaaagacagtgatattatcagaaaagaatgtgcataatgaaaagttgaaacttttaaaaactcactcaaaactaagttttaaaaaagagccaccgcgcccagcctgagacgtgttttaaagactgacttttgtttcttttctagatataaatttagaaattgagaagtgtattttgaaaaggcataataagaaaaactatggtatataattattttaacttgccatatgaaaacctaaggcacagggaggtaacttgcctacaggtgcagccctaggaagtcagggagccaggattcactgtcagctgactgactccaaat

SEQ ID NO: 14924 - DNA, 336 bp, Homo sapiens
cggggacgggctcgttcctgccacactaacaattcgagaagccaaggccggaattattcttgagaccgagggaataggaccaatcctggccatcataggctgacttcatcgctccaacaggatgatttgcatattatccatgtgcaatggcacacacctggagtgcgacgtacttgggaggctgaggtgtgaggatcacttgagcccatgaggcacaggttacagtgagccaagatctcaccactgcactccagcctgggtgatagagcaaggtcctggctctaaaggaaattttaaagattgcccttggaattaagattaatatgtattccctgg

SEQ ID NO: 14925 - DNA, 334 bp, Homo sapiens
agctgtgacctgagggatgaattgcccattgattcatttattgattgaaacgccctttattgaaagtctgctatgtgccaagcattgctttaggcacagggtgtatatagtgttaaataaggtccctgctctctcagagcttacaatctgataaaagagaaatgcaatgagcaaataagtaaagaaaaggaaatatcaagcaggcaataacttctgctatgaaaatcaaactggggaatgtgataagaaatgcatagggggctatgctaggtggggtggtcaggaaaggcctttctgaataggtgaaatttggaggttaaaaaacatggatagg

SEQ ID NO: 14926 - DNA, 335 bp, Homo sapiens
aacatcactatcaattaacattttaattgatagtgatgttattaggcttttcatttaagtcatctacaaattgattgacaattgaactttatcatttgcttagttcactgctaaatcaaactgtttaatacttttttctaatagtaaaaacatactgaagattgagaagcactggtgtagaaaaaatatgtaaatatataaaatgtaatagcctggaaatcaatcagaaaattggaactgattccatttgtaagaacagaaacataaaataagttttaaacttataaaacttttattttaaaattactacaaacctcaatgtagggtataaaaga

SEQ ID NO: 14927 - DNA, 402 bp, Homo sapiens
tcgaattccgttgctgtcgtggacaaacattccttttcttttcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttatctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcaacagccctgctacataatgttttcaggccaccttaatgacaatgagaggcgagt

SEQ ID NO: 14928 - DNA, 399 bp, Homo sapiens
cgttgctgtcgcgagtagctgggattactttcgcccaccaccatacctggctaattttttgtatttttagtaaagacagggtttcatggagaaaccaatatagaattgttcaggctggtctcgaactcccaacctcgggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactacccagctgcacaggtgactggatgggggaggtgtgggagggttttctccacactacgtccttctgcattg

SEQ ID NO: 14929 - DNA, 347 bp, Homo sapiens
aaaccctgtgaggctgagctgtgagggaaggtttggagtttgctatgggaaaggctgcagggtctataagaattgaaaaggggaggccaaggaggcttcagatccccttgacagtatttttaaaagatgcaggttaaaaaattgattttcttgttatttatattttgatacctaattgaacttctccaacttgacctcttttaaaaacaacaacaagaaaaaaaaaaaaaaaacccctgcttccccttattccttaacccgggaggggcctttcccaaaaaaaaaaactccagcccgatttctttgggaaaaaaaaatcctaaaacccttaaaaaaatacctttaag

SEQ ID NO: 14930 - DNA, 362 bp, Homo sapiens
aacaaaaaatatgaagacatactatgtgctgggaattattttaaaactaagaaaacaataaaggaaaaaaactagattgctcctttccctcattattataccacacgttttctgtcagtactacaggaatatataaaaggtctatcttccttgagggcaagattcaggtctaattaatcttttgatctttcttattactcagccagagttttgcacatggcagacataaggtaatagttggttgagtcatctatgtaaatgaatgctgcttagtgcctacaaaaatgggatttctcaaagatgattagagaggtaagtggtaaggaagatgttttctcataaaacccagcagctttgggaag

SEQ ID NO: 14931 - DNA, 176 bp, Homo sapiens
agcttgcatgagccaccgggcctggtcaagaataaggtcatttattgttgtataggcaataagtgtgaatcaaggatacttttaaaaactcataggtgagcccgggcatggtggctgaaatcagcctgcacaacccgtagtgagacaccatctctacaaattaaaattaaaacttt

SEQ ID NO: 14932 - DNA, 358 bp, Homo sapiens
  misc_feature 306, 308, 309, 310, 311, 312, 313, 314, 315, 316, 317, 318,319, 320, 340, 341, 342, 343: n = A,T,C or G
gaagatgtgagtgtgactcgtaaaggcaagagcatgtatattatgcaaaagcagcctgaaatattttattcacagacagacagacaatgcttgactccctgctaatctgaaatacttcgtggggagggccagggaaatcaaaacaaaatttcagaagtagaatgagctatttggtgtatgtctccaaggccagtaaataacaagaaggaaaaataaatttctttgctaacaacaagaaggagaaataaacttttttgctctaaaatattttccaattatctccacgacactggagggaaggactancnnnnnnnnnnnnnggagggagggagggaaaaannnnggaaaggaaaaagga

SEQ ID NO: 14933 - DNA, 400 bp, Homo sapiens
cgttgctgtcgggaacaacaaaacatttttcatagagatgttataaagattagagattatttggcactgtgtgtgacagattataaaggttcgatgaatgaaatctggcaaatttttagatatatgtattcaacgaattttttggtggaacacagataacataatcctgagaattaactctttgtacagacctcaagatgagcaaagctctatcactttcagaaccatgaccactctggtgattttgatttcagaatcttctttcattctggtaaaccccctttgccccaccaaatattgtatggaaatacattttttttttttttttttgaaacaaagcccccctcactttgttccccaaaaggaagggcaggggcgaaattttggttcaccgcccccc

SEQ ID NO: 14934 - DNA, 365 bp, Homo sapiens
  misc_feature 365: n = A,T,C or G
tacgtctgcgaatacgacagaagggggtggagattgcagtgagccgagattgtgccacttcactccagcctaggtgacacagcaagactccatctcaaaaaaaaaaaaaaaaattttttgtttttttttttccccttttccccccccaaaatataaaggctttttaacccctgttatactgctttattatttttaatagcattattgaaatgaggtttttttttgtctcccaaactggatttttttttaccacaatttttgttccttgaaccctaattttctgggcctaaggatatcttttttctttaacctccacaatttaaagggggttcacccacccttggtaaattttgattttatttgan

SEQ ID NO: 14935 - DNA, 328 bp, Homo sapiens
tactgaagaccagcgcgttccttacagcttttcacagactctcaccacaaacccagtgaccaggccaaacatctctcttaccgattacagggtgggtgtactctgctgggataataattatgttatccttctgaacctggctaacaacaagtgttaacaatcatagggaaatgggtttaggaaagctaactgggttgaggttagagaggccataaggttgtatgaggcagcacaggatgtggccacaggtcctgagtcacagagcaagacccggcctctaaaaacaaatttttttattttggagggtggaggatagggggtgggaggg

SEQ ID NO: 14936 - DNA, 320 bp, Homo sapiens
tcagatggagatggtggttgcacaacattgtggatgtactaaatgccactaaactgttcgctttcaaatggttgattttatgttatgtaaatttcacctcacattatttttaaaaatgatggcttttaaagaatatttactgacataggaaaattcacaccacatacctattattaaaactggacttacaatataatctcaattttgaaagattaaaaatgtacatgtgagtttgtgcatatatacatacatacagatatgcgcgcgcgcacacacacacacaccatatatatatatatatactcatcctcctccccaaa

SEQ ID NO: 14937 - DNA, 343 bp, Homo sapiens
  misc_feature 343: n = A,T,C or G
taaacaattatgttcctatactttacccatttaaaaattggtttgttggtctttttcttactgacttcaggagctgcttttatttctgtcccaatttttgcaccttctaactggctggaatagtttttactgatatgactatgtactgggaaaaccctaaaagaaactaatgattaaaccaactcaaacaataaagagttcagtaattggtagatgcaaattggtagatacagtagccttcatgtccacaaataatagacagttaaaagttatgatggtagagaaagccccatttcaatagcaaaagagaagataaaaatatttagaaataagttcaagaaan

SEQ ID NO: 14938 - DNA, 337 bp, Homo sapiens
taaacaattatgttcctatactttacccatttaaaaattggtttgttggtctttttcttactgacttcaggagctgcttttatttctgtcccaatttttgcaccttctaactggctggaatagtttttactgatatgactatgtactgggaaaaccctaaaagaaactaatgattaaaccaactcaaacaataaagagttcagtaattggtagatgcaaattggtagatacagtagccttcatgtccacaaataatagacagttaaaagttatgatggtagagaaagccccatttcaatagcaaaagagaagataaaaatatttagaaataagttca

SEQ ID NO: 14939 - DNA, 331 bp, Homo sapiens
gtttcattctgcatgtctttggtcatacaatagtctattctattattctataggcatttttctaacccactccaaatccattttgcagtgaggtacggatataaatacaaaggtaaacaatgtaattgtattacttgtgtatgcatgtatgttcttgcatgtgtgtattgagaggaatgtttgtctgactacctccatgtgccagtctgatcttctggagagaaaattgctgggaggctgtgacatgaaccagtgtggaggcaaattaatgacaagactgagaactggcatgaagagaaatccatgagatggacaagccacccttttaagt

SEQ ID NO: 14940 - DNA, 328 bp, Homo sapiens
  misc_feature 328: n = A,T,C or G
ggagcgtttgaacacaccacggaaatgatgccctgccctaagcccttggtttgggaaggatgagatcctattgttttttgtgtcccctctattatcttttgaacatgggttaactacatctacggcatttataacatgtggcaagcataagctcttgagtctgatgtttctgatgccatctactcttactgcctttggcacctcccagctactgacttcctcctgcttccccctggatccagatacgtggctgggaagagcccctggcctttgtagccagaggaggtggtgaccatgggcaacaggccactgtgctcctggatgcgtn

SEQ ID NO: 14941 - DNA, 384 bp, Homo sapiens
cgttgctgtcgaaaaatgtaaaggagctcagcctttttttcatacaatatttgttcatatcattaactccctcatatttatgtacataaattattggtgttaatgatatgaacaaatattgtatgaaaaaaagcgaaaatgcaaagtgctaattcttgggcagggtgggagaaggcaaatcacccaataaaggataaccctttaacattttatctaagaaaaaagaaggaagagaaaaatatttaccatctcagattagaagacaatataaatatatacatctatgttaatacttttgaaaataccagcaaaatagaaacatatgttttcctccagaaaaatagaaaaccttggaaattagtaaccatgtttccatggttatta

SEQ ID NO: 14942 - DNA, 348 bp, Homo sapiens
tggtacgtacctgtagtcccagctactcaggaggctgaggtgggagaattgcttgagcctaagaggtcgaggctgcagtgaggtgtggtcgcagcctgggtaacagagtgagatcctgtttgaaaaaaaaagagcaaagggcaaaaaactaagagttgcatatgaaagaaataccaatgaataccacggaaaagatgttcaattccattcataagatgagatatacacatttggtttataaaaagatagtggtcttcacctaaaaaaaaatagcaaaagttaaaagtctcagtatatactatatttgttgaagctgcttcagggaaagaatccagccttgatggtaga

SEQ ID NO: 14943 - DNA, 129 bp, Homo sapiens
tacggctgccatatgacgacagaaaggaggaggaagctgtttgtattccttgggctcgggtggctcatagtggccggtttttccgcgctcttttctctgtgtaccagatcgggataggtctctcttggg

SEQ ID NO: 14944 - DNA, 427 bp, Homo sapiens
  misc_feature 25, 26, 27, 28: n = A,T,C or G
acacagctcttgtctttttgcggannnnttgttctaattcggcacgagcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggaggctgacggagcagccccccagctcacgggctcgcgcctcctgcagcgacggcagatcttcagccagaagctggtggagcacgtcaaggagcaccacaaggccttcctggcctccctgagccccgccatggtggggccggaggaccagctgacccgctggcacccgcgcttcaacgtggatgaag

SEQ ID NO: 14945 - DNA, 255 bp, Homo sapiens
tgtcaccttattcacacatccagacacgtgatgtctgctacacatacctaccattttaacattcatgcttacacacacattcacatgcatacagagagaaaggagctctctctctttcatgggtttctcattgagaatcatgatgatatcagcacaggtctttggaggaaaggaaatttacattctatatctggaacctcaagaatgttccagccgtgtgtggtggctcacaccactgggtgtggtgggaggcca

SEQ ID NO: 14946 - DNA, 350 bp, Homo sapiens
gagtttgcagagacaggaagagagcagtctgggaggagggaacagggtgagcaaaagcagactatggaaggcagaggcataagacagtgcaataagttgtacaagggaagatgaggttgacacctgaccactgaatgtcaggttgaaaaggcccaacattcacccacacccacccatttccaaaacacacatgcacgcacacacatgtgcaaagaattccagcctcatgaaagagtggagcaggttcagtctcaccatagatcaatttcatggagatgtgtccagccatgtgtacatcttctcccattgaagaggctatggaggtaagaacctatatccataagccatgg

SEQ ID NO: 14947 - DNA, 388 bp, Homo sapiens
cgttgctgtcgctgaggtgcacagagcccaaaggcagagagaggggctgaaggatagacaggtgtgtagcatgggctaggtttacggtgagtgcttactaaatgctgtggaatgattgcatgagttccagaaggacccagactggtgagacagagaatgcagaattggctacactgggaaggagactccacctgacacagcaggagaaggataagcagatgtatagtgcttgggcagggccaggcaaaggggagatttgctcagaaaatgttgaatgaatgaatgcacaaatgcatgggaaggcaaaggtaagcatgagagagccacagagatgaaacaaacaaacaaaaaagacagaaatagggaattaaatagggccaggcacggt

SEQ ID NO: 14948 - DNA, 368 bp, Homo sapiens
ggctgtacaaagagacagaggctgttagctatggctgaagacagtggcaaaaaaaaaaagggggaaaaatttttaaagttttgtccaagggttcccttaaaaggggttgggaaacctcgggaataacccccttgttaaaaaccacgggggttggacaaacttttttccaacccttagtccttattccggttaaaaggccacccggggtaaaaaaagccacccccaaaaaaaaaccggtaaaatggtggaaaccccgggcaaaaaaggtttttcagggggttttaattttttggcaaaaacacaatttttgccctttgagggagaggaaaaaaaaaaattttttttggtccccattgtggaaacggggc

SEQ ID NO: 14949 - DNA, 429 bp, Homo sapiens
  misc_feature 16, 17, 18, 25: n = A,T,C or G
gagagcattaacccannngttttgnagaggaacccatcgattcgaattccgttgctgtcgccaatgtgcccttcctggtggccctggcgctcctgagctccgtcctggggggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccaccgctgcccgccggccccctgaggtagtgcaggcccacgggcaccccagacactggaactccctgcctctgagccaccaact

SEQ ID NO: 14950 - DNA, 411 bp, Homo sapiens
ctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgccc

SEQ ID NO: 14951 - DNA, 405 bp, Homo sapiens
ggcacgaggaccgaccaggaggtcctctgttgagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccggcgccaagctccgcaagagctgcagggg

SEQ ID NO: 14952 - DNA, 383 bp, Homo sapiens
cgttgctgtcggtttgaacccggtgaggcccatgtgggcaggccgtgggtaggcagggggcaccgcggggcctggcatatcccagcagcctggctctgtctcgagcaggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttc

SEQ ID NO: 14953 - DNA, 419 bp, Homo sapiens
  misc_feature 419: n = A,T,C or G
cgttgctgtcggcgtagatgtttccacccactattctaacagctctatctatgaatatattgtacggcggggggccctggatttctctttctttgatttgatccgctactgtgtcagcgtttgcaatcagattgcatctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgctggataacttttattctttattattggtaacacgccctaactatcctgtgtgagaatgggaatttcaagtcccatcttgcaaattggatatgttgtcatgcacggtttgagcn

SEQ ID NO: 14954 - DNA, 324 bp, Homo sapiens
tgggattagaggcgtgtgccaccatgcctggctaatttttgcatttttagtagagacaggatttcatcatgtttgctaggctggtctcaaactcctgccctcaggtgatccatctaccatggcctcccagagtgttgggattacaggtgtgagacaccgcacctggataacagtctgttgttgatcaccagtttttatataatttttcttttgaacacaagtatattataaaaatacttgaaaggagtattcaaaaattgattttgaataccgggttaaagattcaggtatggtcgttttcctacttcgaaatgcagaggaggg

SEQ ID NO: 14955 - DNA, 322 bp, Homo sapiens
attgtttttcttccagtttttctttttccaaaaaagggattcaagctggcctgcaaactcaaatggcttgtacatagttgagattaaggcaaatacacaagattgtatcctgtttttttcagctacattatacacaagtatcttcccttgtgataatgtagtttttataaatataagtttttaataactaatatttcattatgtgatacatcatgatttattattttaaaccatttctggattgtcttggtttcaacttgggaagggtctacaaaattctttaacaaagatctggatgcggcagactcagtggcttacgcct

SEQ ID NO: 14956 - DNA, 319 bp, Homo sapiens
tccctacataattgtgacttagaattatttagaagagaaatattatttatgagaagaaaaaataattaaagtcataatctttaaagcttaaattttaaaaagacaaagtttaacagcaaccattgagggtgaattatttattgttttgctctcttaacatacctttggggaatacaaattaaaataacaagaactatttaatttattgcttatctgactggcaaggataaaaatgaatgttaacatttatcagcaagcatgtgagaaagtaggctttctcatgcactacttatgtgaattaaaattggtaaaagttttc

SEQ ID NO: 14957 - DNA, 422 bp, Homo sapiens
  misc_feature 422: n = A,T,C or G
ggcacgaggtgaacacggccaaaggattgagtggcgaaaatggaagcaacagaagaaagaggagaaaaaaaaatggaaggatctcaagctgatgaaaaaactggagcggcagcgggcacaggaggaacaggcaaagcgcctggaagaggaggaggcagcggcagagaaggaggaccgcgggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagactgtggagggggaattcagaggagttgggaagaaggggcaggcgtgcgtacagctggcccggatcctgcagtacctggagn

SEQ ID NO: 14958 - DNA, 373 bp, Homo sapiens
cgttgctgtcgggctggtcttgaactcctgacctcaggtgatctgcccgcctcagcctcccacagtgctgggattacaggtatgagccaccacgcccggcccatttttttttttgacaacttttttttttggaaacggggttttgtcccttggccaaaatgggagggcgggggttggataaaagttaattgggcccggaaatcttttggcctaaccctccaaagtggtggaaactacgggtggccccattagccccggctagtttttcaatttttggaaaaaagacgggttttttttttttgaaaaggggttttttttttgccccaaaagtgggggggaaagccggggctaaccctattggaagcccccgccg

SEQ ID NO: 14959 - DNA, 343 bp, Homo sapiens
cattggtaggaggttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggattagctgattttaaaacaactcggctgggcacagtggctcacacctg

SEQ ID NO: 14960 - DNA, 406 bp, Homo sapiens
ggcacgaggagagtatggaacccttccccttcgctctcagccggaggccagctgcgtccagccgggctcggtcttctgaacaccgatttcaaatcaggtccccggggcccagcgtcacttagggaagtggtggcattttgtggttgctgctaaatcacggagagcagccttggcgctgccggtcccaacttgatccaaggagccttgagaaggagatgagattcagtaccaggggccggccgtggctcccatcctccggaatctgcaaaatggctacttcttcagaaataatggggagagggatggcaagaggccagagatcaaggccctcgagtattaacttgagcatttgggcacaaaatagacacttttggattttcccgtcttttccaacaccaaggatgag

SEQ ID NO: 14961 - DNA, 363 bp, Homo sapiens
  misc_feature 363: n = A,T,C or G
cagaagtttaattttttataatgatggatgaagacagtaatatctaccttgagtggcttgtcataagtattaaataataaaaactagcattaaaaatatctagcatacctagatatatgttatatgttatagttatatgtttaaaaatttgtgtttatttcatgccttatttatctttaagaaactttatagcctgatcggtgctgattctttttccaaaaagtcacgtaaaattttatcaggacaatgttttctgtaacaaccattatttcttgtctttctgccataagtggagaaaaaagatgtgaaggatcttgagttttcatactttctaaatgggctaagagtacagatgtcagaagn

SEQ ID NO: 14962 - DNA, 408 bp, Homo sapiens
cgttgctgtcggttcgctgggaggtatggatttcatttccattactaatgcctgcaattgctgataatagacgtgccccaggaatcgctgcatgggaaatggagcaagggtctccttctgtggcccagtctggaatgttagtggtgcaatctcgactcactgcaacctccgcctcccggattcaagagattctcctgcctcagcctcccaagtaactgggattacacgtacgcaccaccatgcccggcaaatttttgtatttttagtagagatagggtttcaacatattggccaggctggtctcaaactcgtgacctcaagtcatctgcccgcctcagcctcccaaaatgctgggattataggcgtgaaccatcacaccgggccattccaatcactcttcatttcctg

SEQ ID NO: 14963 - DNA, 443 bp, Homo sapiens
  misc_feature 11, 12, 26, 27: n = A,T,C or G
tagacaattcnnttttgtgaaaatannacggccctcgaattcggcacgagggcacttctgccgctgcgcctgtttctgcaccgataacttgtacgtggcgcgctatgtgctgcacgtgcgcttccgaggcgagcaccagctgcgccgggactacggcccgatcctgcgcagccgaggctgtgttagcgccaaggacttccagcagctgttagcagagcttgagcaggaggtggagcggcggcagcggctggggcaggagtcatcagctaggaaagccctcatcgcgagttcctaccacccggcacggcctgaggtctacgactcactgcaggatgcagctctggcccccgagttcctggccgtgactgagtacagcgtgtccccagacgcagacctcaagggccttctccagcggctggagacagtatcggaggaaaagcgcc

SEQ ID NO: 14964 - DNA, 374 bp, Homo sapiens
ctatgttggaattatttggtaaactatctgaggctcatataatttagtatctttcattataagattattcttatatccatttctataagtttatattctaatttatgttatattccaggtagatgctgttttttttaaatgaatttgctctttgcatttaaatatttaaatatatcgggaaatagttgtgatcggatcccttatcttcatttttacaacctcatctttatcctacatggcggaccagcccttcttacaaggaagtcggttttttggcgtttaaagtcacaaagatctactgcgcaatcagcgcgggtcgaatacgccctcactttctacatttttcaatacaacaactccgtcggggtcatttg

SEQ ID NO: 14965 - DNA, 389 bp, Homo sapiens
cctgtctctgctaaaaatacaaaaattagctgggcatggtggcatgcatctgtagtcccagctactcaggaggctgaagcaggacaatcacttgaacccaggaggtggaggttggagtgagccgagattgcacaccactatactccagcctggcgacagagcgagactccgtctcaaaaaaaaaatcactctgtcaacagcaacaatacactttcttctcaatgttcattacaagctttgtgctgggccacaaaacaagtctcagtaaatgagatagaattaaaatcacgcagagggtattctctgtccgcagtggaaattaggactcggtaagatatctggagaaaatgctggccaggcacggtggctcacgcctgtaatcccagcag

SEQ ID NO: 14966 - DNA, 386 bp, Homo sapiens
tacggttgcgagatgacgacagacgggactgtgcacatggacacaagtgatcctcagtccttactccaaacccacatctttgagagacaggccacgctggagtgctgtggctcgatcacggctcactgcagcttcaaactccgcctcggcctccataattgctgggattacaggagcgtgccagtgtgtctggccttaacttgcatttttacataagacttctaaaaaaaaaggagaaaatcttcacaatcctgggatagacatggaattcttaggacatggaaagtaatagaatttcaaaattctgcttcctgaaagacactgttaagaaagtgaggaggcaaggcacagactaagaaaatattcacatcacacacatatttatt

SEQ ID NO: 14967 - DNA, 359 bp, Homo sapiens
  misc_feature 281: n = A,T,C or G
ccaccacgcccgctaattatgtatttgtagcacagacctaggtctgtcaagttgggcgaaatagaaccctcctttccttgttcccactcttgattcttttgaacatgggttacctcccttcgcgtcttttggaacagaaggggatcataagctcttgagtctctgttttctgctgtcatctactcttcctgcctctggcacctcccagctcctgacttcctcctgcttccccctggagccagagacgtggctgggaagagcccctggcctttgaagccagnggtggtggtgaccaggggcaacaagccactgtgctcctggatgcgtgggctggcaaatctctctcccattcgcctttg

SEQ ID NO: 14968 - DNA, 399 bp, Homo sapiens
cgttgctgtcgaaagcgttagtgaaatatgaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaa

SEQ ID NO: 14969 - DNA, 388 bp, Homo sapiens
cgttgctgtcgctgcctccctctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccgagacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcag

SEQ ID NO: 14970 - DNA, 406 bp, Homo sapiens
  misc_feature 406: n = A,T,C or G
cccatcgattcgaattccgttgctgtcggaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtn

SEQ ID NO: 14971 - DNA, 347 bp, Homo sapiens
tatattaaccgactaaaagaggaaaataacaccatgggcattcctcccttttgcctggaaccatgttgactaaaatgtgtgcctattataagccaattgtgtcctcacttggcgtggtttcaaggtaacaaagatttgatcttatttaatctcttctcacatgtggtagacagaattcctaggtgacccacatggcttttgttccctggtgttactcgcatggtcatgttatgttgcaggacaaatgatattatgcagatgtaattaaaatgacttactaatcagttgaccttaggagagattatctagatggatctaacgttatctcacgagtactttaaaaacag

SEQ ID NO: 14972 - DNA, 327 bp, Homo sapiens
cgacagaaggagggttggtacccacctttgactgatggggaaagtgacgtttgaagcggtttatgcaaggtcctatagctcaggattcaaacccaggctctcttgctttaaagcccacctgggcttttaatactacaccaaagcctcctgttatctcgtttgtccttgaaccccccacagagaagctggaaaaataaaaaaaacaaggacgacacacaagcagaaagtgatgacctgctgtttgtagttgatcaaatgccatcgatgctgcttatgtgacgtggtgtccatgcaccatccatttttatttttcaggtcttagttacg

SEQ ID NO: 14973 - DNA, 329 bp, Homo sapiens
attgcactgattcatgtgaatggttcccctagtcatgcaccatgcggcctctgagaaaagcacaatattgaactctatcctagcctcccagagatttttaacctctacttcttccaagaatttttgttcctggacttagaagtcagggcagaggcaagccaggaaaggcagcaaaccagtttaacttcctcctctctctcgttgccttatatcttcttttgcccctttgctctctgccccaatcctcacaatagttaacagctactttacccaaatatcaaactagccagagaagctactgaacatgatcatttaaaaaaaaaaaaaaa

SEQ ID NO: 14974 - DNA, 330 bp, Homo sapiens
caacctgtagtatgggaaaaatatttgcaaaccatacgtatgataaagggttaatatccaaaatatgtcaggaactcacagagctcaatgacaaaaaaaaaaaaaaaaaaagggaaaacccttttttaaaaagggacaaagggtttgaaaaaatttttttccaaaaaaaaacaaaaaagggttaaggggcttttggaaagggtttccccctttataatttttaaaaaaatccaaattaaaaaaaaaacgggggccccccctccttcaattaaaaggggtttttgcccttaaaaaccccaaaaacaaccgggggggggggtttggaaaaag

SEQ ID NO: 14975 - DNA, 351 bp, Homo sapiens
ttatggcttgaagtttcatttgcctttttcttctctattatctaccacaaatctttaataatttggttgtaatctggatattagctttctttagaaaatattttatattccttaaatcttttttaacatgataaataataaacataaataggaataaagaggaatgaatttagttcctggctggagatgactaaataaattacaagtgataatattctttaagttattagtataatttaacaaactaaagacactcaaatgatgtttcaaaggttgttgaaaaaaactgataaatttacctagaaaaaaagttttgagataaagttaatggcgttgaagatgacctactgg

SEQ ID NO: 14976 - DNA, 346 bp, Homo sapiens
ttatggcttgaagggtcatttgcctttttcttctctattatctaccacaaatctttaataatttggttgtaatctggatattagctttctttagaaaatattttatattccttaaatcttttttaacatgataaataataaacataaataggaataaagaggaatgaatttagttcctggctggagatgactaaataaattacaagtgataatattctttaagttattagtataatttaacaaactaaagacactcaaatgatgtttcaaaggttggtgaaaaaaactgattaacttacctagaaaaaacgatatgagataacaggagtggcggttgtcatcacct

SEQ ID NO: 14977 - DNA, 296 bp, Homo sapiens
aagctattaggaatcagttaaatgttttgggattttgtctgagaatgggctaaaggagaatgtcccttttgccttctgaagtttccctgaaaatcactaataggaggcagataaatagtagaaaaggcataaaggtttctgcaatgtgtgtacactggagcccttagaacgaagacccagacacacgatgcgtgcagaagcttatctaccacatgaagtttacagaaagaatggggtcttggatcacaggaaaaaaaaaaaggttatgtgagaaaacgaccctggctagcaacagg

SEQ ID NO: 14978 - DNA, 351 bp, Homo sapiens
aaacagcaaatatataaaacatacaatataaacaacattgatgatatatgtatattatctacatataacccacaaaatagaaaaagaaaatttcagtacacaggaacaatattgttcacaaagtagttttcaataaactttaaagaaattatattatacaaaacacgttctttgataacaattataaattatgaataaaaatatagtaaaatatatattagaaactaaaactcctaaataatccttgaatcaaagaggaaatagaaatggaaattacaaaatttttagaatgaaatttttatgtactatataaaaaatgtgtgtaataaagccaatgtacattcatagacc

SEQ ID NO: 14979 - DNA, 353 bp, Homo sapiens
  misc_feature 263: n = A,T,C or G
ggctgcatgagctgttggcattcctaacccctgtgctgttcaaggttcaactgtactggattttcttgaaaattcagaagtgctggaaaccctgggcccggatttctatgtgacagcaattttggggctgagtggcttcatttagatggggcatgtgctccccatattctgctctccccttaacactgaggttgatgatagtgacctcaacatcaatgaggtagtgctgtttccatgtcatagaattaagaggaggttgaagnatttccccttctcactttcagcataactggaacaatggaacatccccttagggcaccatattttaagcaagaaaggaagagggcatcttt

SEQ ID NO: 14980 - DNA, 354 bp, Homo sapiens
  misc_feature 354: n = A,T,C or G
aggttttccataaacctagaaatatgactgaagaaaaatattccaaataacgattagggttggcattttagcttagtgagatcataagcatatttatttatacttagacataaagccagcaaataagatggggaaaggaaagaaggaataaaggaggacagagaacaatgaaggatgagtcagctagttttttaaaaagaaaagaacagaatgacgaagaaaaaggagcagaaagaaagacaaccaaatggggagaaagggaaacaaagctactagaaactatgaatgtatcacttgcctaccatgaacctataattgtgcttaatttggagacaaatccaagaaagggtacan

SEQ ID NO: 14981 - DNA, 337 bp, Homo sapiens
gagcaggggttaggcctggtgatgcccttctagtgaataaaatatggccacagtgatgggatgtcacttctgaggctggggcacatgaaacaccccacttccctcttgctgatgctctctcatgctctcacttactgtaagagaagccagctgccccatggagagacattcatggcaaagaactggagctggcctctggccaacagcccaagaggatggaatcctgccaacagccctgtgagtgagcttggaggtggatcattcccatgccgacctttatgtgactgcagctctggctcacaccttgactgcagccttggtaggaaaccctgatcct

SEQ ID NO: 14982 - DNA, 350 bp, Homo sapiens
agccagcacgggcagaagcttgaaagcccccaagtcacccctgggccagcagcagccacccagggcaggagggcaggtgcacagccagggtcagcgggtcagcaactcaccctggcctgcagcctacccagcacggaccatgtgcccagtagcagagctagaggaacaagcagaaaaatggccggcccccaaccagaggtcagagggaagggcaggagccgctgctgacctcgggggacacgggtggctgacctcgggggacgcgggcacacgctgtggggcttcgtgtcaggcacccatggggcctggggtctgctctgtgcaacagatactgtcgggctgcccatggg

SEQ ID NO: 14983 - DNA, 325 bp, Homo sapiens
gaccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaa

SEQ ID NO: 14984 - DNA, 384 bp, Homo sapiens
  misc_feature 377: n = A,T,C or G
cgttgctgtcggaaggccgtggtgcagcgcgtcacccgggccagcgtcacagttggaggagagcagattagtgccattggaaggggcatatgtgtgttgctgggtatttccctggaggatacgcacaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcanagatggg

SEQ ID NO: 14985 - DNA, 123 bp, Homo sapiens
gtggatcaaagatttaaatataaaatgacaaaacttctaggagaaaacatacaagaaaatcccgatggcactggcagatatctcttagatgacagcaaaagcacaatttattaaagaacaaat

SEQ ID NO: 14986 - DNA, 349 bp, Homo sapiens
cagtatcgatcccattaaccaaatctagcgaacattattgagcaatgactatgtaccaggctctgtgttaggtgctgccacatatctgatgagtactactattactactattcatactaccattacgaagaataacatctaacattttattaaatcctcactggtagtgacagaaaccaggctaagtgctttacatacaatgtaagttttcacgaccacaaacctattaacatggcttatgggtgaggcctacctaatatgatatcgaaacgaaacagatcaacaaacaaagcatctagaattgtccactgttgccttattcaccatgagggcatcttagagctagaag

SEQ ID NO: 14987 - DNA, 340 bp, Homo sapiens
  misc_feature 340: n = A,T,C or G
gatgcgtgtgagctgacgccattttttttaggactgggtcacactctggcacgcaaactatgaggcggtgtcactatcatggttcactgcatcctcattataccatgagcatgcagccctcccccttatctggcgccacaggcgcatactaccatgctcagctaagtttctaaaagctattgtgtaaaaacaggatgtccctatgttgcccaggctggtctcagactcctgggttcaagtgatcagcctcccaaagagatgggattattgttgtgagccactatgcccaggtaattgcatctgctttagagagaagaggacaaacagatagatacactan

SEQ ID NO: 14988 - DNA, 325 bp, Homo sapiens
tcactcctgcccctctcctccaggcaatcaaactttggtttctgtcactatagattcgtctgcattttggggatatgtagatatattctgaaatactgtatattctgaaaatacactatatgattctgaagtcatacagtatattctttttttggtctggcatcttttactcagcataattattttagattcatccaggttgtaccttattgatagttcattcattttattgctgagtagtagtccattgtacagatacactacaatctgttcatccattcatctgttggttaacatttaggttggtgtatatattttggctatg

SEQ ID NO: 14989 - DNA, 355 bp, Homo sapiens
caacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtacacctagaagagagttttaaaaaaccaaacaatgtaagtaaaggatatttttgaatcttaagattcattccatgtggg

SEQ ID NO: 14990 - DNA, 331 bp, Homo sapiens
  misc_feature 75: n = A,T,C or G
aatcccaactacttgggaggctgaggcataagaatcgcttgatcccgggaagtggaggttgcagtcatcccaacncataccatttccctctaaatcttacatacttcatagaccttccctaaatctctcactacattctctttatttaccccaatactcatatctcttgaccgactgtaatctttatttcccctttttcactaatgccttaacccactccccttacctctatctacaccttgccccctcaaaacaaaacaaaaccctatttatgtgtggaaatttattctaatacttgggacctggttttaaacccaatttgttcttcctg

SEQ ID NO: 14991 - DNA, 233 bp, Homo sapiens
  misc_feature 233: n = A,T,C or G
tgaataacagaacttacttcatagggttgttataagaattgaatgaaaagtgcacagcatgacaaatagtaaacactcagtaaatgttagctattactattactagtctgacttaaactgttatcatcacatttgatgtgataaagaacacaaggttttctaaatagactcccatgggagctgggaggggagggtagtagatgagaatctgcttatttgttggaattttctcn

SEQ ID NO: 14992 - DNA, 204 bp, Homo sapiens
tgaataacagaacttacttcatagggttgttataagaattgaatgaaaagtgcacagcatgacaaatagtaaacactcagtaaatgttagctattactattactagtctgacttaaactgttatcatcacatttgatgtgataaagaacacaaggttttctaaatagactcccatgggagctgggaggggagggttgtacatgg

SEQ ID NO: 14993 - DNA, 338 bp, Homo sapiens
gagatctcagctctctgcagcctccacctcccaggtgcaagtgattctactgcctcagcctttggagtcactaggattacaggcgcccgccaccacacctggctaatttttgtatttttagtagagaagagcagggatcatgatgggctagatatgctggacttacgagcctgctgtctaaggctttcttaatgctaccattacaggggtgagccactgtatatggacggttgattgcggagtaaaataacgtatgcttgataagaataagatatacaacggagataacacctacttgatccgttcttgcccacctctaaggagctatattgaaccac

SEQ ID NO: 14994 - DNA, 326 bp, Homo sapiens
cggggacgtgtggggacttacgactgttagaccgccccgaaaaaagggctttacttgcgaattatgagatgctattacttaaaccgtccccaccatcatctgcaataaatgtctttactacaactacagcattcattctatcgttcaggctcacatctatagatgcgcaatgctctgaaggctgaggcaggagaattgcttgagcccaggaggcagaggttgcagtgtgccgagatcattccattgcgctccagtctggcgacagaacaagactctgtctcttaaaaagaaaaagaaagcaaaagttggggggcttattttataag

SEQ ID NO: 14995 - DNA, 300 bp, Homo sapiens
gttctgtcatcagtacttattaaggtgtcttgatgtagtaagcaagatagtttttacagtcctaggcttattacaagtttagtaaccccagtggactgagaaaatctttctcaatagctctggcaaaaaattcctctgggaaaatatgactgatgggagtttggatcatttgcccattcttgaaccaatcattgtatagttagccctctgtatataagggttccgcatctgtgtattccaccaatcgcggttgaacaaaattttggaaaacgctgggcgtggtggagcatccccccttct

SEQ ID NO: 14996 - DNA, 303 bp, Homo sapiens
  misc_feature 205: n = A,T,C or G
ttcgcattttcctgttaactaataatgctgagcatctttgcatgtggctattggctatttgtatatattctttggttaaagtctgtttaattcatttgcttctctcactttataaaattgggctatttatcttctaattattgaatcataagatttctttatatatgatgctctataaaagtatcttgtcacatatatatatcgntatttttctcctagtttgtgacctgcctttttatattattaatagtatcctttggggagcaaacattttaaattttgatagtctaatttatcattttt

SEQ ID NO: 14997 - DNA, 338 bp, Homo sapiens
atatagaatttcaatacatttactcaaaatgtggagtaagatagagttcaagatcttagattctagaaactatatagcaggaatatgaccataggctacttcctaacagctgtgtgatttgggtataataacttaatctctttaagcctcatttctccttctgaaaaactgaagaaataacacctactcgtctgagttcttaaaaggattaaatagcgtcgtgtgtcattttggattccaccagcagcacagtcagggacaagtatcctaacacaagaaatttgtcatggtggtaattccaggaaagtctggtggagacaggggaagtgagactgaga

SEQ ID NO: 14998 - DNA, 353 bp, Homo sapiens
cacaaaaaacaaattgtgaattaaaacaaattatataagtaaatgcatatttagcataagaaaagaaatcccctcaaaataccaaattttatctaatacatactacaatacataaaaataattttttttatttattaacttcatagcatacctttctaataccacattttctttcttttttttttttttttggaaacaaagttttctaaattttttggccaaggctgcaaaacaggggggggatttaagttaattgaaacctttcctttcagggtaaaaggaattttctggcctaagcctccaaaaaagttaaaataaggggggggcacaacattgccgggttatatttgtgt

SEQ ID NO: 14999 - DNA, 409 bp, Homo sapiens
cgttgctgtcgctgaggtttccttaatgttctttttgaatctttgagatacaggatctattacttgcatctgagagaattttgatcatgagtcttgtggagatctttttcatattactctctgaatgtattgggataaggtgtaagggcgctgtcttctactttaatctgataatatggggaattgtgttaatagatgttccaatgtttcctatgccttacatccctaggataaatccaactgtgccattttgttaaccttacaactgttagttaaacccctgtctgacaattaatatcacttatgtggtcatttttgctttttaaaacactttatttatttattgagacagggccttgctctgtcagctaggctggagcgaagtgggacttctctccccttaactgga

SEQ ID NO: 15000 - DNA, 292 bp, Homo sapiens
atttattatattttaacttgtgaaaggggttaaagtgatattgtcaaatttcatattattccatttttaaattttattaataaactttgatatgacttcacatttttataatacatttaacaaacagggtgaaaaaagagatagtatcttgatagtgctttattatttttctttaatcatatagactatattttcaaactttgtattttaatatttactatttaataaatgctatagttttcaaacatcttcttccattctattttttttaaactaacatttcttatttgcc

SEQ ID NO: 15001 - DNA, 339 bp, Homo sapiens
  misc_feature 57: n = A,T,C or G
gatggagaaatagagctcacctcttctgggtagagtagtggcaaagtcacattgtanaaaagcctgggaggtggaaaatttttttcatgattgtctttgtaaagtacaatctactacctacactttaacccaccaattcatcttttagaaatttatcctgtaagtggacttacaaatgtgaacaaaaataaatgaacaagggtatttgttactaaaatagtaatagcaaaagactggattaatctaaatgtccaataatagggttatttaacccaatttatttgtgcccatgcaatgcatagctatgtgcctggctttttttttttttttttggaaagg

SEQ ID NO: 15002 - DNA, 341 bp, Homo sapiens
agaggaagaagagaaagtggccacagggacagggcagcaagggtcaagcctgcagggggagagatggatgggtgagggctgtgagaaactcggggatacccatgcccagtgggaccaagggatggggctggagtgcagccacatgttccacctcccccaagtgccaggctgcattggactttgtcctggagccgtgcagagccatgggaggtttttgagcaggggctcggaggcctcagctcatggtttccatctggttccaggctgatggggaggcaccatcacagcccaggtcaggaaggtgagacactcataccaaacacttagaaaacagggccaga

SEQ ID NO: 15003 - DNA, 311 bp, Homo sapiens
atctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgctaactttattttaagtaccaccatttgaaccttaacgaagaaaaaaatcttcaagtagacctagaagagagtttt

SEQ ID NO: 15004 - DNA, 343 bp, Homo sapiens
acaaagaaaatgaaaagcaaaattgccctgtaaacaattacattaaatgcaaatgtcttaaaatacagctattggcataacaaattattaaacataaccaagtatatgctgtctacagtaaactcacttcaatataaagcagtttgaaagtaaagggatggaaaaagatacattatgcagatattaattgaaaggaggaatggctatgttaacattagataaagtatatttcaaagcaaagaaaatattttataatgataaaagaatcaggccgagtgcagtggctcatgcctgtaatcccagcacttatggaggccgaggcaggtggataacctgagatcag

SEQ ID NO: 15005 - DNA, 346 bp, Homo sapiens
  misc_feature 330: n = A,T,C or G
agaggatgaagagaaagtggtcacagggacagggcagcaagggtcaagcctgcagggggagagatggatgggtgagggctgttagaaactaggggatacccatgcccagtgggaccaagggatggggctggagtgcacccacatgttccaactcccccaagtgccaggctgcattggactttgtcctggagccgtgcagagccatgggaggattttgagcaggggctcggaggcctcagctcatggtttccatctggttccaggctgatggggaggcaccatcacagcccaggtcaggaaggtgagacactcataccaaacacttagaanacagggccagaggccg

SEQ ID NO: 15006 - DNA, 390 bp, Homo sapiens
tctatccagttatccatccatccatctctccctccctccttccctccctccatctctcccttcatccatccatagctctatcctatcacccatccatctatccctttatccaatcatccagccatccatccctctatccaatcatctatccatccatccttctatccaatcatccatccatctatcccctattcaccctccctccatgcaatcaaccatctatccattcccatttatctaacaaatcatccatccacccacacacccaccatccacccattcatccaccaatccatccacccatgcaccatcacttaacagagcgccaagcactgtgccacatggggatacagatcttgctaaactgttaagcttcatgaaggcaacggc

SEQ ID NO: 15007 - DNA, 420 bp, Homo sapiens
cgttgctgtcgggggaatatgtcctgtttctgtttcaagagctaccaggagccatgaggcagctgccctacttcatccggccagctgtccccaagagagatgtggagcgttattcacacaaatatcagatgtcaggtccgattgacaatgccatcgattggaaccctgattggcggcgtctaccccggtagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaacaacacaacgaagaggaggaagaagaagagtttgatgaagaagaacctgaagaggaaactg

SEQ ID NO: 15008 - DNA, 397 bp, Homo sapiens
ggcacgaggaggacgaggacgtcaaggataactgggatgacgatgatgatgaaaaaaaaagaggaagcagaagtaaaaccagaggtaaaaatttcagaacagaaaaaaatagccgagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagg

SEQ ID NO: 15009 - DNA, 429 bp, Homo sapiens
  misc_feature 357, 429: n = A,T,C or G
ggcacgagccatcttcaagagatgactttacagagtttggaaagctactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggggggtatgatggaggatatgtacaagactatgaagacttcatgtgacattttatcttttcttggngtcatctttatggtgcccacaatcccttgaacatgtagcacaacttccttttctttcagttctgccaaatgn

SEQ ID NO: 15010 - DNA, 372 bp, Homo sapiens
  misc_feature 372: n = A,T,C or G
tatacgacagaaggggtaatcccaaaaacttgggaggctgagataggagtatcacttgagcacagttccagaccactctggacaacagagcaagacccccagaaaatgaaaattaaaaaatggcaaagtcagaatacatgttgaatttaaaagactacgttttggaggtgtagctgatcccaagctgttatgagcaaccccctaaggactgcagatggcctggatccaggttctgagttagagcagcagacagtctagagctatagccacacagagggctggggattgcgcagcagggtctagacacgaccctgccacagtaggtcgtctccctctgttggcacaaacagacatgacattgttggcagagtn

SEQ ID NO: 15011 - DNA, 341 bp, Homo sapiens
aattagaataattgggaaatgattggaaaatagaaatcttaagctagaaaacatgtaactaataaaagtagtttcattaaaacaaaataaataaaagaataactaggaatatcctaatcaagtaagtaatggagagtatacaaaataattagtaaaaggagggatatatccaagatagtaaaaactttaaatattttgaaaaattttatgctacatatttgatatttttaagaaaacataatttaccaaaactgaccccagaataaatataaagtttcattctgttaacacaataaagaaaatgtacaaaaggctatctttcagaaatgtaccaagtccag

SEQ ID NO: 15012 - DNA, 394 bp, Homo sapiens
  misc_feature 394: n = A,T,C or G
cctgaatggagtgaacaagagggccatgcagatatcttggaggaaagacattcccgggcaaggaaacagcaagtgcaaaggccacaaggtgggattgagtgtggtgtgtttgaaagctgaactgtcaccagtgcaggagcagagtgggcaaggcagagcaggggagtgatccaggcaaaggtacatttcaggaaaaattgacagtaaggagttcggattttatgctacatgtgttggaaaaaccaatgaagggttttcagctaggtaacatgatccgatttactccctttaaagattggccgggcacagtggcacatacctgtaatcccagcactttgggaggccaaggcaagaggattgtttgagctcaggagttcaagatcagcctgaccan

SEQ ID NO: 15013 - DNA, 385 bp, Homo sapiens
cctgaatggagtgaacaagagggccatgcacatatcttggaggaaagacattcccgggcaaggaaacagcaagtgcaaaggccacaaggtgggattgagtgtggtgtgtttgaaagctgaactgtcaccagtgcaggagcagagtgggcaaggcagagcaggggagtgatccaggcaaaggtacatttcaggaaaaattgacagtaaggagttcggattttatgctacatgtgttggaaaaaccaatgaagggttttcagctaggtaacatgatccgatttactccctttatagattggccgggcacagtggcacatacctgtaatcccagcactttgggaggccaaggcaagaggattgtttgagctcacgagttcaagatcaa

SEQ ID NO: 15014 - DNA, 420 bp, Homo sapiens
ggcacgagattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggaggaaaatacaatggaaatggttcaaaaatttggg

SEQ ID NO: 15015 - DNA, 389 bp, Homo sapiens
acgctgatgccgcatctgtatacacccgtggaactagcatcaagattaagataatgaacatgttcatcaccctcaaaagttccccgatgcccctttgaaatcaccctttccatcctttccccaccctcctgcccggcaaccactgatctgctttccgtcactatagatgaattagcttagattttctagagtgatgcttatgtggaattgtacagcatatattctcatattatctcgcttctttcactcagcataatcctgtcaacattattccatttgtgccatgtagcatcacttgatcgtattgttgagtaggattccattttatggctagatcacaatttgtttctccatttgtctattgatgggcatctgggtcatttttcact

SEQ ID NO: 15016 - DNA, 176 bp, Homo sapiens
  misc_feature 76: n = A,T,C or G
tgggtgaataacagaacttacttcatagggttggtataagaattgaatgaaaagtgcacagcatgacaaatagtanacactcagtaaatggtagctattactattactagtctgacttaaactggtatcatcacatttgatgtgataaagaaacacagggttttcaaaatagaatg

SEQ ID NO: 15017 - DNA, 359 bp, Homo sapiens
gagtctcactctgttgcccaggctggagtgcaatggtgtgatctctgctcactgcaacctccgcagcctgggttcacgccattctcctgcctcagcctaccaagtagttgggagaataggcgacttccaccactctcgcatttgtgataggactttttaaaggactcggagtccaaatactaaaaacaggatggccggaatctccagacctgatgatcttgctgcctttatatttaaagtgccaggactatacgccgaataatgggtggcccccttgaagacgcaaccctgtcctttgcttatgaattgggtgttgtaccgattctcctgatatccctataggcaattgtcggaaatag

SEQ ID NO: 15018 - DNA, 328 bp, Homo sapiens
cagggtgaatctgccttaggttccctgccttcagacagtattctcctgcggcaacactttgctgacaactattcttgaaaatacggggattggtattttcatggtggttttcatggggctgagaacttagaagataatgactgcttccttcatctggggatgggatttaaatgtaatggagcactcactgttttcttgagaaggtgggagatactagcttccttataaagataaaggggtgcgagaggcaggattttaggaactcaaatctatgtgggaaccggcgagcatgaattcttttttctttcccaatcccaatcttttattg

SEQ ID NO: 15019 - DNA, 347 bp, Homo sapiens
tatatgaaccgactaaaagaggaaaataacaccatgggcattcctcccttttgcctggaaccatgttgactaaaatgtgtgcctattataagccaattgtgtcctcacttggcgtggtttcaaggtaacaaagatttgatcttatttaatctcttctcacatgtggtagacagaattcctaggtgacccacatggcttttgttccctggtgttactcgcatggtcatgttatgttgcaggacaaatgatattatgcagatgtaattaaaatgacttactaatcaggtgaccttaagagagattatctagatggatctaacgttatctcacgagtactttaaaaacag

SEQ ID NO: 15020 - DNA, 297 bp, Homo sapiens
  misc_feature 297: n = A,T,C or G
tgcatacatgttttaaaacatcatactgtatcccataagtttgtacaattactatatgtcaattaaagataaaatacaactttaaaaaattgtccaaaatgaaacatacagaaaatactttaagaaaaagcaaaagagcatcaatgagtcagtgagttatggaacaacttcaagacacctaatatacacgtaatttaagtccctgaagaaaaggggtgtataaaaatatttgaaaaaataatggatgaaattttaaatatttggtaaaaaccataaaactgtagatctaagaagctn

SEQ ID NO: 15021 - DNA, 328 bp, Homo sapiens
aaatctttacctagctttgttttctaagccttcatcagaatctaggctttttctagtctgctcctccaaattattctacctgctgccccattatacccagtttcaaagctgcttccacatgttcaggtatttctcgttgtcagtaacaccctacttcttggtaccaattttccagaattccatgaactctaccaccagttaacccaatggtaactggaacatattccagctaagaaattcagcagtttattaaaaattaatggatctaggccaggcatggtggctcacacctgtaatcccaacacattgggaggctgagatgagggga

SEQ ID NO: 15022 - DNA, 350 bp, Homo sapiens
gaatgcaaaaagagaaaggccgaccatgcggtggaaggtgcggaggaaggggaggggagtactcatcattgtggagggccccaaagcatcggaatgggacggcatgcacataatgaatccttctccctggcgaatctaatgctgttacgtctccatgtcaggaaagccatttaagaaacaaggatatgccggtcgcggaggatcactctttttattcctgcactttggtaggcctttgttctcacattgacttatgtcatgtattacttacctttctggccaccctcgtttcaagaccctattaattttacttctccatcccttttctttggagtctcccccccgctgcg

SEQ ID NO: 15023 - DNA, 338 bp, Homo sapiens
tcatcactttttaatataatgttaattaatttgcataattatcatgacaagtacaagtgactttcacaggtaaagaagcagacacaactgattttgactctggtaagcaacaccactcaaggagagggttggaagcagaagtgcctgagtctcctatggagtagcctgtcagtgactgggcagcccttgggcagtccatgtgttatgggggaaggaagagcattaatgaatccaatagtttggttaattctaactgaacagtattcttttaaaatttacatgtcccttattttaagaataatatgtttattatatatatcttgaaataatatgtttca

SEQ ID NO: 15024 - DNA, 397 bp, Homo sapiens
ggcacgaggctgggggtgctttatcctttctgccaagtgccgtgacacttctgaaaaatctccaggagcaagtgatggctgtaactgcacaagtgaaatcactgacacaaaaagttcaagctggggcctatcctacagaaaaggggctcagcttcttggaagagaaagaccagctgctgctcatgtaccttatggatttgacccacctcattctggacaaagcctcaggaggatctcttcagggacatgatgcagttttgagactgggagagattcgaacggttttggaaaagcttcgtcccttggaccaaaagctgaagtatcaaattgacaagctgatcaagactgcagtgacaggcagccttagtgagaatgacccacttctgtttaaagcccg

SEQ ID NO: 15025 - DNA, 316 bp, Homo sapiens
ttgtggctatagagttactttgtatgattttgatcatttaaatttatcgatacttattttatgacacagtgtttggtctatcctggaaaacattccatatttgcttgagaaaaaaatctatatattcctgtgttgttggatggagtggttattcaaaatacaactctgtgctaactttctgtttagtttttctaccaattattgagataatgcattgaagtctccaaatattattgttgatttgtgtttctcttttcaatttagcttctgtttgtatttggggaatctattactatgtgatatgatctatatatgt

SEQ ID NO: 15026 - DNA, 156 bp, Homo sapiens
tggtaccgcttggaaaggacaagagaagggatctgttgcgggaagacgaccgagagctactggtgctacaagacgaaacaccgtctctgctgagagtacacgaattataggtgcttgtgggcacgcaccagtgatcgctactggtgcggaagggag

SEQ ID NO: 15027 - DNA, 325 bp, Homo sapiens
gcctcagcccccaagtagctgggatgacaggtgcatgccaccacgctggctaatttttatattttttgtggagacagggttttgccatgttgcccaggctggtggtgaactcctggattcaacctttctgcctgccttgggctcccaaagtgctgggattacagatgtgagccattgcgcctggccaaggcttgatattattaagtcaatgcttctcatattggcctaatttatagatcaatgcaattataatcagaaacctagcaggtctgtgggggggcgtaaattgacatggtgggactaaaaggtatgtgaaaatgcaaag

SEQ ID NO: 15028 - DNA, 379 bp, Homo sapiens
cgttgctgtcgctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaa

SEQ ID NO: 15029 - DNA, 112 bp, Homo sapiens
tacggttcgagaagaacaataaacggttcggcttgcttaatacgactgaacggttcggcttcgacatgaacccccaaagggctggttgtctgaataagcttgaacggtacgg

SEQ ID NO: 15030 - DNA, 380 bp, Homo sapiens
  misc_feature 362, 368, 380: n = A,T,C or G
cgttgctgtcgctgtcacagacacataactggaaatgtgattttattctcctggatggacaattgtgatggattttttgggttccgggcttcaggctttgcaatctcatcttctttgcccttcctcttgtcataatggaagaggtgctgctaatttgggttccatcctttcctgctttcagagactgtcctgtgatttcctaaaacatttccattagtttgtttgaattttctgattttcttcccttagggccctccacaggcctctgtgctagtgccttgaatgatggcaagtgtacaaaaaaaattttttttctttttaagacgtttttgttctgtcacccaaggtgagtgcaatggcgngatctngggtcactgcan

SEQ ID NO: 15031 - DNA, 160 bp, Homo sapiens
gaacctcctgctccagcctctgcctcctccattttgatgtctagaatcaggggatccaggatcatcaccaaggtcattttcccagacagatgtgctgaggctgtagaaagtgctttttatttggttgggagcctgtgcataaatgcgagaggggctgcac

SEQ ID NO: 15032 - DNA, 343 bp, Homo sapiens
  misc_feature 331: n = A,T,C or G
ttattgggtatatgcaatgtgtgtgtccatgtgtacctctcccacagtccctcaaatgtggagggtagaacttccaataaactttctctccactgtgcttacatagcccactgcacatgtcttctacattgtattatagttatttgttcacagattttttttttaccactaaactatgatcttgtcaagggtggagacgtctttatctttataatccaagtgcctaggacatttcctgacacatggtaggagttaaataccttggttgaattaatatacaaataaaacagggagcattgtttaagaatatgaattattggctgggtgcggnggctcatgcctg

SEQ ID NO: 15033 - DNA, 246 bp, Homo sapiens
ttcctgtgacattggacaactgaaaggctcttatgcaggaagacatatgcttagcacatgtgccagaagcactactaccaggtctttatgctagaatcatgaaaatgtatattctcgcagaaagtctacgcaagtgcttattgcaactatacttataattgtcacagatggaagcaaccaaatgtccgacaattcgtaaatagataaaccagctgcactgtcattggtggctcacgctagcacttt

SEQ ID NO: 15034 - DNA, 369 bp, Homo sapiens
catacctaatagctcaacagtgtatagccaattactaacaatgtcatttttgtaagctaatgaggattcctgacaaaccactttatactttcatcatcactccctctcccaattcatcatttttttctttagcagctccagtctctcctttgttctccagagcacttcccaaggtaacttagaagtattttctgggctgcagtccttaactttaggccaaataaaccctctacctatagtaattttggctcaatttctttctttaggccaacactcctaaaaatcacaaatgaagctgaatgggcattcactttctgctttcatcttcttggggataagaactataaaatccttggccgggcgcggtgg

SEQ ID NO: 15035 - DNA, 347 bp, Homo sapiens
  misc_feature 347: n = A,T,C or G
catatttttctaagttgcttaaaatttaattacttaaaattacttaaaattctaaattacttaaaaatttaattcatgtcaatgtgatcaaacagatcaatttctttcattgtcctggttcaattatgttaacattattttcccaggaagataatgttcctaggaacatatagatttaaaaaaccagcaaataggaaaaaatgtaggttgtagacttcttttccaggtagtctttgaaaaatgaacagaattcagtattgaaaatatctatggttctaactttgtcactgtgtaaccttaaataaattacttagcatctctgagtctttactttctaaactattaan

SEQ ID NO: 15036 - DNA, 317 bp, Homo sapiens
ccagcctgggtgacacagtgagactccatctcaaaaaaataaaaaacaaaaaaaccagagaataccaagaaagtgcatatctatatatacatacatatgtgtatatatttgcataaataaatccagaagatgcctaagaaacttatttaggaatgtgggagggcatggtgcatttagatgaatagggaggaacagttagagagagttcacactttgtatgttttcatatggttaggtttgaaaccatgtgaatgtattacttactcagaaattaaattaggccaggcgcggtggctcacgcctgtaatcccagcact

SEQ ID NO: 15037 - DNA, 386 bp, Homo sapiens
cgttgctgtcgataaggggcaggtcttggccctagaggattgagatgtttttctaaatcttagaactatttttggataaattatatattttccttcctagtagaagtgttactgcctgtaactagctcaaaataccaatgcagtttctgcattctgggttttggttttcctttttttttttttttttggagtttggctttggccccccaggtgggggggcagggggggaatttaatttaatgggaaaatttggcctccggggtaaaaagaattccccgccctaaccccccggagaaccgggaataacggggcccccccccccccctaagtaaattttggttttttaaaaaaaaagggggtttaacattgtggcccggggggttttt

SEQ ID NO: 15038 - DNA, 347 bp, Homo sapiens
aatagtttggttaattctaactgaacagtattcttttaaaatttacatgtcccttattttaagaataatatgtttattatatatatcttgaaataatatgtttcaataaattgaaaataaaacacatacatacacacatacacacacacacacacacacacacaatgcaccacctggaaaatcactataaatattcaatcattctatttccataatgctctcttatgcaaggaccacttacaacacaataatttttaaacacagtccatggttttagctaatactgcatatatcacataaaaataggacaatatgcccttataatgagttattcttggtataactca

SEQ ID NO: 15039 - DNA, 354 bp, Homo sapiens
agtacattatgaccactgggtttatttcagaaatgcaaggctgatgtttgaaattctccatattaagtaagtaaaaggggggaggcacagatatcaattctccccaaattgatacttagagtcaaagtaatcccaaccacattcccaacagttgttgaagaaatataggtggattctctattatttttctgtattgagctctaaatagatacagaaaaaaaattgataaaattcaatacttatttgttatttaaaaataatcatgacacaccccgaacagaaaggaacctttttaatttgaaaaagcttatttacaaatacctatctaaccattgaaaatttcttcttctttct

SEQ ID NO: 15040 - DNA, 381 bp, Homo sapiens
tctacagctgagagaagacactgaagggatgggaaacgctgcgacctcttacagaggaggaaagttcatggacttctagcttctagaactgtgatacaataaactcctgctgcttatctactcctctgcagtattttgtcatggcagccctagcaaactactatagtgactgtgggggttaggatgacaccaagcatcaaatgccactccctgttccaacagtgagaccattccacagcccctgaatgacaagacaggccttcaaactcaagactacctggctaaggtagaagtactttagtcacaccacttctgaactttcttgcctacctgcagggcaagaatttttaccatttttaaatgtggacactgaagctcaca

SEQ ID NO: 15041 - DNA, 403 bp, Homo sapiens
ggcacgaggtccctgaaagaaagttctgtatggattcctttcatgcggtgaaggaacaacaacaatattcaacttcaccttggcgtgtgagggtcgtcgcgttttataacactatccctgtagaaagattagtgaaatgtattggaagaagtaatggaaacgtgaatcttcctgggctcgcgagtggatcttatttggagtcctcaccttcttaaatctgatgtttgtttgaaatcacggctgaatttccatatataggacagaaagaaagaaccccaattttttaaagaaagctccccccccccccgcccgcttttttcctgaacccacttggtctcccgttataaggcggccacaataaaaggcaacaattttcttttagtcttttgacgccattatattt

SEQ ID NO: 15042 - DNA, 331 bp, Homo sapiens
  misc_feature 293, 331: n = A,T,C or G
cctgtctctgctaaaaatacaaaaattagctgggcatggtggcatgcatctgtagtcccagctactcaggaggctgaggcaggacaatcacttgaacccaggaggtggaggttggagtgagccgagattgcacaccactatactccagcctggcgacagagcgagactccgtctcaaaaaaaaaatcactctgtcaacagcaacaatacactttcttctcaatgttcattacaagctttgtgctgggccacaaaacaagtctcagtaaatgagatagaattaaaatcacgcanagtgtattctctgtccgcagtggaaattaggactcggn

SEQ ID NO: 15043 - DNA, 373 bp, Homo sapiens
agtctgggtgacagtgagacctcttcacaaaaaaaaaaaaggggggggggccggacccatgggctcacccctggaaacccaaccttttgggaggcccggggctggcgattcaaagggacggaaaacaaaacccttctggttaaccggggaaaaccctgtgttttcttaaaatgccaaaaaaaaaatttacccgggcgggggggaaagcccctgttaccccaatttctttgaagggtggggccagaaaatgggggaaaccccggagggggaatttggttgaaactaaaaatgccccactggactccaccctggggaaaaaaaacaagaaaaatttctaaaaaaaaaatatccctttgaaccccctcttttttga

SEQ ID NO: 15044 - DNA, 351 bp, Homo sapiens
tctcccaaagtgctgggattataggtgtgagtcactgttcccagccgagacactgtctcataaaaagaaaagaaaagaaaaaaaaaaaaagggtggggggcaggggttcacaccggtatccccacctttttggggggcaaaggcggtcaaacccccgggggcggggagtgaaaaactcctctgcccaacgggcaaaaacgttgtcctttataaggacctaaaaaataacccgggttggtacgaacctctttgaagcggcactaacgtgcatcctctgaggattcgtagtattcgcctacacttcctcacacgatgtaatggattcacttccttctctaacatagtagaccg

SEQ ID NO: 15045 - DNA, 335 bp, Homo sapiens
cctataactgcttttgtggtggctcattggttttaatacgatgagtttctattctaatttgtctcaataaatttttaaaataataaaattgacccattggttattttttgagtgcattgtttaatttccatgtatgtgtaaagtatatgacactgttgttgatttccagatccatacctttgatacttgatataatctccatcttcttaaatttttttaagacttgatctgtggcctaatgtatgatctattctggagaatgttccatgtgtagttgaaaagaatgtgtaccctacaattgttgaatgaaatggtctgtaaatgtctttaaggtc

SEQ ID NO: 15046 - DNA, 429 bp, Homo sapiens
gtctttttgcaggatccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattc

SEQ ID NO: 15047 - DNA, 365 bp, Homo sapiens
cgggagtgtgggggagggcagtgaatatgataggataccactcctgtgatcaggttactaatcagttgatttttttagttaatcaaaagggaggttatcctaactggaattgatcaaaccaggtaatctctttaaaagaagatgaatgtcagagtgatggtctcctcctggccttgaagacaacgcaaactgagagaaaggggccactcagcaaggatctgagggcaacctataggaacagacagcctactgcacaagaagcaagggtatcagtcatagcacaacaaggaaatttctgccaaaaaccagtgagcctggaagagaatcctgaacttcagacgagactgcaaccttggattgatttt

SEQ ID NO: 15048 - DNA, 373 bp, Homo sapiens
cgttgctgtcggaactgggcaacatagtgacacccagtgtctattacaaacaaaacaaaaacagatgaaggcctgcatttgcctgtaggctatagtttgttgatccctaactagtaaatggtattcacatataaccacatggactttgcactgcacagaaaaagtcagtttggggagaatttcagacttacatgtgaaggacagatgtcaatttttatttttattttatttttgagacagagtctcgctctgttgcccaggctggagtgcagtggcatgatcttggctcactgcaacctctgccccctgggttcaagcaattcttgtgtctcagcctcctgagtagctgggattacaggcgtgcaccaccacg

SEQ ID NO: 15049 - DNA, 408 bp, Homo sapiens
gggcgacagagtgagactttgtcacgaaagaaagaaaaagaataaagaaagaaagagagagagagagagaaagaaagagagagagagaaagaacgacagaaagaaagaaagaaagaaagaaagaaagaaagaaagagagaaaagaaaagaacgagaaaggaaagaaggaaagaaagagaaagaaaggaacaaagaggaaggaagggagggagagagagaaggagagaaagaggaagggaaggagagagggaacgcaggaagaatgcattactgcccacaggttatctctttatgcacgacttatgcctagacgcgctccggtatacaaacggcaaagctctaaaccggcgggctcgtacttaccacccttatctccccccaaccgcattgcagccttcctaccctgcg

SEQ ID NO: 15050 - DNA, 351 bp, Homo sapiens
gacatcagaattgtgtatcttgatttacaaagaaaaaaaacaaaagatactctcttttttaataaacttaaaatgttcacatggcaagtgttcactcagcaaagtacttcagaacaaatttcagaatcaccagagaaccagtgaacaaagagggtgcagagataaggagaggcattagatgataaagcaatcagttctccaaggagacataacagtcctcactgtgtatgcaccaaacaacacaacaccccaatacatgaggcaaactgatgaactgcaaggagaaatggccaattcagatactgactggattagaacaaatacccaaaacttggggagtagtgctcaata

SEQ ID NO: 15051 - DNA, 380 bp, Homo sapiens
  misc_feature 340: n = A,T,C or G
cgttgctgtcgcgcgagatggattccgggtgctggttgttcggcggcgagttcgaggactcggtgttcgaggagaggccggagcggcggtcatgaccgcccgcgtcctactgcgccaagctctgcgagccgcagtggttttatgacgatccttaacttctcgcttacgtttcacttccgcctctttcgcttcttcttccgcccccttttccttcttctcatcccaccattctgatcgttctccctgcgatctctgctcgctcttcatctctgcgctcctcgtacttttccttcctccatctcttctctctccctcgtctgccgccgccttactactcttnctagttctgtcagctcttctttctgtctcgcctctctttc

SEQ ID NO: 15052 - DNA, 347 bp, Homo sapiens
  misc_feature 347: n = A,T,C or G
tctttttctactacacacacatttttagcaccaacctctgtaatacatcttaacagattccacatcacattgtactgaattcatattttctctacttctttgtaagtatttttgcctgttcacatagaatattaatgtaaattgattctttagtcactttaaacttggcattgactcttctaagagacaacatctgagcagtcttctacttagacagccattcaataatagtgggatccttcaacaccccattgtcacattagacagatcatcaaggccaaaaagtaacaaattctgaacttaaacttgacacgtgaccaatggcacttaatagatatatatagaan

SEQ ID NO: 15053 - DNA, 336 bp, Homo sapiens
ttttgagggatttttaaagaaaaactactaaatttgatgattgataacatctgtgcagtgggctgggcttgcagggagggttatgagacatggtgaggccagagtggtcaagtgactgaatattgttgagagtgagaagtgagaagggcaggagaccagaactgaggctgagagtgcagctataatgataaagacgggccaggcacagtggcttacacctgtaatcgcactctgggaggccgaggtgggagaattgcttgagtccagtaattcaggaccagcctgggcaatatagtgagaccccatctctacaaaaaatttaaaaattagccaggg

SEQ ID NO: 15054 - DNA, 330 bp, Homo sapiens
gttgagactgcaatgagccgagatcatgccattccactctaacccgggtgacagaatgagaacttgtctcaaaaaaataaaaaaataaaaaaaaaatgtatcaaccaaagtcatggagaaccaaaccaagttttgtctacaaccatgattcttacagtttttggtttcaggactctttgcattttgaaaaataactgaacacccagaagcttttgtttatatgaattttatctatcagtatttactatattagaaattcaagtgaggaaaaatttaaatatgtatcaattcatttaacagaacatgagtaaactcattacatgtaaacat

SEQ ID NO: 15055 - DNA, 332 bp, Homo sapiens
ctatacaatctctgttgcaactcttcaactctccctttgtagcatgaaaacagtgatatgccatatgtaattaataaacatggctgtgtttcaataaaactttatttgcaagaacaggcagctggtcacagttgatctcctagccatagttttccaaccttatttatctcccaaaggagatttcctttgggagataaataaggttagatttgatcttgagggtgagaaacttatgataggattaatatcctcataaaagaagaaagaggccaggtgaggtggctcatacctgtaatcccagcacttttgggagggcggaggtgggcaaatct

SEQ ID NO: 15056 - DNA, 335 bp, Homo sapiens
gtctccatataaatcgagtatgatttccagaaggaaagaaaacaataaataggacaaatgtgatatacaaagtagagacaataatgggaaatttttcagaatcagtcattggtggagcatgacacgagtgattaagtagggtagtggtcactaaatccaacaaaaataaatacctccacttcatgatcttcatcattatcatcataatcattgttatcatcttaagtaccatccacaaatatcacaaagctctagaatactattgttattgtactggaaatgtaaaactctaaggtaattaaaacataaatcaaatgtaaataatatattttcag

SEQ ID NO: 15057 - DNA, 319 bp, Homo sapiens
gggcgatcttttcggattatcttccatgctgtggcagaataaaaccaaaacattggctcttcctggaccttcaacctaccagcttttgaactgaaccaccattggctctcctgggtctcatgccttcaaattcagactgccaatatcatactgaatgggcaaaagctggaagcattccctttgaaaaccagcacaagacaaggatgtcctctcttaccactcctattcaacgtaatattggaagttctggccagggaaatcaggcaggagaaagaaataaaggtattcgaacaggaagagaggaagtcatattgtctct

SEQ ID NO: 15058 - DNA, 333 bp, Homo sapiens
cttcctttgaaatgactttcagtttcccactgggatagattatatcaagtctgcttggtaaatgccatgctggaaagcaaaagtgtcctttcaaagtatggaatacactgaataagataagccgcggatcccgcagtatgaggttttaaatttattccaaaagaagaaatagaggggtacatttacaagcaaagtacagggccaggcacgggggctcacacctgtaatcccagcactttgggaggtcgacgcgggcggatcacgaggacagatcaagaccatccctgcttactcagaaaactcccgctctactaaagatacataaacctagcg

SEQ ID NO: 15059 - DNA, 316 bp, Homo sapiens
attaaaataagaaaataattctgatattatattttactctaattttaaagccttttttcatattaagtgtttttgttgattcaaaattagaaaatatatctatctctaatacttaatacccattccctaacatggcatttgttcattcaattgaaaacatttagcaaaatgcctcttcgacatctatgggatcatttaaaaaatgttttgggggacttaattataattctcctctaagcttttgaagcttagctaagactattacctattctcttgggttttgctaccaccatgtgctagtatgtgacagatgttt

SEQ ID NO: 15060 - DNA, 338 bp, Homo sapiens
  misc_feature 338: n = A,T,C or G
tatgtactacggttgcgacatgacgacagacggtgatgtatgtggaccccccacctctcatcagcgtggacaggcatgcgctatttgcgatcctcgttatgccctggctataactaggatgcccactctctcgcactcctattggacatagcaccggttggcctacattttatcgatcaggatcgagaggaggtgagggatgttcttataggaagagagtaagtcaaactatctttctctgcaagtggtatgattgtataactatgaaatcccatagtctccgcccaaaagatccatgagctgatgaacctcagcaaagttttaggatacaaaatcan

SEQ ID NO: 15061 - DNA, 326 bp, Homo sapiens
cagggctagcgagcctacctctagaaccttcttgccagggtcaacttctgagattgacagttgtctttcatgttctagcatgaaagttatctggttggtttgctcttattctagctttgtggggacttgtataatctaattttttgaataggtaatacattcacatggttcaaaatttaaaaaataacaacaaaaaggttatgctgagaaaagtctctcttactctcccgttccctatctacccagcttctaccacctccctaaaagtattagtttcttatacagtatatgtgactagaatttctttatataaaaagaagcaaatg

SEQ ID NO: 15062 - DNA, 244 bp, Homo sapiens
gcagtgggggagaggccatgtaagtacctggggaagatccaggcagaacagtttgcacaaaggccctgagatgacacctcgcttggtgtgctggagggcagtaaggggaccagagtggctggagtggggtgaataagaaagcagaaggccgggcgtggtggctcacgctcatgcctgtaatcccagcactttaagaggctgaggctggcggatcacaaggtcaggagattgagaccatcctggc

SEQ ID NO: 15063 - DNA, 336 bp, Homo sapiens
aaaaagatgacctaaaactgtccttatccccaggtggtgtgattttcaacatagagaacaaacctaagcattctacaaactattataactgataagtgatattagcaacatttaaaaattaataatttacatctccactggcaattaccaattagagattatgatagaatatgatagaaaaataattccatttataatagcaaggaaaactataaagaatctatgtataaatgtaacaaaaatgtttaagacacatttgttggaaaaatcacaaagtattcataatatacataatgaataaaacacattaataaagaaataagtacaaagtccatg

SEQ ID NO: 15064 - DNA, 325 bp, Homo sapiens
  misc_feature 310: n = A,T,C or G
tgacactctattatagtctaggctgtttacatactaccatcagggacgaggatgtctgacgtaagaaattaccacgaagtatttattcccagaaggcaaagacctcaccatgagtgggaactactgtacgcagtagcgaaaaaacattaaggacacagaatatacatatatgtctatatttatatatatgcacacatttatacacacatacatatatacaaaacattccctgtttttaaatatatgtatgtacatatacacacacatatatgtatgcgtgtgtgtatactgaaactatatttgcataagnttatatattatatcc

SEQ ID NO: 15065 - DNA, 328 bp, Homo sapiens
gccaagatcgagccactgcactccagcctgagcaacagagtaagactctgtctcaaaaaaattttccttttaaaggaaataattatttatttatttttgagatgagatctcactccgtcgcccaggctggtcttgaactcctggcctcaagcaatcctcccacctcagcctctcaaagtgttttggattacaggtgtgagccactgctcctggcaaactcgtaatttttggtagaacaattggggtacttctgatatgaaaacaaagctgggccaacttcttcacttcgatatagtcatatttatccaattttcgttcatgctgtggg

SEQ ID NO: 15066 - DNA, 352 bp, Homo sapiens
tactatattataagagtagacaaaaagagacaaaaatctctgctctcaaagagcttaaatgctggtgggagctaagaagcagataaaaaaaggcgaaataatggttacttcaatttagcatataccaagtgctaggtggtctcctgagtatctactaggtattacttaatttaatcctcccaacaactccatgaggaaagtattactattgtgcatatggggaaactgagacacagagagattaagttacctgctgaagatcatgcagctcctgaaggcagaaccaagatccaaacctgatggtcttggtacaaagtccatggtctaattaagagctacacttcaggccagg

SEQ ID NO: 15067 - DNA, 353 bp, Homo sapiens
tatgttttcttccagatgttttatagggtaggtcttatatctaggtctttgattcactttgagtttttatatataatgggagatcacatgctgtttttgaaaacgagttaaagtggtaaacaatcaggagtttaaaaatatgcatctatctttggttttactgacaatcatgtgatattttgttaaacataccatttaatagaaagaaaacaaactttaacctctaatgaggctgatattctcaatatttactttaaaaatgtgataagcttagagttattagaaaaggcctttgacatttttgtttttacaaatcaactgctttcaataaagacttgaataaatgaagcctt

SEQ ID NO: 15068 - DNA, 362 bp, Homo sapiens
tatgttaaaatgctcttacacagagcccagactttccaagggttattctttgtgtgagtgtgtgagtgtgagtgtgcgtgtgtgctcacaaatagaggcccagcacgcttatactacaaagagagaggttactcgggggaatatactaacaccggaaagggttactaatttaaatgctgagggtacagacctacctcaccttgtgaagcgcactatctctcgactgggcacggttacatacgtctgcagttctagcactttacgaggctcgagcctggtggatcacgatgtcaggagttcgagaccagcctgtgcaatatgggcaaacccccgtctctactattcatacttatattagctgg

SEQ ID NO: 15069 - DNA, 372 bp, Homo sapiens
  misc_feature 372: n = A,T,C or G
aagattgttgtatcgccatatctatttctactttgtaacagtagcttttttttgccacgtttaatgactgatcacaaagtgagatatttaaatatatatatacacacacacatatatgcatatatgtgtgcgcttgtgtgtgtgcgtctatatgatagatacttgccacatgtttaatgactgatcagaaagtgagattttaaaatatacatatatatacacatgtgtgtgctttgagagcggtgtgtatatatatatgatagatacttagctgatcttcacaccacaacattaatctgcccaccatgaacagaagcactgctatcaagtatcagccttcttgtataataacaggaaattcagaacattgan

SEQ ID NO: 15070 - DNA, 278 bp, Homo sapiens
gttggttttgtttttacgatagtttatcacaatctgtcagtgttttaaatgcatgtatcttttgatcccgcagtttctataacattctctcttacggatatacccatacttgtggtcacatataccatatttcatccaatctaaaacactctaaatagtacaaagtgctattattttatgtaccattaagaaaacaaaacctaccgctttaactatgacacagtcctttcatatcacttagaattgcgtcttatactcattaagaccgctcctagctg

SEQ ID NO: 15071 - DNA, 357 bp, Homo sapiens
  misc_feature 357: n = A,T,C or G
agacaaggtttcaccatgttggccaggctggtctccaacttctggctcaagtgatccacccacctcaacctcccaaagtgctgggtttacaggtgtgagccaccatgcccagccctacaaccaactggtttttgacaaaggcaacagtaatacacagtggggcaaggacattctcttcagtaaatcgtgttgggaaaactggataaactgcagaacaaaattagacccttatctctcaccatatacaaaaatcatcttgggttataaaaaaaacaggacctgaaactatgaaactactaggagaaacaagaaaagctatgtgacattgatctgcaccatgattttgtatctatgacn

SEQ ID NO: 15072 - DNA, 351 bp, Homo sapiens
cccccttcacggctttgcacaagtggccttttataaaattaccacttgctgtttgccattctgcctctgagggactgaatttccaaccccccatgggatggtataaggagatggggactttggggggtaactaggtttataagaggccataaggggcttggcctagaggctcacacctgtaatcccagcactttgggaggccaacacaggaggatcacttgggcccagtagctcaagaccagcctgggtaacacagggagatcctgtctcaaatcaaaataattaaattgttaaaaagataagaatatgatagaacagggcatgaaggtggggcccccgtgatggccttag

SEQ ID NO: 15073 - DNA, 410 bp, Homo sapiens
ggcacgaggtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtga

SEQ ID NO: 15074 - DNA, 406 bp, Homo sapiens
  misc_feature 337: n = A,T,C or G
cgttgctgtcggcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcanatgacgaggacgaggagtggcccaccctggagaaggctgccacaatgacagcagcgggccatcatgcag

SEQ ID NO: 15075 - DNA, 329 bp, Homo sapiens
gagcacacctgcacacactggaacacacctatgcacacctgcacacacctgcaacgctcatcgtccctatgtgacctggagcaagttatctaacctcttggtgcctgagcttccttatctgtaaggtgatagtgatgatgcccccccccagagagctgtcatgagaatgaaatgaggtgacgcccttacaggtgtgtaagggcgatacctggcacactgtggggccatctgagggttgctcatcatcccccatcccgggagcttgccaccgtgcccaggtgtgcagcccacagacagctgcagctgccatggtcacaggagatcacaag

SEQ ID NO: 15076 - DNA, 321 bp, Homo sapiens
aaatacaacagagaagctcaacagagccaaaaattgtttctttgaaaatactagtaaaactgactaacctctgatgtgactgaccagtaacaaattagtgatgcaaaaataacccatgaggaatgaaaagaggaacctaattacagatgccacagagattaaaaagatagaagaatacaatgaactttatgccaataaatcttaaaagttagatgaaatgaactcctgaaaagaaaacttaaactgtcccaagtagaaacagaaaactttgaatattcctaaaactacttcagaaaatgaatcagtagttaaaaatctacc

SEQ ID NO: 15077 - DNA, 399 bp, Homo sapiens
ggcacgagaagaactcttgctcacatcatctaagagattgcacctgctgacctagagattccggcctgtgctcctgtgctgctgagcagggcaaccagtagcaccatgtctgtgactggcgggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcataggcagctcatctcacgaaacttccaggagcgcacccaacaggacctgatgaagtctctacaggcagcg

SEQ ID NO: 15078 - DNA, 129 bp, Homo sapiens
  misc_feature 28: n = A,T,C or G
gcttccggtgggcttggtactgatcgcnccaggctctacagagtgacggtttaattcctgggtcctggagctacttctgtggttccatgtctggatctgtatgttccagtaagcgtactcggtaatctg

SEQ ID NO: 15079 - DNA, 387 bp, Homo sapiens
cacctcaattaaaaagcagatactgctagtttggatgaaaaagcaagatacaactatatactgcctataagaaatagactttaaatataaaaacacaaataggtacaataagaatatggaagaagatattccatgttaacaataaaagaaagctgaggtggctatattactcaaagtagactgcagtgcaaagaatattataaagaataaaggtcattataatgataaaaggtcgattttatcattatgttctctgactacaatgtaattaaattagaaatcaataacatgagattatctgaaaaatacttggggaaaaaatacacacgtctaagtaacccatgggtcaaataagcaatcaaaaggaagattaggaaatattctgaa

SEQ ID NO: 15080 - DNA, 388 bp, Homo sapiens
cctctgaaacttgggttgcccatccaaagagggggtgacaatcctgtcttgccaagactgctgtgaggattcagcttataagtcataaaatgtagtcggctggctgggcacagtggcttacacctataatcccagcactttgggaggccaaggcaggaggatcactagagcccaagagtgtgacaacatcgtgtgccatggagagagaccccatctattcaaaatacaaaactatatgtgcgcgggggggcgtacctctggattcccatcctcgcgaggcgctgacgcgagctaatgtgatcagcccggacggctaagcgttcaccgacgcgagtatgcgccactgcttatccctctgtgcaacagaaaacgacttttttgaaagata

SEQ ID NO: 15081 - DNA, 345 bp, Homo sapiens
aaaaatccaagttcatttgggatcttgtttacttatcatctagataaaaagtttgcaaactatagccaaagggcccaatcccacctgccacctgattttataaataaagttttactggagcataactgcacctatttgttttgttttgttttttgagtcggagtctcgctgtgttgcccaggctggagtgcagtggcacgatctcagctcactgcaagctccgcctcttgggttcacaccattctcctgcctcagcctcccgagtaggtgggactacaggcgcccgccaccacgcccggctaattttttgtatttttagtaaaaatggggtttcaccgtgttagc

SEQ ID NO: 15082 - DNA, 283 bp, Homo sapiens
tttacctcattggttatatgtactcctaggtatggtggggtttttcttgtgcatgacgcaagtattaaattaaacctctcatgttatactttatcttattccttacaatagctcagacagtagatcatctctgtttccactcaaatgcaccagaagcctgagtgtgtattttatttatttatttaaaaactgaatatcactctgttacccatgctggagtgtggaggggccatcataaattattgcaacctttaacacttagtcttaaaggattctcccacct

SEQ ID NO: 15083 - DNA, 331 bp, Homo sapiens
caaatatcctcagtaaagtactggcaaacaaaattcaacagcacattaaaagatttatatgccgtgatcaagagaaatttatccctgggttacaacagtggttcagcatatataaatcagttaatgtgatatatcacattcacagattaaaagcaaaaaacacatatatacctcaatagatacagaaaaatattttttaaactcaacatccattaatgataaataatatttaacaaaataggtataaaaaacttacctcaatactaacataataattaatagacaaagaagcctgaaaactttttctcaaggacccagtagaaaacaagga

SEQ ID NO: 15084 - DNA, 335 bp, Homo sapiens
  misc_feature 198: n = A,T,C or G
tttccgtttgttgagacttgttctatagcacaaaatatagtctaatttggaaaatgttctgtgtgcatttgaaaaggatacacatttgaaaaagacatgctattgttgaatagagtgtcctatcattatctgttaggttaagttgttgacaatgttatttcagggttctttgtagatttgcttatttctctttctagntccatttgtttttgcctaacatatttaaaattctgttattagtgattaattttttaggacttttatgtccttttgatgaaatgactcactgcttattagtaaatgaccttcgtgaactcttggtttcattcttgggg

SEQ ID NO: 15085 - DNA, 331 bp, Homo sapiens
catttacatatacttgaaaatcattgctattaatttctaatttattttctctttttgtcagataatacacttcgtaggatttgaaaccttttccgtttgttgagacttgttctatagcacaaaatatagtctaatttggaaaatgttctgtgtgcatttgaaaaggatacacatttgaaaaagacatgctattgttgaatagagtgtcctatcattatctgttaggttaaagcgctgacaatgttatttcagggttctttgtagattagcttatttctctttctagctccatttgcttttgcctaacatatgtaaaattctgatattagag

SEQ ID NO: 15086 - DNA, 322 bp, Homo sapiens
  misc_feature 254: n = A,T,C or G
tctatccaggtatccatccatccatctctccctccctccttccctccctccatctctcccttcatccatccatagctctatcctatcacccatccatctatccctttatccaatcatccagccatccatccctctatccaatcatctatccatccatccttctatccaatcatccatccatctatcccctattcaccctccctccatgcaatcaaccatctatccattcccatttatctaacaaatcatgcatncacccacacacccaacattcacccattcattcaacaatccattcacccattcaccattacttaacaga

SEQ ID NO: 15087 - DNA, 298 bp, Homo sapiens
gtacacacacatgcatatacatatgtatgtgtgcgcatatgcatacacgtccatacacgtgtacatatatgtgcatgtgtgcgtgcatacacacatgtacatacatatggatacatacacatgtatacatatacatgcatgcaggcacatgtatacatgcatacatacacatgtatttaagccagagattgcacactggtgccctaagagctggatattggcccagatgtgttttctttggtctacattaaattttttttttcctttttgagacagaatcttgtcctgtcacccaggc

SEQ ID NO: 15088 - DNA, 345 bp, Homo sapiens
gggcaggtcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgat

SEQ ID NO: 15089 - DNA, 350 bp, Homo sapiens
tgatttctcaccctcccaaacacttaccttatttttttctctatatctgcatggttttgtttccttaatatattccaggaaatttatttttgggttggcctactggagaagttatgatgaatagaaaagtgtgaagaagaaccttctattctcctcacagtatacggcaaagagcgtgcaattgcccccacaatatcattgtggaaaggtcatattactgagactagctagtaacacattagcttacagaattctcattcttacgctataatattaccttcctcatcaaacttacctgaccgcatgcttgatgttggctgattaagacataacacgctggtatttaccaa

SEQ ID NO: 15090 - DNA, 269 bp, Homo sapiens
cagcctcctacagacttttaagtgccatgagtctcaggcaattaaaactagaagtacttctacgtatgatctattaggtcctaaaagactacttctatattcatttgttccaaagttcagagtgacacatactatccaagagacagctaatggtttttgttctggcacatgacttgttcatatctacacaagttcacaaattgaaaattcttaagagtttctggccaggcacagcggctcatgtctataattccaacaccttgtgagga

SEQ ID NO: 15091 - DNA, 390 bp, Homo sapiens
cgttgctgtcgctgctttgtagagaatagaatataggaaagcaagaatggaaacagagctattaggaggctattggagaataatgcagatgagagattattacactgtctgaactaaggaggtggcggtaaaggtgtagagaagatggatttttttttaaacggtcccactgtctagagtgcagtggcgtgatcacagctcactgcaacctagacctcctgggctcaggcgatcctcccacctcagcatcctgagtagctgggactataggcgcatgccaccatgcctggctaatttttcgtatttttttgtagagattgggtctctccacattgccccggctgctctccaacccctgagttcaagtgattcacctcccttggcctccca

SEQ ID NO: 15092 - DNA, 388 bp, Homo sapiens
cacacctgtagtcccagctactcaggaggctggggtgggaggaacacttgagcctgcatttcgaagctttgcattgatgctgcaccccagcctgggtgacagagcaagacccggtctcaaaaagaaaaataaaacactaatcccttcctcagaagaggaggtaaaatccttgagtgatgtttactcttcttcatatcccataactcagatattatgatgcaaaattaataatacttaatactatgacataaagttaatacatcttatgttacattatgagggaataaaagagaaaagaaaatgaagatatttgcttgatatacacacacataaacatataaataacaaaatgaggaaatactcatggcaatcatagtcctagggtcca

SEQ ID NO: 15093 - DNA, 363 bp, Homo sapiens
cagaagaaggattgattatgatacttactcagaattttccaaaactgataaagtacattagccaacagattcaagaagctctctgactctaagctgaataaaaataaaaccactttagcaaaaaatctaactctaagctgaacaaaaataaaaccactcctagcaaaaacaaacaacaaaaacttcaaagaagcaacagtataactgattactgctcagcaaaaaatgatgcaaaccaaaagacaataagaagaaatctttaaaatactgtaagaaaattactgttcacctagaattttatacccaattaatatatccttcaaaactgaatgcaaaatagagatgtattcagacaaaaaccag

SEQ ID NO: 15094 - DNA, 355 bp, Homo sapiens
tttctaaaagtactaaaacagccttaaaaataacaaggaaaacccaatttaaaattttaatacttattgtaaagctagaataattgattctgcatggtttggaaaaacaagatatattcagcaatgaaacaggatagaaaatcaagtaatagacacgcatatatgtggtcaatcgatgttcaacaaaactgccacggcaattcagtagaagaaaagcaatctcttcaagatacgttgctggaacaattggagagccatctacaaatgaacttcaatctttatctacctcaacaagaaacacagaatagatgagaaaacaaatgtgggagctaaaaatgtaaatattctagaagta

SEQ ID NO: 15095 - DNA, 388 bp, Homo sapiens
cgttgctgtcggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctg

SEQ ID NO: 15096 - DNA, 354 bp, Homo sapiens
ctccctgcaaactcaacctcccaggctcaggtgattctcccacatctagcttaatgtattaatgatgtaatagacaattactggccaggcgcggtggccagagcgagactccatctcaaaaaagaaaagaaaagaaaagaaaattactggcggcaagcaggaacattgtagattttgaaactgtcttgttttacaagatactgaagcaaggtggtgcaattattacgtccttctaaagctgatcggataaaggctttaattttgtaattttcagagaatattaccaatgtagcaagatttaccaataaccaatggttgcttgaagacaaaagaggttgttggaacttgcttaat

SEQ ID NO: 15097 - DNA, 342 bp, Homo sapiens
  misc_feature 307: n = A,T,C or G
aatgggggcctcgaagatagtaatttcttatgtcctaagctagggggtatgcatatgggagttcgttttattgccattctgtatgactcacacatgtcagaaatattctttggtcttgtattttaaaatacaagtgggccaggtgtggtggctcacacctgtaatcccagcactttgggaggccgagtcaagcggatcatctgaggtcaggagttcaagaccagcctggccaacatggtgaaaccccgtctctactaaaaatagaaaaattagctgggtgtggtggcacacacctgtaaccccttgngagactgagggaggagaatcccttgaacccaggag

SEQ ID NO: 15098 - DNA, 373 bp, Homo sapiens
actacggttgcgagatgacgacagacagggatactgtggcactgacctcaaccctgggggacagagtaagactctgtctctgtcaatattgtgatgctattgctttttttgtaacttttataccgctgagaacacagagagactgcgacgtatagaccctactaagggctttttgtctggggagcgtgtgggggagtagaagtaaacttttaaaaattcaagatagaatcgtgatgagcaagcctcatgcacatgcatgaggatggctactaccaaaaaggcagaagataacaagtgttggtgaggaagcagagaaactggaactctcatgcagtggggttgagaaggtaatatagtgcagccgcggctgggt

SEQ ID NO: 15099 - DNA, 350 bp, Homo sapiens
  misc_feature 287: n = A,T,C or G
tattactgctttcttttgtgttaaataggatttttctaatgtactattttaattcctgtgtagtttcttttgctatctatttttgtaggactattaatactaaatttataataacctagtttaatgtctacttaatctcaatattttgtaaaaactttgctcttatacagtcccatttcctcttcttttatttatctattggtgctgtgcaaattgtatctttatacacagtatgcccatcagcacggatttataattattgctttttttataccattgtcttttanatcaaacaggaaaaatattagaaacaaaaaattcatctatactggcttttatatctacttatg

SEQ ID NO: 15100 - DNA, 240 bp, Homo sapiens
tacggctccaaaaaaacaacaaagggtaccgcttgcaaaatactacaaaagggttccgctgccaaaatactacagaagggtaccgctgcgagaatactacagaagggttcggctgggggaatactacataagggttccgttgcgagaaaatctataaaagggtccggctgggagaaaactacagaagggtacccgctgccgaaaagacctcataaagggttctcgctgttagataaattg

SEQ ID NO: 15101 - DNA, 131 bp, Homo sapiens
tacgggtgcgataagacgactgaagggtacggttgctatatgacgacatatggggagccagtttctatgtctttggaagtgtcgtgtaggtggtcatctctgcttatctccgccttctcttaacgtccggc

SEQ ID NO: 15102 - DNA, 330 bp, Homo sapiens
taccgctgtgagaacactactgaagggtccggctgcgatacgactacagaagggcaccctgatcactactgctggcatccacgcctgccatccacaggcttggggacatgtccaccttgcccaccttgcccactgccaccaccactggtgcccaacgactatctggtctagagttttcatgcctagcaaagcctcaaacagtcttcagtaacaaacacaggctaagccaatgagaaactcatagataccactgacactagttatagctacctaaatacttcagaggctacactactgccctaccctgtatcaccaccaaagcctcctacc

SEQ ID NO: 15103 - DNA, 373 bp, Homo sapiens
gattgcataagctaaggagtttgagaccagcctgggcaatatggcaaaaccccatctctacaaaacatacaaaaattagccaggtatggcagctcgcacctgtagtcccagctacttggggggcagaggcgagaggatcacctgagactgggaggttgaggcagcagtgagttgagatcatgctactgtactccagcctgggcaacaaagtgagaccccgtttcttttttttttttgaaaacaaagcttggttttgacaccaagctgggcgtccagggccccaatttgtgttaatggaaggcttggcttccaaggttcacaccattttttgggtaaagcctccaaaagaacttggaacataaaagccccccct

SEQ ID NO: 15104 - DNA, 393 bp, Homo sapiens
ggcacgaggtaatcccagctactcgggaggctgaggcaggagaattgcttgaacctgggaggtagaggttgcagtagccgagattgcgccattgcactctagcttgggaaacaagagtgacactccatctcaaaaaaaaaaaaaaaaaagggggtcctttggaatttttaaaaaaaaaaaaaaagggggggggggaagggaaaaagggatcaaaaagggccaaaaaaaaagggggagggattttgggggccaaatttgaaaaaggggggtttccccttttgaaaagggccattttttttaacgggtgaaagtttccaaaaaggccgggggggaaaaaaaagggggttaaatttttttcccaaattgggaaaagacccctttgttttttttcca

SEQ ID NO: 15105 - DNA, 376 bp, Homo sapiens
cacctcaattaaaaagcagatactgctagtttggatgaaaaagcaagatacaactatatactgcctataagaaatagactttaaatataaaaacacaaataggtacaataagaatatggaagaagatattccatgttaacaataaaagaaagctgaggtggctatattactcaaagtagactgcagtgcaaagaatattataaagaataaaggtcattataatgataaaaggtcgattttatcattatgttctctgactacaatgtaattaaattagaaatcaataacatgagattatctgaaaaatacttggggaaaaaatacacacgtctaagtaacccatgggtcaaataagcaatcaaaaggaagattagga

SEQ ID NO: 15106 - DNA, 294 bp, Homo sapiens
gcgatgtctaaaaccaaatagggaaaatataaaaccaggctgggcaaggtggctcatgcctgtacaatgcttggcacaatgcctggcacatggaggccaaggtgggaggctcacttgagaccatcctggacaacgaagtgagaccctgtgtcaaaagaaaaaaacagagggagagagagagcgcgaaaactacaaacgagaggtgacaatcttccgggggggcttattttgaaaaatttttccgcctgtttctcacttaaaaaaaaaagggccacacttctaagaaaaaggggg

SEQ ID NO: 15107 - DNA, 345 bp, Homo sapiens
ctggccaacatggagaaaaccccatctctactaaaaatacaaaaattagctgggcgtgcacctgtaatcccagctactcgggaggctgaggcaggagaatcgcttaaacccaggaggcggaggttgcagtgagccgagatcatgccactgcactccagcctgggtgacagagtgagaccccgtctcaaaacaaaccaacaaaaaacagagccaggtgtagtggtgtgcacctggaacataacttctcacaacgctgccgtgggaagactgcttgaacctccaggagcgcgaggaacactctggtcataccaaccgaggtctcaaatttcaaaggcatttctattc

SEQ ID NO: 15108 - DNA, 262 bp, Homo sapiens
tgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggg

SEQ ID NO: 15109 - DNA, 298 bp, Homo sapiens
aactgttgtatttttaatagacaatttcacgacgttggcgaggctggtcttgaacccctgacctcaggtgatccacccgcctcagcctctcaaagcgctgggacaggcgtgagacaccgtgctgggacagtagtaacttctaatggataatgtatgcgtggggtggaaaggggagtaccagtatttttatttcaaacacatatacaaaacaccagcttgcaattcaccctgaagaaccctcagcacagagcagtttcataagtccatgccatcgtgccatatgccttcttcactggcc

SEQ ID NO: 15110 - DNA, 324 bp, Homo sapiens
ataacctctatgcatacttctttttagctgaagtatgccaggcctgtctctaacatattatgcatatttgtgataccattaagtagagagggtttttaaataataatctgactcaaaagaaaaagacaaaattgaatataatgaactccaaggagatacaggaattgtacagattgcttagagtataagaaacttgcttaagtatgtgaaacttgattgtgattagaaaaaaaaatttatttaatcctgttgttcctagttattcaacatttggacgccataaaagaaaaaatgggctgggcacagtggctcacacctgtaatc

SEQ ID NO: 15111 - DNA, 129 bp, Homo sapiens
taccgctgcgataagacgacacatggctgcggttgcgagtactcaacagactgggacgggtgggagacctcgacacaggggtgcggctgtgagaagacccaagatagtgccgctgcacataagactacg

SEQ ID NO: 15112 - DNA, 249 bp, Homo sapiens
tggtatccacaggaggtcctgtaagcaatttcctgtggatacttagggatgactgtacatggttataaaaggaaattgatcagagttaaagagagatttagtgagctgaagaaagtcagtagaaaatatctagactgaagcatgcaaacaaaatatatggaaagtacagaaaatagcattagagatgtacagaaccttatgcaaagggtgaatatgaaggaacctggagatccccaagggagagagaat

SEQ ID NO: 15113 - DNA, 344 bp, Homo sapiens
caaaccaccaccactaagtaaaccaaaacatgcatgatcaactggaaaaaaaatgcaactcatagcaaagactatacataaagagctttcagaataaagaagaaaaagaccaacaacatagtgggaaaatgtctgaaattcaaaacacactccacataaaaataaacacaaaatgacatttaaatacatgaaaatatgatcaaccttacttataataacagaaatataaattaaagctataacaaaataccatttctcacctaccagcaaaaatccaaaaggttgacaacagattccatgggtgatgttctagggaaacaggcactttcacatactgcttgcat

SEQ ID NO: 15114 - DNA, 360 bp, Homo sapiens
tcaccatgttggccgggctcgtcttgaactcctgacctcaagtgatctgcctgcctcagcctcccaaagtgctggaattacagggatgagccaccaccctcagcctgactttggccccttttaatagtaaaacaataggttttctggaaactctgaaacagacttctggttatatatcattggctataatcatgtcaactatgaccacccccaactttatgtttgatttacggcacattggccaaaataactgaacataatcgcgttacatttaaaaagaaccacgggtggcactggcgggtcttagttgtaatcccaaccctttgggaggacaaaacccatgggtcacttggggccagt

SEQ ID NO: 15115 - DNA, 359 bp, Homo sapiens
ttgcaggcagactgtagccccatttttagtcctgtttgtttgacttaaggttcagtgagtcttgtgtaacagttgtccttcttgtcagctgtctttcaactgtgccgttgactgttgtctggttgtgggattagtgccatcatgaagactggctaatgtgtttgcatgtagtgcctcattcctgctacaggaggaggtcagaaaggtaaaaccaggccaggtgtggtggctcacgcctataaccccaacactttgggaggctgaggcaggagaatcacttgaggtcgggtttgagatcaccctgggcaacatagtgagaccttgtcttccctcccaccaaaaataggtgagagtgcgct

SEQ ID NO: 15116 - DNA, 357 bp, Homo sapiens
  misc_feature 357: n = A,T,C or G
ctacggctgccagaagacgactgaagggcagctaacatcatacttagtggtgagaaactgcctttcttctaagacagagaataaggcaaagataacccctctcaccactcctattcagcactgtactggaagctctagttgccgccctaagacacgataaggaaccaaaagatgtacagattgcgaaggaagaaataaaactgtctttgtttgcagatgacatgactgtctaaagaaccctgaaacaatgaagtgactatagcaaagttacaggatacaaggttattatacacagccaattggattccaaaatgccagccaccaccagccagaatttataatcaaaaagatactatn

SEQ ID NO: 15117 - DNA, 162 bp, Homo sapiens
taccgctcccagaagtcgaccgaagggtgtggatgtttgtagggatgtatatttggtattgtggcaaggtacacataacattaaatatgctatctgaaactgtgtaagcgtatagttcagtagcatcaagtacattcgttctgttgtgcaatcataaccacc

SEQ ID NO: 15118 - DNA, 337 bp, Homo sapiens
gcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttctaggagctggtgcgttgccccagctggggagcctgccctcctccctagccctccaggcctttgtttccccacctataaaatgtggcagagtagccctcaagtgaaatgttactcctaaaggcacctgtgagccagagacctgctctggtggctgtgggagacaggggaagacttttctaacctg

SEQ ID NO: 15119 - DNA, 354 bp, Homo sapiens
ggttcttagaatgtatcccccatggataaagggggactactgcacttgttcttttgcagtcattcacagacatgcacagagtggcaaaaaatttaaatcaccctacatgtactttctgggtgaggtcaaagtttcactctgtcttctcatttcagctcttatgctataaacaagtatccttttccacagtctatttagagtcatttttttttttgcatttttgcgctttttgtggggaattttgctgtttaaaaaggcccctaaccataatgttcagttgttacctagggtccctaaaggcaagaaagctatgaagggccttactgagaaaatacctatggaaaaagaggttct

SEQ ID NO: 15120 - DNA, 324 bp, Homo sapiens
gctgggattacaggcatgagccaccgcacccggctgcttccaaattaatttttgattatgatcaaaagattccaaagaatcgcttaagcataggagttcaagaggctgcagtgggccaagatcacaccactgcactccagcctggggacagagcaataccctgtctctaaaaaacaagaagattcctacagagcatgaagtcaagcaagcataacaaattggagaagctcaataacagcaaagtggggccagccatccatatacattcatttgctatgaggatgtctcagccatagggaccagacacacgagtcttccaacagg

SEQ ID NO: 15121 - DNA, 364 bp, Homo sapiens
gggggccttcactccctggagttccaaccgcagccatccttgtccccacaacttctgcagtgtcccagggcttgcctcactctaactcagcccactcacacttatcacgtgacttcatcctaaacaacaataaccttgaaatctggaatctgtcttggtcatgttcttacaaactcatgctgaaataaatgacagcagcccaggctggctgcagaggctcacacctgtaatcccagcactttgagaggccaaggcaggaggagttcaagaacaccctatgcgagatcccatctctacaaaaataaaaaattagctggggccgggcgcagtggctcaggcctgcaatcccaagcactttgggagg

SEQ ID NO: 15122 - DNA, 324 bp, Homo sapiens
tattcccattttacagataagaatcctgaggcttagagagttcaagtgacctacccaagggcacatcactgataaagggcagaggtgggattcaaacccacatctgtcaggtgcaagtgcaaggctccttctcctcatgctcactgcctgctggggaatagggcactggggacataccccagggagcccttcctcatgttctgagtcccagttcatcccatgctgctattttgctctcccaggagcatctggactccctagacagagccccagcttctcacctgtccctctctaaatgctgctctgcaggcctgtgatcctgga

SEQ ID NO: 15123 - DNA, 328 bp, Homo sapiens
ctaccctgccctgtctctaaacttttattattatccctacagaattgcattcaaccttcgctcaaggccgggtgtggtggatcacacctgtgatttcaacactctgtgagcctgaggcggaaggattgcctgatgtcctgattctcactgtctgctggacaatatagcaatactccctgtgtcccagaagcccttcctcatgatctgagtccccgttcatcccatgcttttattttgctctgccgggagcatctcgactgcctaaacagagcccccaacttctcacctgtccctctctaaatgctgctctgcaagcctgagatcctgg

SEQ ID NO: 15124 - DNA, 375 bp, Homo sapiens
gcttggctccctgcatcctccacctcccgggttcaagcagatctctgcctcagcctcccgaatagctgggattacaggcgcctgccaccgtgcctggctaattttttgtattttttgtagagacaggctttcaccctcttggccaggctggttttgaactcctgacctcataatacacccaccttggtcctccatagagctgggaagacaggcgtgcaccactgcactctgccaaaaaatattcacttatcagcgcctaatgccatgcggctgttaatccagctattcttgaggatttagtacccggattgcattgagcccaccgggtttagagctgattaaccttgacataatatcatggctctctaagggggg

SEQ ID NO: 15125 - DNA, 346 bp, Homo sapiens
  misc_feature 346: n = A,T,C or G
cccaaagtgctgagattacaagcgtgagccactgtgcctggccttttttgttttgatctttgtttttgtgagaccctctcagtccgttacccaggctggagtgcagaggcacaaccatgaccatagcttacctatgggctcctaagctcaagagatgctcctgccttagccacctacccaccaagtggctgggactacaggcatgcgccaccactcctggataattttagcatttttttgtggaaaaggagctgcatggtcaggagcataggctaaggcctggcaccccaacgctttggaaggccaaggcagatagatcacctgaggtcattagatgaagaccaan

SEQ ID NO: 15126 - DNA, 343 bp, Homo sapiens
tgacagaagggtaactgattactgctcagcaaaaaatgatgcagaccaaaagacaataagaagaaatctttaaaatactgtaagaaaattactgttcacctagaattttatacccagttaatatatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacatgaaaatacaaaaggaaatgaacagtgacaaggataaatgaatactgagtttacaaacagtgaatgtaatgtcctgtggg

SEQ ID NO: 15127 - DNA, 355 bp, Homo sapiens
aaggaacaaaagatatacaagacaacaggaaaacaacaaaatggtggatgttaagtcctcacttatcaataataaccttggctgtaaacagactaaattcccaactgaaaagatatagactagctgaatgaattaaaaaaaaaaaaaaacctaggtatatgctgcctaaaaaaaactcttttcccctaaaaagacccttttgaaataaaaataggggagggaaaaaaaatccttccaatgggaacccaaaagcaggggaaaatagctttccttatttcaggtaaagcaaactttaaaccaaaaagaaacagggtttttttcatttccccagaaaaatgtaccattggtaaacatc

SEQ ID NO: 15128 - DNA, 315 bp, Homo sapiens
ctgtaggacaatttaaaaaggtaaaatgtatgcataataggaatccaagacagaaaagaaagagagaaggaaacagaatacagatgctcctccacttaagtcctagtaagtccatcctgagtgaaaatactgtcaggcaaaaaggcatagctgactggaagctgaggcttgctgctgcccagcatagcaagagaagtatggtttctactgaatgcatattgcttttgcaccattgtaaagctgaaaaatcattaaaatagtagtcgaagaaaaaatggctgaaaacttttcaacatttacgacagacaccaaatg

SEQ ID NO: 15129 - DNA, 310 bp, Homo sapiens
tttttaagtgtacgatgaaattcacctgtgaagctacatttgtctagagttttctctggggagaagtttttaaattatcgctcagtttcgtatatagaattctctctaattttatttccttagcctgttttggtaggttattgttttcccagcatttgtccatttaatctaagtttgcgaatgtcttggcatcagattattcacaatatcactttaccattctaatgtctacaggggcattccctttttattccttacattattttcttggtgccttctccctttgtttcttttgattagtctcaccagg

SEQ ID NO: 15130 - DNA, 400 bp, Homo sapiens
cgttgctgtcgaacaactgcctcaggatatactctttttaatcagtattgtaactaaccttggcttattttacttttagacttggggttctattttgctttaaaacatgtacatcagttttgttttttgttttgatcttttctttcctttttttttttttttttaaaaaaaagggatttccctttgcccccccattttttaaaagtggggggggccccaattttgccctaactgcagccttgacctttaagcctaagggaaccctcccccctcaccctccaatataggggggactataggaccccccccccacccggggtaaattttggtttttcctgaaaaaccaaagtttccccttgtggtgaagctgggattgaacccccggggacaaaccaccccg

SEQ ID NO: 15131 - DNA, 360 bp, Homo sapiens
attccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattctcattccaaagtacaattggattttggccctctgatgc

SEQ ID NO: 15132 - DNA, 366 bp, Homo sapiens
cacatacgcatacctaacacatgtgcacacacgatcctgtccccatcttcctctccctggatcctccgagcatgcacactgacacagttgcacacatgcatgattgtgcatacacacacgtattcacaggcacacatccatacacacctacaagcacagaagcatgcacacaccacatgcatgcatactcacacaaaagtgcacgcatgcatataccacttatatacacaggcacacacccgtacacacccacatgcacacatgctcgtacacaagtgcacacatgcatatgccatacaattgtgcgtgcacacacacacatatatatacgaatatcccatgcatccacatgcacacatgggtacg

SEQ ID NO: 15133 - DNA, 394 bp, Homo sapiens
  misc_feature 388: n = A,T,C or G
ggcacgagggcagtacatgtacgatgattaggttgcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtcagaagccaatgacctggccctgaggctggctcgccactacacgggacaccaggacgtggtggtattagatcatgcgtatcacggccacctgagctccctgattgacatcagtccctacaagttccgcaacctggatggccagaaggagtgggtncacggg

SEQ ID NO: 15134 - DNA, 235 bp, Homo sapiens
agatggagagggaaagcatttggaagacagaaactgaatacacaaattgcaaatatttgaaatgaacaagaggtcatttcctacaaattataaatgttaaaatgataagggactattatgagcaaccatatgccaataaatttgtcaatttagctgtaatagaatatttggccgggcgcggtggctcacgcctgtaatcccagcactttgggaggccgaggcgggcggatcacgg

SEQ ID NO: 15135 - DNA, 235 bp, Homo sapiens
  misc_feature 93, 94, 95: n = A,T,C or G
acgacagaagggaccgcgcccggccgagagttgactcttcagattcacaaggtccacagagaaacactcagaggaaaaatcaaaccaaacctnnnaaaaaaaaaaaaaaaaaaaaaaggggggggggtttttttcggaaaccccaactgggaaaaaacctttggggggttggggccaccccccctttggggggggggaaaaaaaggttttttttgggaaatttggggggcttttt

SEQ ID NO: 15136 - DNA, 320 bp, Homo sapiens
cggggattataatattcaatcaacgttatgaatgaaaagtgtattttgccttatactttcaacacacaacttactaacctaatatattcacttattaatcagataattttgtgttaaaacttacaactcttattttcattggactttgattgattaattatacatttgacaaattaaaatctcaaacatttatgcactgttcacaaacttaaactgtcttaaacatataaagacacaaaacttatatatctagcaaatttaattctctgaaatttttgttttgttttgttgagacagggtcttgctttgtcacccaggcg

SEQ ID NO: 15137 - DNA, 229 bp, Homo sapiens
tacggcctttgcattttctgttttctctgcctggacgtgctgtgcgcccatatactcacttggcttaccctcttgcctccttcaggtcactgctcaagtgtcttcttaccagagatgccttccttgactactgtctataaaatagtaaatgcggccgggcgcggtggctcacgcctgtagtcccagcactttgggaggccaaggcgggtggatcacgaggtcaggaaat

SEQ ID NO: 15138 - DNA, 417 bp, Homo sapiens
  misc_feature 417: n = A,T,C or G
gcctacggctttcgttaaaacgacacaaagggcgggatctcggctcactgcaagctccgcctcccgggttcacgccattctactgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagagctgggattacaggcgtgagccaccacgcccggccggagtaattttacaaaagagacttgttagtaactacctcatccaggttatcaaattaacatcaacagtgattaaagccaggtgataccctgtgcccgggatattatgtgatgagaatggcacatttcctttgagatcttcctcccn

SEQ ID NO: 15139 - DNA, 342 bp, Homo sapiens
ggctaacttttttgtatttttagtagagatggggtttcactgtgttagccaggatggtctcgatctcctgaccttgtgatccacctgcctcggcctcccaaagtgctgggattacaggcatgagccaccacacccgacctcccttacattcttaaaaattatggagaaccccaaagacctttgctttatgtgggttctatctattaatatttaccaaattaatattaaagccgagagaaatttaagtattttcttactaatttttaaacaataaattttaatataatgaaccctttacaagctaaagtaagacggagtctcgctctgtcgcccaagctggaa

SEQ ID NO: 15140 - DNA, 353 bp, Homo sapiens
aatcttggctcactgaaagctctgtcctctgggttcaagtgattcacatgcctcaaccccccgcgccctgcctcaaggtagctgggattacgggcgcccaacaccacacccagctaatttttgtatttttagtacagatgaggtctcaccatgtcggtcatgctggtactaaactcctgaactcatgcgtggaaactaatttaactttcctcctggatgacctttgggtttactaattatattagcggcatcatcacaaagctgtttttatctttatgaaaattttagacaccatgtttctttaaactccttctacattggaggcatgaggatacaattatccaaaaaatggt

SEQ ID NO: 15141 - DNA, 402 bp, Homo sapiens
cgttgctgtcgttcagggggaaattgaaagatatatattttagtcgatttttcaaaaggggaaaaaagtccaggtcagcataagtcattttgtgtatttcactgaagttataaggcttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagaacagcataacgaagcgggaaa

SEQ ID NO: 15142 - DNA, 324 bp, Homo sapiens
  misc_feature 235: n = A,T,C or G
gaagagagagaagagaatgagagagagacagagaaggagaaagaaagagaataagggggagacagagacagagagaggaagaaagacagagaaggaggaagagagaggaagagaggcgggaaggggggagagagaagaagagaatgagagagagacagagagggaagaaggaagagagggaggaagagagaggaagagaggcaggaagagggggagagagaacaccgatgaaganaggaataaaggaatagaggaagggagaaagaaagatctaggaagagagagggaggaagactgacaatatgacagcatgggcaagagagt

SEQ ID NO: 15143 - DNA, 306 bp, Homo sapiens
cgcccagctagttttttatgtttagtagagacagggtttcgccatgctgcccagggtgggatcaaactcctgagctcaggcaatccacctgccttggcctccccatagtgctaggattgcaggcatgagctactgtgcccagcctactgctctttcttctgtttacagaggaactgcaggtgctagggatacctggatgaatgaaatacagccctgccccacagtattttgtggtctggtggcaatgaccgacctgttacagaggcactttaatagagactgctatgtgtcaaagcacagctgtgg

SEQ ID NO: 15144 - DNA, 282 bp, Homo sapiens
ggaatagcttcctatacccccaaagtcctattcaggtcttggggtacacactgcccagtgggcctctttcttatcatctcagttagaatccttttctccctctatatattttgcaactttaacagttcagttttttggcaatatattgaacatatttaaagtatacaaatttatcagttttgatatctgtaaacatcccatgaaactatcactacaatcaagaaaaacatattcttagccaggtgtggtagctcacacaggtaatcccaacactttatgagg

SEQ ID NO: 15145 - DNA, 305 bp, Homo sapiens
gatgctatgtaagacaaccattgcagagacacaaagtaatcagattcttgaaggtcaatgcaaaagaaaaaaatattaaaggcagttaacgacaaggggcaggtcacataaagtggaaactacatcaaactcacaggggaactctcagcaatatcccacagtcagaagacattaagaatccatattcagcatttttgaaaaaataaaattttgaaccaagaattttatgtcccaccaaactaagcttcataaacaagggagaaataaaatccatttcagataagcaaaagctaggggaatttatg

SEQ ID NO: 15146 - DNA, 365 bp, Homo sapiens
ttgaaaggataaacaaaactgataaactgctagtctaatcaagaaaaaaaaactccaataaataaaatagacaacaataaagttacactgcaacttatacaactgaaatacagaagatcataagggattattatgagcaactatatactaacaaactggaaacctagaagaaatagataaattcctggatacatacaatctaccaagattgaatcaggatgaaacagtaaatctgaaaagaccaataaagagcagtaagactgaataagtaataaaacatctgccaacaaagaaaagttgaggacttaatggctccactgccaaattctatcaaatgggtaaagaactaacccatatttccctaa

SEQ ID NO: 15147 - DNA, 146 bp, Homo sapiens
tgtcgcctgggagacgacgaccgatggggctttgttgttgagacaggggttctcattgccctgggtgggctacatctcctgatctctagctacccacctgccttgggctccccaagggctggggattcccgattgaggcccaccgg

SEQ ID NO: 15148 - DNA, 329 bp, Homo sapiens
cagtctctactaaaagacagaaacaatacactgccaaaatgttaagttgaccaccgtgaaacttctctattggagtgtctgtttctttaagctgtgaatactgaaattatgccttgtctcctccccaccccagggggatgccgttttgcagtgtggacacgtgtttgaagcagttactaaactcgtcatcctggttaagaaggagaacattgtcaatgttgttcaaggaaggtaggtggcttcatcttcagctcaagaagtaattcaatgttaaaattgttattaaggccgaacgtggtggctcatgcctataatcccaggactttggg

SEQ ID NO: 15149 - DNA, 406 bp, Homo sapiens
cgttgctgtcggaaggagagaagcgatatcttgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtgggccgggggggggcacccctgaaatcccactttgtctggaggttaaaggggaaggataacttgaccccaggggggtaagggatgcgggggcccttggtctccccctggccttttaccctgggggaaaaaaaagaaacccccgctcaaaaaaaaaaaaaaagtgaataatttgga

SEQ ID NO: 15150 - DNA, 405 bp, Homo sapiens
gatcccatcgattcgcattccgttgctgtcggagctccttatctgtctgagaatggggaccagctctgagtggggttgctgcctgtattccctgtttctcaggaacttacatgggtctggggaggctaggtaggtgattgtacgtggttgctcttctccttggctgggggaggtaatgagcagatctctgtgggtgtggagcttgttggggggatgtctaggaagcttcagcttagccacattcccaagtttaggtgcactgagccatatagcccagtgtatgcatgtgtgggtgtgttcatgcacacacacactctctctcttgtctctctgtctctctctcactcttactttcttactctcttctcaggtcacttgtacacttggtttcctagtagaagctca

SEQ ID NO: 15151 - DNA, 348 bp, Homo sapiens
aggtgatccacccacctcagcctcccaaagtgctagaattacaggcctgagccaccatgcctggcaatttggtttctttcaaaatagagcctgagataagaattttgggtgcaggtagtttatttgggaggtgatcccaggaagcagaagtgagcagacagagagaatgagataaggaaggaacaacagcagtataagaatgctttctagaggattcttctgagggcactgtgagttaaattctgccataatctcttaagaaccacagagaggccaggcgtggtggctcactcctgtaatcccagcactttgggaggccgaggcaggcggatcacgaggtcaggagag

SEQ ID NO: 15152 - DNA, 378 bp, Homo sapiens
tactgcttttagaaaacgacagaaaggtccactaagggcgggatccatccactaaccaacccacccatccattcatcaattgtccatctactacttcatccaccaatctctccatccatccgtcttccatccattcacctacctatttatcaatctatgaaccagctcatctaccactctctccaccagcctaccagatattaacatattaactaatccatccaaccatctatacttccatcattcatccaccaacccatccataatccttccatccatccaccatctatacatttccagccacttaaccaccaatgaacccattcactaatccattaaactattcatctatgtatccctccaccaacccacccatcc

SEQ ID NO: 15153 - DNA, 341 bp, Homo sapiens
agactcccaagtagctgggactacaggcacagtcaccatgcccggctaatttttgtatttttagtagagacagagtttcaccatgttggccaggctggtctcttgacctcgtgatccgccagcctcagcctcccaaagtgctgggattacaggcgtgagccaccgctcctggcctattggtattttggggggccaaggcttgtttttgtgcccaagctggagtggagtgcgacactctgtgctcactgcagcttccgcccactgtgtttaagatggaccttgcgcctcaccctgcccagtaactggagactatttttgcattgcaagcgagaccactgtat

SEQ ID NO: 15154 - DNA, 358 bp, Homo sapiens
cacatacacatacctcacacatgtgcacacacgaccctgtccccatcttcctctccctggttcccccgtgcatgcacactgacacagttgcacacatgcatgattgtgcatacacacacgtatccacaggcacacatccatacacacctacaagcacagaagcatgcacacaccacatgcatgcatactcacacaaaagtgcacgcatgcatataccacttatatacacaggcacacacccgtacacacccacatgcacacatgctcgtacacaagtgcacacatgcatatgccatacaattgtgcgtgcacacacacacatatatatacaaatatcccatgcatccacatgcacaca

SEQ ID NO: 15155 - DNA, 138 bp, Homo sapiens
ctgactggaattaattaaactaacctttctttgccttactacgtgcttaccacagtgaaagtaccctccctagccaggcggggtgacttatgcttataatcccatcactttgactgactgaggcaggtgaatcacctg

SEQ ID NO: 15156 - DNA, 317 bp, Homo sapiens
agttgtttcttttatcaaagagaggtgctagaggcctctgcaaaaaaattttcatttatgtctcacatggccacaccttggtatagagaaaactgggaaagccaatccagtacttagctttccaggctctatgatggcaattgtcaaggagagggttagaaatgtgtgttggggcaggacacggtggctcatgtctgtaatcccagcgctttgggaggccaaggcaggtgggtcacctgaggggaggagggtctcaatctcttgaccctatgatctgacaccttcggtctcccaaagagctaggactacgggcatgg

SEQ ID NO: 15157 - DNA, 81 bp, Homo sapiens
acgacagaagggtgcggctgctagaatacgaccgaggggtcatcttttaatagcaagaatcatattttttttccagtaccc

SEQ ID NO: 15158 - DNA, 386 bp, Homo sapiens
gagcaagactccatctcatagggaaaaaaaaaaaaaaaaagccgggcccggggacttaaaccttgaatcccaggcttttgggagggccggggggggggtacaaaaggccaggaattcaaaacccccccggttttaggggaaccccccttttttaaaaaaaaacaaaaattaattgggggggggggggggcccctggaaacccaatttcttgggggggtgggggcaaaaaaatctttaaaccccaggggggggggttccaagagcccaaaattccccccattgtccccaattggggggaaaaaacaaaaattttttttaaaaaaaaaaaaaaaaaaaaaccggggggggggcggtttaacaaaaaaagaaaattccccacggcccgg

SEQ ID NO: 15159 - DNA, 122 bp, Homo sapiens
atcaactgctatgacggttcacaatgtcagtataccagaaggaatagaaaactgatactgttttaaataatctgtcattgtacctttttttttttgctgaactacattctatgggacgtggg

SEQ ID NO: 15160 - DNA, 383 bp, Homo sapiens
  misc_feature 158, 383: n = A,T,C or G
cgttgctgtcgaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatanaacactgatggattccaaccttcctttttttaaattttctccagtccctgggagcaagttgcagtctttttttttttttcccccttggccccccccccccttgttttgggggccttttttctttcccccgggctccccattttttgggggggaaactccttgggccccaccccctggggaaaaaaccctcccccctttttggtcagaccccatctttttcccccn

SEQ ID NO: 15161 - DNA, 335 bp, Homo sapiens
ggagatgcttttccttctgcatgttaactcacaactcattcctaatcatggtggctctaatccaactgactaaaatgcttttctccccaaggaactaacgtagttacttgagagaagagtttaatccagcttctcctgcgtggcaaagggttttttttcatcagagggtagctgacttcaataagggcatttacaacatcccaagggcttattttcatttaagaaatttggccgggcgcggtggctcacgcctgtaatcccagcactttgggaggccgaggcgggtggatcatgaggtcaggtgatcgagaccatcctggctaacaaggtgaaat

SEQ ID NO: 15162 - DNA, 337 bp, Homo sapiens
  misc_feature 337: n = A,T,C or G
cggggacggctccgagaagactacagatgggaatagtattggtaaaaccgtgataaaatcaaattgttttctgatagaatatcactttaccatgtaatcaatttatgaatcttctccctacaacactatttaataattactcttataaaaatatgctttgaagtatccaaacctaaagttaaaatgagtcatggaattgtaatggcaatagaaaaattacaatcacattatcagcaaaagctgacagtttgactccctctttaccaatctggatgtccagacagtaactgctgtcttcaagagactcacctaacacataaggaatcacataaacttn

SEQ ID NO: 15163 - DNA, 312 bp, Homo sapiens
gaaactgagtctcagagagacaaggtaactggctaataagttcgaacactgtttttcccaagactatttgactcaaaatacagaggaagtttggtgtgtgtgtgtgtgtgtgtgtgtgtgtgtgtgtgtgcgcgctttcatatttactatatagtagagctctttaaataactctctgagacagaatgaaaatatacacgtgttggggtgcgcgcagtggctcacgcaattctcccctctctgtgggaggccacgctgggtggatcacctggggccgagagtgagacaccactctggcccgtggggagacct

SEQ ID NO: 15164 - DNA, 325 bp, Homo sapiens
aatgtaaaacataaaaatataaaacttccagaaaacggcacaagagaaaatctagatgaatttggatttgtcaatgactttttagatatggcatcaaaggcaagatctaggaaataaaaagttaataaaatggactttgttaaaataaaaactatatgctacatgatagacgtctagcgaatgaatagacaaacacgggctgagagaaaatatttgtaaaagatctacttgataaaggactgttatgcaagtatataaagaaccctaaaatctcaacagcaaaaaaaaatctgattagaaattgtgtcagagactttcacaaacg

SEQ ID NO: 15165 - DNA, 394 bp, Homo sapiens
cgttgctgtcgggcaaaactcaacagcccctggagctgcgcttgtggtggagctggaccctgattttagctggaccttgtttttagagacagggtttccttctgcagtctcaatctcctagccttgattgatcctcctgccttggcctcccaaagtgctgggactacaggtgcatgcaaccacacctggctaattttcttctcttctttcttttctttttttttttttggagggaaacttgtttgggggcccaagtggggagaaaagggggccattctggtttattggaaccttggcccccgggggtaaaacaatttttcgggctaaaccccccaaggaggtgggaaaaaggggggggcccacccgcccgggataatttttgaattttaaagag

SEQ ID NO: 15166 - DNA, 340 bp, Homo sapiens
cagaccattcgtgacatgcttggactttttggtttgttctgaacatctttctttcttatacaaccactcattttattcttggtctaaatttaccatacaagattatttttcatacaaaattatttctcatttgggcatagtggctcatgcctgtaatcccagcactttgggaggtcaaggctagtatgtcacctcaggtcaggagttcgagaccagcctggccaacatggcaaaaccccatctctactttaaatacaaaaattagccgggcatggtggcaggcacctattattccagctactcaggaggctgaggcaggataatcacttgaaccctgctg

SEQ ID NO: 15167 - DNA, 321 bp, Homo sapiens
tcctcacctttgagacttcaaagataggccagatgtaggaacaaaacggctgattagaagcagctgcagtccgcagcactcacaaagagaaatgaaaaggggtgagtgaattcagcaccttcaatggaaatatccatgttcttgcattgggaataactaggtgaacaacttgacccatggaaaataaagaaaaggaggggggtgacaaaccacccaggagtggcacagagcccaaggaaccaccaccccaagccaagggaagtggtgagtgatagtgtgaccccactctgttaccaatgaacaagctaacctcatgatgag

SEQ ID NO: 15168 - DNA, 129 bp, Homo sapiens
gaaagttcagcatcacttattatttggcagtgcctctcatgcaatttaacacatcaaataaggctaattagtttaactttcctcttggtaccaggagaaaaaattaattcttttgacctatttcatggg

SEQ ID NO: 15169 - DNA, 351 bp, Homo sapiens
ccagtggtgaatgagacagacctattcctcacctttgagacttcaaagataggccagatgtaggaacaaaacggctgattagaagcagctgcagtccgcagcactcacaaagagaaatgaaaaggggtgagtgaattcagcaccttcaatggaaatatccatgttcttgcattgggaataactaggtgaacaacttgacccatggaaaataaagaaaaggaggggggtgacaaaccacccaggagtggcacagagcccaaggaaccaccaccccaagccaagggaagtggtgagtgatagtgtgaccccactctgttacaaagtaacaagctaacctcatgatgacaggag

SEQ ID NO: 15170 - DNA, 138 bp, Homo sapiens
ggaagatttagcattttttttcattgccctctcagtacctaattctgtaaatagaagttttttcctgtattttcttctaagagttttatagttttagctcttaatgtttaggtgtttgatcctcaaaaggtatttatt

SEQ ID NO: 15171 - DNA, 334 bp, Homo sapiens
tatgcataagacaaccatggtgcactgcagccactaactcctggcctcaagtgatcctcacacctcagtagtcccatagttgggactctagggtgtgctaccacacacgacttaagatttatatttttaaaaaaactggaggtataactatataaagtgcaaaaatcttacatatacaacccaaatttagacacatagaaactatatgaatatatatgtaaccattatcaatataaaatatttttaaaataaaattaattcaaaatattatattctaacacactgccttatggttagataccataaggcatgtaaaaagttactacagataaag

SEQ ID NO: 15172 - DNA, 418 bp, Homo sapiens
cgttgctgtcgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttc

SEQ ID NO: 15173 - DNA, 444 bp, Homo sapiens
ggcacgaggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagataacatccccaaagaagaaaaacataggcgagaagaggaagctatgaagcagataacccagctcctaccagaggacctcagaaaggagctctatgaactttgggaagagtacgagacccaatctagtgcagaagccaaatttgtgaagcagctagaccg

SEQ ID NO: 15174 - DNA, 391 bp, Homo sapiens
accatgttaggcaggatggtctcgaactcctgaccttgtgatccacccacctcggcctcccaaagtgctgggattacgggcgtgagccaccgcgcccggcccctgacttccatccttaacaggagaagctacaaacacacattgtaaaagtgcatgaatataaggagaagtgaggcatggtggccatctttgccatctaccacattagtagaagagaaaaaataaaataaaataaaataataaaaaacttgatggatccttaaactgtaagaaagaaggaataaatgaaccacagaatgatgaaacaaatagaaaacaaatagtaatatggtagatgtcaacccacatatatcagtaattacattaaatgtagatggactaaagtcaaaga

SEQ ID NO: 15175 - DNA, 344 bp, Homo sapiens
ctcacgcctgtaatcccagcactttgggaggccaaggtgggcagatcacttgaggtcaggagttgagtccagcctggccaacatgacgaaaccccatctctaccaaaaaatacaaaaattagatgggcttggtggcatgtgccttgtagtctcacatacttgggaggctgaagtgggagaatcacttgaggccacaggaagtgggggagtaccactgcactacagcctgggggacagagtgaaacccaaaaataaatagacaatgatgctcagccatgactgtttcaacacagacatatttgctctttaaagaaaaaaacccttcatgaatattcatccttttc

SEQ ID NO: 15176 - DNA, 263 bp, Homo sapiens
  misc_feature 263: n = A,T,C or G
tcaatatctttagccattagagaaatacaaattaaatgagatgccattccacacctactagaataaatacaattaaaaatactcatcatcttttgtgttggtgatgatttagaacaactgtaattctcaaatactgatggtaggaaagtaaaatgatacagccactctgggaaaaaaaaaatggactgtttcttacaaagttaaatagacccccatcattttacctacttattctactgttgctctttaagcagaaaacagan

SEQ ID NO: 15177 - DNA, 368 bp, Homo sapiens
cacttaaagaaatgagaaaaagaattacaaactaagcccaaaataagcatataaaggcaataataagactagagtagaaataaataaaatagagaattaaaaaaaaaaaaaaggcaaaccgggaacggggggagggggctaatttttgaattcccaccattttgggaggccaaggaaggcggacaacaaggccaaaaaatcaaaaccttccttgccaacaggaagaacccctttctttattaaaaaaaaaaaaataacttggccccgggggggcaggcttgaagggccacttactcggggggctgaaacagaaaatttgttggaacccaaaagggggggttggaggggccctaatgggggcaatggag

SEQ ID NO: 15178 - DNA, 408 bp, Homo sapiens
cgttgctgtcgcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccac

SEQ ID NO: 15179 - DNA, 311 bp, Homo sapiens
  misc_feature 311: n = A,T,C or G
caacacgagaagtaatgcaggtactttaaggagctaagagggaaacagaaatctcagccctataacaaggaactgtatgagcatagaaacattctcctcctcccccagtaactttatcaaaactcttaaaaatttcccctctttggcacaaacatatggacacctttctcactccagagtaaaggaatgatgtactaaaatgaaggatttataccgggtggggtggctcatgcctgtaatcactttgagaggctcaggtgggcggattgcttgagctcaggagatcgatcagcctgggcaacatggtgaan

SEQ ID NO: 15180 - DNA, 324 bp, Homo sapiens
agataaaaattaaaacataaaattaaaaaatttttgaaaacgatgttttcagacatacaaaactgaaaggaatcatcaccagtagacctgcactacaagaactgttaaaggaaattcttcaggcagaaaggtaattgtaccaaataaaaatatgatcccacaagagaaagaaagagcatccaaatcggtaaagaggaagtcatactgtcactgtttgccgatgatatgatctttgacaaagcaaacaaaaacataaagtggggaaagcacaccctattcaacaaatggtgctgggataattggcaagccacatgtaggagaatg

SEQ ID NO: 15181 - DNA, 364 bp, Homo sapiens
gttgatgggaatgtgaaatagacatcctatctaaagggcatcttgagtatatctaaatttaaaacacacgtaccgtttgacctaataatcccacttttttttttcttttgagactgagtctcactctgtggcccaggctaaagggcagcagcttaatctcggctcactgcaacctctgcctcctgggatcaagagattctctgggcctcaaccttccaaggagctggaattacagaggcccgcctccccacccgactgatttttggatttttagtaaacaccttttggacacctggaaatccaacgcaaacgtcatatatttatatccactctttcacaaaaacttttctttcttttttgttgg

SEQ ID NO: 15182 - DNA, 382 bp, Homo sapiens
cgttgctgtcggggcattataagtaattaaagatgatttaagtatatggaaagatgtatataggttatatgcaagtactgtgccattttatataaagcacttgaacatcacagattttggtatcaatgaggggtgctgaaaccaattgcccatggataccaagagacagctatatttgtttcaatgtgtacctctccttctaaactcagttcttaagcatatagtatctttatagctatacacctagtgtctatcagaccctaaactatggtaggccctcaatacattttattgttataggtagatagataggcatgagtagggcaggagagggctctccctccacccactagaaatgtcaagtgatgttttaaaaattgtg

SEQ ID NO: 15183 - DNA, 351 bp, Homo sapiens
aaccaatgtttccaactgcatcctgttataaagagagagcaaattttattaaacttatgtaaataattcttgccataaaaaataagaatactcatggatagtttctgaattttagaggaatcaaatagggacaaaaaaaatgtttccacctttgttcacaaagtataccaaattactgtaaactaataagtagcttaagagaaagaaaaggtttccttaaagctagaaaacaaaatatttaaataaagaacctggctaggcatggtggctcatgcctgtaatcccagcactttgggaggccgaggtgagcaaatcacctgaggtcaggggttcgagaccagcctggccaac

SEQ ID NO: 15184 - DNA, 394 bp, Homo sapiens
  misc_feature 289, 394: n = A,T,C or G
ttttgccttcagaagcttccctgaaaatcacgaataggaggcagataaatagtagaaaaggcatacaggtttctgcaatgtgtgtacaccggagacgttagaactaagacccagacacacgatgcgtgcagaagcttatctaccacatgaagtttacagaaagaatggggtcttggatcacagggaaaaaataaaggttatgtgagaaaacgaccctggctagcaacagtggacttattgcataggtggaatctcactaggagcagtcctcagagagaataaacagaanatgtttctttcagacctttggagacctcagactctcatttaagctttcctagatccagacaaaggggcagacctcagagaaagcctggctgcatcaaggcagatn

SEQ ID NO: 15185 - DNA, 369 bp, Homo sapiens
tacggctgctagaagactacagaagggtacggctgctagaagaccacagaagggaatgatattattagatcactgaagcagaaaattagcaaagatatttaggacctgaaatcagcactgaaatcagacagaaaacactcctcaacaaatgcaaaaaaaaaaaaaaaaccggaatttttaacaccccttttaaaaccacaccccattcaatttaaaactcaaaacggacaagccctttaaaaatcttccctttaaaaaaatttggaaaaactggctcctgaaggacttggggaaaatatggattttaaggcaaaatccaaaaatttttttgaatttattaaaaataaggggccaacttcacaaaatttt

SEQ ID NO: 15186 - DNA, 363 bp, Homo sapiens
  misc_feature 165: n = A,T,C or G
cggttgcataggcaaagggagattaaaaaacaatctgctcattgctcctgagctattggaattttctccttaactaaggtatgagctcctggagctcttaaatgtctatgccaaggtctcaagccagaagccacagctacaatccggcctggagataggtgtggntttgacgtgcacactgtacaaacaaaacaatatccattgtttcaaagatcagatttcacataaaaatgtggattatcacaatttcttttctttgcttttaacttttagagacaggcttgatatgttgctcacgctgatcttgaaatcctgggctctagtgatccttctgctttatcctcccaagcaggtttgttttac

SEQ ID NO: 15187 - DNA, 311 bp, Homo sapiens
atacacatgacatttttttttcttttttttttttttggggggggaatcctccttttgcccccaagctggagggaaaggggcccaattcggttaacttccaggccccccttccgggtttaacacatttttctggctaaaccctccaatggagcggaaataaggggcccccgcaccaaccccaagatattttttaaaaattttaaaaaaaaaaggggtttaccccgtttaacccgggagggttagactctcggaaccagggaattaccccccttggccccccaaaggggggggaatcacggattagccccctt

SEQ ID NO: 15188 - DNA, 319 bp, Homo sapiens
gaagacttacttaccctaagtatatatgcacccaacattggagctcccaggtttataaaacaattacttctaaacccaggaagagacttagtcacacaacaacagtgaggaacttcaataccccactgacagcattagacagatcatcaagttataaaactaacaaagaaattctggacttaaaaattgaacacttaaccaataggaccttataaatatattaagaatatttcaccccaacaccacagaatataaaataatcttatctgcacatgaaaacgactctaagatcaaccacataatcattcataaaaaaggc

SEQ ID NO: 15189 - DNA, 405 bp, Homo sapiens
cgttgctgtcggaacagaatagagagccccaaaataggcttacatgaatatggcccactctctctgacaaaagaacatgacagttcaagggaggaaggataatcttttcagcaagtggcgctggaataatgggacatcgacatgcaaaaaaaaagaatctagacccatccttaccccttaacttaaaatgttaaaatagattcttttttccttcgacctagagcccttgacaaaatggatcttaaacctaaatgtaaaacccaaacactataaaactcctagaagacaacataggagaacatctaggtgaccttgagtttggtgatgaggttttagatacacaaaaagcataatccatgaaagaaataaattggacttaaatgaatttaaaacttctggaagcag

SEQ ID NO: 15190 - DNA, 366 bp, Homo sapiens
gagtgtttgcagagacgtgaagccaaaactaatagaactgaggaaaaatagacaaattcacaatacagttggagccttcagaacttctccctcagtaataaatagaagtagacagaaaaatagcaaggatatagatgaagtgaacatcaccatcaaccaactgaaatgctatagagcctcacacccccaaacagcacaatacacattcttttaaaccacagatggaacattcaccagcacagaccatattctgaatcagaaaacttaaatttataagaattgaaagcatgcaaagtatgatctgacaataatgaaatcgacatagagaaatgctagggtctgaggatgtgagaagatacagtctat

SEQ ID NO: 15191 - DNA, 248 bp, Homo sapiens
aagataaaatttgaaatctggttaggctggtgttagggttctttgtttttggggtttggaagagatgtgttaaatgttatgtttttaaaatagtatttttgattattttgtttgcatgtggttaatttagtttaattttggtgcggtcctggcatattgtcatttttttcttatggttctatggaagacttgcccatttttccaccgtttgttggtaacgctctggtttgtgttatcctatgattcag

SEQ ID NO: 15192 - DNA, 354 bp, Homo sapiens
gtggttgtttaaaagggtattgtttcattttcacgtatttgtgaatttgccagtattccttctgttattaatttctaggtttattccattgtaatcagaaaaatggtttgcatgatttcggctttttaatatgtattaagacttgttttgtagccaacatatggcctatcctggagaatgtttcatgtatacttgaaaaaaatttgttgttatacggagtattctgttggctctaattggccttcaaaccctttggtttctgttgataatatatctcagcacactattcataattggaagtggtgtactaaaatctccgactgtttatcctatgaaaaagacactttcacatgg

SEQ ID NO: 15193 - DNA, 347 bp, Homo sapiens
tgagtagctacaaaagagaccttatggcctgcaaaggctaacatatttactatctggccctgtacagaaaaagtttactggcccctcctctaaggcatgatttattattggatcgttcccagcatggagcacttcctgcccttgcctgcttcagctcctcttcctaacactgctgtagaatagaggaaactgagccatgaaaagactatttcaaagtctcagagagagtgggattagagttccatagggcccctgagtctgtgacattcccctcaagcctggggtgagatgctggcgatatccagcccttagagaacaagcggtggaatggaagggaggaaaatcat

SEQ ID NO: 15194 - DNA, 342 bp, Homo sapiens
tttgtgagtttttaatcaaatatgtatgtcattgttcttcattttatttatgcctaaatgcgtcttgtcttcacacatagaaaattttgtcattgatttttttttcactttagtttagaagaaataaaattccttataagaaattgttggccaggtgtactggctcacgcctgtaatcccagcactttgggaggctgagatgggaggatcctttgaactcaggagttcaagaccagcctggataacatagtgagatcccttctctatcaaaaatacaaaaaattatccaggtgtggtgggacgtgcctgtagtcccagctgctcaagaggcggaagtaggac

SEQ ID NO: 15195 - DNA, 313 bp, Homo sapiens
  misc_feature 313: n = A,T,C or G
aggggctggattgattgatatatggaaatgtaatcacagttttccaggaacccaaatctttatctcccctaggagcagcgtttcagaattcacaaataaagtgcttgaggtgactttatagaacataactattgcatataacaagacctaaatgcattcctttctaaatggaaatctaaacacagagtttgaaaatttaggtaacactaaattcccctttcttgtacttcataagtaacgaagtatgaggaaattataaaaggtgtaaaagtgggtttggcattgtgctaccaatgctaatgggaagatgacn

SEQ ID NO: 15196 - DNA, 360 bp, Homo sapiens
gtgggcaaaaggtggtagcatttcccttgagaatcagaagaagacaatgatgcccactctcaccactcctgtccaaaatagtattggaaccctagccaaagaaaccaggtaagagaaagaaataaaaggcatccaaagagaagagaggaaatcaaactatctctggttgcagatgatatgattctatacctagaaaatcaatcatctctgtctgaaagccccttgatctgatttaaaaaaaaaacttcagcagaatttcaagatacaaaaataatgtacaaaatcagtagcattctcatacaccaacaacatccaagctgagagtcaaatcaataatgtaatcccattcacaatagccac

SEQ ID NO: 15197 - DNA, 316 bp, Homo sapiens
cagcacatgaaaggattatacaccatgatcaagtagaatttatctctaggatgcatagatatttcaacataatcaatcaatgtgactcactacattaacagacaacatgataatcccaatatattcagaaaaagtatttgacaaaattccacataggctcatggtttaaaaaaaaatccttcaacaaaatagataaagaacaaacttactgcaacacaataaagaccacttatgaaaagctcacagccaacatcataatcagtgaggtaaacgtttttcctctgagatctagtacaagatgatgttgcccactctc

SEQ ID NO: 15198 - DNA, 361 bp, Homo sapiens
gagttggagaagggggagccctcatgaactggctgctatgaatacaaaatgatgcccttgctgcagaaaacaatttggttgttcctcacagaatgagcattgggtgaaaaatgaaatcaagatggaaatgtaaaaaatttcttcgaactggatgacacaacctatcaagacctttgggatacagcataggcactgctaagagcaaactttgtagtcctaaaaacctacgacaaaaagtctgaaagagcacaaatagacaatctaagttcacttctcagggaactagagaaacaggaacaagccatacccaatcccatcatacacaggaaatacccaagatcagagccgaactaaatgaaat

SEQ ID NO: 15199 - DNA, 358 bp, Homo sapiens
  misc_feature 137, 139, 142, 145, 149: n = A,T,C or G
gccatcatatgttctcatttatttgtgggatctaaaaatcaaaacaattcaactcatggagatagagagtacaagatggttaccagagactgggaagagtagtggggaaattgggggaggtgtgggaggtttttttntnttnttntttntggttgacgagaagaccttatggagcgtttaattattattgcaaggggtacctaaaaaccgataggggtttaaggaacctgcctggggttaatattttccattaggcgatcttctgtggggaaccccaccttccgagcagtcatggctttaattccccaatgtaaggcgaacttctattcctttattggtcggaaaaaattggtcgacg

SEQ ID NO: 15200 - DNA, 338 bp, Homo sapiens
gttatgctatatggcaagggagaattacagttgcagatggaattaatgttgctaatcagttgaccataaaatagggagaccataatatggtcaataggagtttaccataaagctaggttttgtagttgggagggagggtgtagtgtattcagaaatatcctggccgggcacggtggctcacacctgtaatctcagcactttgggaggccaaggcaggcagatcatgaggtcaagagttagagaccagcctgaccaacacggtaaaaccccatctctactaaaaatacataagttagccaggtgtggtggtgcacgcctgtaatcccagctactcagga

SEQ ID NO: 15201 - DNA, 310 bp, Homo sapiens
agaatcgcttgaacctgggaggtggtggaggttgtagtgacccaggatcatgccattgtactccagcctaggtgacaagagcgaggctccatctcaaaaaaaaaaaaaaaaaaaaccaaaccctttggcttttgttggtttttgaaaaaaagtttaattttgtcccccagcctaaagggcagggccgggatgtggcctaattgaaatttgaactccgggcctaaggggatccacccacctaaccctccaaaagggctgggtttatgggcttgacccattgaccccagctggaaacctttaactttttaat

SEQ ID NO: 15202 - DNA, 342 bp, Homo sapiens
  misc_feature 342: n = A,T,C or G
agagggcagggcttacagggctgtcacccttattctccgctgagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggn

SEQ ID NO: 15203 - DNA, 283 bp, Homo sapiens
  misc_feature 283: n = A,T,C or G
atcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttattttattttattttattttattttattttttgagacggagttccactctgtcgccagactggagtgaagn

SEQ ID NO: 15204 - DNA, 383 bp, Homo sapiens
cgttgctgtcgcaaatttcttcctgctcagaccatagtcctaattacttaagaaaaccccttctaactgtgtggatcttttaacgtatggtgcacatgagtgcatggaaatgagagaacctgggtgacagagtgaggcactgtctccaaaaaaaaaagggaaaaaaaaaaaattttttttggcttggatgaagggggggctaaccctttattcccaccctttgggaaatttgaggttgggggatcatttgacctcaggagttggaacccaccctgggcaacacagggaaacccattctttacaaacctttaaaaaaaaatgggccgggccggggggttaacccttgtatttccagcctttgggaaggccaaggcggccggttt

SEQ ID NO: 15205 - DNA, 317 bp, Homo sapiens
  misc_feature 317: n = A,T,C or G
tgtcaccagcggactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgn

SEQ ID NO: 15206 - DNA, 320 bp, Homo sapiens
tgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacag

SEQ ID NO: 15207 - DNA, 386 bp, Homo sapiens
cgttgctgtcggttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccaca

SEQ ID NO: 15208 - DNA, 349 bp, Homo sapiens
gtctacatatacacatatgtctatacttgtgtttggatattgtctacatggtaccaaattgccgtaacaataaatgagtaatcaaaaattaaataaataagcccaaatatttttcaagttcttgtgacttgagtaaatcttttggtaaatatgagtagcttaatatagttggtttaataaaaacaaatgtcttttgacttatcagcaaaatatgcatgtatttaatgttaaggtgattgcttttatgatacttagataacatatgataatattaatagcaaaatggttaatacaaaatttaagctgagatgatggctagatttgtctaacggctcatgaaatttttcca

SEQ ID NO: 15209 - DNA, 341 bp, Homo sapiens
gaatactcgtgaataaactttgcaaaactatttgtaaagtactataaggaattctgagaagttactataagatagaaaagaatataggagcatgcccaagccatatatatgatgtttcacgtaatatgcttggtagacttgtaaaatattttagatgtggtgtaggaataaatctttgatgtaatttgtttttttgtatatgtatatgattttgaaatttgagacagaagctataccatgaaccaggctggaatgcgatggaaccatcttggctcactgttgcctgcagctacctgggtcaagtgattcttctttttttggccttccatggagcatgagat

SEQ ID NO: 15210 - DNA, 342 bp, Homo sapiens
ccctcccaccctctgtttttttcttcttcttctctctcttttttttttttttaaaaaaaagggggcctctggcggggtggcccaggcgggccaacatcccaaattcccaaattcccccgggcctaaggggatcctctaacctaagccgccctttccaattttgaccccacccccagtaaaaataacttgtttggcccgcccaggggggctcaggacggaaaccccaccatttgggggggccggggggggaaaaccactggaccccaggagtttggggccacccgggccaacagggggagacggcctctcctaaaatccaaaaatttccccgggggggggggg

SEQ ID NO: 15211 - DNA, 311 bp, Homo sapiens
cctgtggtgttattgtatacacacatatatatatatgattttgtgcatggttcctgggtcaaactcccatggccgttgtcttttgttagaacagtcttttattagaacagtctagtaaaacagttctaacagtcttttgttagaacactgggtgtgttaggcctcaagaaacggaccctctccagccttattttggcctagtttcacctgcccaaaggcaggtctctaatcttcccctgcctttttgaatgcgggtcataagactgtacccagaggccgaacgcggtggctcatgcctgtaaacctagcac

SEQ ID NO: 15212 - DNA, 327 bp, Homo sapiens
gattataatcaagtgtaggcttcctgaattttgacatccttttagaacttgggtctggaattccagaaatgttaattgctgcttgtatttgttcttgtttgttttttagccagtatttgccctttctatccagccttatgaataatagcagtaaaatcacagtatcttggtcagtctttattttttccttttttcttttttaagagacagtcatccaggccagagtgcagtttgatgatagcttgctgaagcttcccactcctgggctcaagttatccttccattttggcctcctgagtagctagaccataggtatgcatcaccaca

SEQ ID NO: 15213 - DNA, 325 bp, Homo sapiens
  misc_feature 325: n = A,T,C or G
cggtaaggagttttcccacttgaaataaaaaaatgctagacagcaacatgatggcatagaaaagtatgaaactcattggtaaatacaaatatatagacaaatactgaatattactgtaatgatggagggtaacacacttttaattcaactgtacatgttaaaagacaaaattagttaaaataactataaataaatatatggtaaaagatataccatatgaataaatgaacatagtgccaacaataatataaagtgtagggagaaaataagttagagttactggatacaattgaacataagctgttatctgcttaataaggactan

SEQ ID NO: 15214 - DNA, 322 bp, Homo sapiens
attccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccgaaaagttttactggcaactttgtca

SEQ ID NO: 15215 - DNA, 330 bp, Homo sapiens
ggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaa

SEQ ID NO: 15216 - DNA, 384 bp, Homo sapiens
  misc_feature 384: n = A,T,C or G
tacggtttcgagttgacgacagaagggcttaaagacaaggatactttccaagaaatgcttccttacacaattttggcattgtgtgaacatcgaacagtgtgttgacgtaaacctacatggtatagcgtactgtatagtatagatagcccaggggttccttatctctcagccacggtatcagtccatcacctgttaagaaccaggccacacagcagtaggtgatcagcgggcaagctagcagagcttcatctttatttgcagctgctcccattgcttgcattaccgcctgagctccacctcctgtcagatcagcggtagcattagattctcataggagcacaaaccctattgttaactgagcatgggacgtatgtatggacatan

SEQ ID NO: 15217 - DNA, 361 bp, Homo sapiens
tcaaaagaaagttgtaaccctgtgatatgaatccacacaccacagagcagtttcatggataactaaccactttctagttttaactgggaataccccttttttcccttattactcaatgaactgcagaatgtccctttgcatattccaaaaagagtgtttccaacctgctgaaacaaaataatactttaactctctgagctgaatccacatatcacaaaggagtttctcagataggatctttctagtttttggctgaggatatttggtttttcctcataggcctcagagggctcccaaatgtctcctcacagattctaacaaaagagtgtttcaaacttgctgaatcaaaagaacattttag

SEQ ID NO: 15218 - DNA, 393 bp, Homo sapiens
ggcacgaggttgggtagagacggggttttattcgtgttagccaggatggtcttgatctcctgagctcgtgatccgccctcccgcctcggcatctcaaagtgctgggattacaggcgtgagccacggcgcccggacttccttcttttttaagcaaagcctgttagaatggcttggatctcgaggtggcgtcttacccgacctccgagggctctgcagccgctgcgggagaatgaccctgtcggtatttttgaggctgctttgagcgcggccccctgccaagtacccggccatcaaggccctgatgcggccagacccgcgcctcaagagggcggcgctggtgctggtgctggtgcagatgctggcctgctggctggtgcgcgggctggcctgacg

SEQ ID NO: 15219 - DNA, 317 bp, Homo sapiens
  misc_feature 177, 182, 185: n = A,T,C or G
cagcacaccaacatggcacatgtatacatatgtaacaaacctgcacgttatgcacatgtaccctagaacctaaagcataataataaaaaataaataaataaataaaaagaaattaagcctcctttttttttttttttttaaaaaggatttccacttttgtggccaaggctgatgggngtggnccnaaagctatcataaactttagtcccccttctcaacttgaatctttccagaaaaaaccactcccgcttattacccgaaataggagaaaaaagttcaatgggaaaacaaagtggttctttattccttaaaaagag

SEQ ID NO: 15220 - DNA, 350 bp, Homo sapiens
aagggtctcacctgccagagatctgtgcaattaaaaacacccacagctgaaccgttcaggggctggcaatttttttttttttttttttttaaaagggactcgggttttgtggccaaggtgggggggaaaaggggcaatttttgttttttgaacccttaacttccggggttaaaggaaggggcccacttaagtttccggggaagttaaaacaaaggggccacacaaaaaaatcgggcaaattttaaaatttttgggggaaacgggagtttcgttttgttcccaaggtgggtttcaaattcgggggttaagggaaccctccggcttgggtttccaaaagggcggggataaaa

SEQ ID NO: 15221 - DNA, 415 bp, Homo sapiens
ggcacgaggaagagcaaccgagatgattgtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgagatggagtcaattgcttggcaaagcatccagagaagctggctactgtcctttctggggcgtgtgatggagaggttaaaatttggaatctaactcagcggaattgtatccgtacaatacaagcacatgaaggctttgtacgaggaatatgtactctcttttgtgggactttctttttccactggtggggatgacaa

SEQ ID NO: 15222 - DNA, 345 bp, Homo sapiens
gatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggg

SEQ ID NO: 15223 - DNA, 342 bp, Homo sapiens
gccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttataagcatggtaagttaatgagactct

SEQ ID NO: 15224 - DNA, 330 bp, Homo sapiens
aggcgtgctgtgcaaatggcacacctggtccaaccaatcttttgtgccctatgtaaatcagacaccgcctcctcaaactcatttataaaacctgcatttcactgcagaagtggcaatccattttctccagggcccctctctgttcagagagctctttcttttgcctgttaaacttctgctctgaacctcattctttgtgtgccggcgtcctagttttccgtggccatgagaccacgaatctcaggtatttaccccagaccacagtgctgcttcattaccacgttcctgattcctaaaggcccagggcagattgaaccctaagttcagttt

SEQ ID NO: 15225 - DNA, 320 bp, Homo sapiens
caaaggcaaagatgttacagaaaaagagaagaatatagatttatatcctttatgaatattgatgcaaagacgttcaacaaatactcacaaattgaatttaacaatatatcaaaagattatacatgatgatcaaatgagatttattcctggaatgtatggctaattcaacatacaaaaaaacaataaatgtaatacaccacattaacaaaataaaggattaaaaaaagaccatttcaaatactgcagaaaaagcttttgacaaaattcaacactcttgcatggtaaaaacagtcaacaaactaggaatacaaataatgtcc

SEQ ID NO: 15226 - DNA, 323 bp, Homo sapiens
ggctgctctctggccactagagccaggcagtcacctagctgctgttatgctgcatacctgtctctgagtactcgcttcatccatcggccagggtctgtgggacagaccaggcaggtggtgccccatgtgaggaacgctgcaatggattgcaagggaacccctgaaaacaaatgtgaagtgactgagcagtgttaaccttagaagactagaacctaatgagttatggcaaacagatgttatgcacgtccctgaatttggaaaactaaaggcctctttggattccagcacgaggcatcaaaccataccatggcatgggtaggaac

SEQ ID NO: 15227 - DNA, 355 bp, Homo sapiens
  misc_feature 328, 332: n = A,T,C or G
gaaagaaagaagaaaagatcttgtaaaagttttcacccaaaacattttcactttgccacaactttcaaagctaccctttatctactcttcacactccaaataatactaacaactttaactcgcagtaaagtatagcaggagtagtaactaccatttattaaatgcttattatgtatcaagtaccatgctgagttctttatgtcatctcatatatttattttgagacagggtctcactctgtcacccaagctagtagtgcacaatcatggctcactacaggcttgacctcctgggcttaagcatcctcccacctcagcctcccgagtantaanactacagatatgtgccaccactg

SEQ ID NO: 15228 - DNA, 172 bp, Homo sapiens
cacccatcaagtcattattaccctcactgtcgacccaacacaggcatgctcatgtgaagatgcgaaaaaacgacagaaaggaacgggggcgtttttttgatagatcgcaacgggggagaaacctttgggggagggggcccgcccccctttatgaggggggggaaaaaatggt

SEQ ID NO: 15229 - DNA, 344 bp, Homo sapiens
gaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtggaaagaaggagctcctacaaagaataagaacatttcttgcttaacatgccagcc

SEQ ID NO: 15230 - DNA, 337 bp, Homo sapiens
gaaagaaagaagaaaagatcttgtaaaagttttcacccaaaacattttcactttgccacaactttcaaagctaccctttatctactcttcacactccaaataatactaacaactttaactcgcagtaaagtatagcaggagtagtaactaccatttattaaatgcttattatgtatcaagtaccatgctgagttctttatgtcatctcatatatttattttgagacagggtctcactctgtcacccaggctagtagtgcacaatcatggctcactacaggcttgacctcctgggcttaagcatcctcccacctcagcctcccgagtagttaaaacta

SEQ ID NO: 15231 - DNA, 348 bp, Homo sapiens
ggctgatgccattttcagcctcagcacgcctgcacccaggcgctcattaaaacagcatgttgctccccactgcctcgtgttgtctgttggcgcgctgacggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgcgccgaacagatgaaaaaatgcattgtcaacggaatcttttatgtttggttgtcttcctttaagc

SEQ ID NO: 15232 - DNA, 328 bp, Homo sapiens
tgggtatatataatttacagaaagtctatgtgtaaatcattgactgacttaactccgactgatcactctctgtacggaaccacctaatgagatctttttgcctgacacctagatagagcccattaccaagacagaggaattacaatacagagtttaatccatatagaattggctaaatgggagattcaagttttattattactcagatcaccctttccaaaaatccagagggtagggttttctaaacacggtttgttgggcagcggtctaaggaatgaggaaagctgattggttgtgttgcggataaaatcataggggttaaaactgt

SEQ ID NO: 15233 - DNA, 137 bp, Homo sapiens
tgtaaataaagttttattggaacagaaacacactcctttgtttacatagtggctatggctgcctttgtgatagaatagcagaattaattgactgtgccaaagattgtacagccagtaaaataaaaaatatttactgg

SEQ ID NO: 15234 - DNA, 323 bp, Homo sapiens
  misc_feature 323: n = A,T,C or G
ctcctctttccaggtgctccccgagcctcacaggtctggctcctgggcacgtagcaagctctttccctacctttacttccttttcattccctttttttttttttaaacttaatgggggcaaggttaacatataaaaaaatccccttttttggaaaaaagaaacaaggggttttaagaacctttacccattagggcaattataacaggccggtttaaaaacatggttatggaccaaaaaaacccctccggcggggggggaccacctgaagtcgggagttaaaaaccagccggaccaacagggggaaaccccatctttacaaaan

SEQ ID NO: 15235 - DNA, 320 bp, Homo sapiens
gctgctctctggccactagagccaggcagtcacctagctgctgttatgctgcatacctgtctctgagtactcgcttcatccatcggccagggtctgtgggacagaccaggcaggtggtgccccatgtgaggaacgctgcaatggattgcaagggaacccctgaaaacaaatgtgaagtgactgagcagtgttaaccttagaagactagaacctaatgagttatggcaaacagatgttatgcacgtccctgaatttggaaaactaagcacgaggcatcaaaccataccatggcatggctaggacccaacccggtaccaaaa

SEQ ID NO: 15236 - DNA, 363 bp, Homo sapiens
ggataagctacaacataaacacatctaggttcttgttcttagaatacagcatgaagaatttgctttcttctttcttcctaacattttcatgtgagatccagaaaggacacattgtctctggccattcgaagaaagaaagaaagaaaaaaaaaagggtttttagagaccgagagagaaaaaggctgaaatgggttcgctgggttctaaaaatccgcaaaccaaacaagcccaagttcttcttttgggacttgactcagctgggaagtctactctcctttataaattaaagcttgctaaggatattaccaccatccctacaataggtttcaatgtggaaatgatcgagttggaaaggaatctttc

SEQ ID NO: 15237 - DNA, 363 bp, Homo sapiens
cggggttcttgttcttagaatacagcatgaagaatttgctttcttctttcttcctaacattttcatgtgagatccagaaaggacacattgtctctggccattcgaagaaagaaagaaagaaagaaaaaaaaggtatttagagacagagagagaaaaaggctgaaatgggttcgctgggttctaaaaatccgcaaaccaaacaagcccaaggtcttcttttgggacttgactcagctgggaagtctactctcctttataaattaaagcttgctaaggatattaccaccatccctacaataggtttcaatgtggaaatgaacgagttggaaaggaatctttcactcccagtctgggatgtgggag

SEQ ID NO: 15238 - DNA, 341 bp, Homo sapiens
tataacaggaactcaaagacaatgcacagggctataatctaagaacagatgtattaacagccttactcactgtaaggctgggaacccttgaagccaggcattatatgcacattctcaaatatgatgctctagttaaagccttggtaatatatataaccaatgtttccaactgcatcctgttataaagagagagcaaattttattaaacttatgtaaataattcttgccataaaaaataagaatactcatggatagtttctgaattttagaggaatcaaatagggacaaaaaaaaatgtttccacctttgttcacaaagtataccaaattactggtaactaa

SEQ ID NO: 15239 - DNA, 384 bp, Homo sapiens
  misc_feature 384: n = A,T,C or G
tacggctgctagaagacgactgaagggtgtggtacattcagacattgtaatattacccactgctaaaaagaaatgtgctattaagctatgaaaagacatggagaaaaatgcattttactaagtgagagaagccaatctgaaaaggctacatagtatatgattccaagtacagttgactcttgaacaatacaggtttgaactgcatagatctacttatacagggattttttttcagtacatacagttggccctctgtgtctgtgggttctgcctctgcaatgaaacatggatagaaaattcagtattagcctgggcaacaaaatgagaacctgtctctacaaaaaatttaaaaatttagctgggcgcagtggctcacacctgtan

SEQ ID NO: 15240 - DNA, 317 bp, Homo sapiens
gaaaacattgctcctaactccaccgcctaccccaaaacctataagaactaatgataatcccaccaccctttgctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatt

SEQ ID NO: 15241 - DNA, 299 bp, Homo sapiens
aactgttggattttgttagtattctctattatttttctattctccattctacttatttctactcttatctttattatttcttcccttctggtagatttgggtatggtttttttctttctttttttccaagtttcacaatctgtagatttaggttgttggtttgacgcctttcttatctttaaatttaatggtgtatagctataaattgcctcgtttgcactgttttcactgtttcccatacgtttggtatggtttctttcatgtgcattcatttttaagtatttttctatttcccttgg

SEQ ID NO: 15242 - DNA, 285 bp, Homo sapiens
ggttatcagccaagagtttgtatctagtgaaactaagcatcatatacgaaggaaagatacattctttttcagacaaacaaatgctgagagtatttgccactaccaagccaccactatacgaactgctaaaaggagctctaaatcttgaaacaaatccaggaaacacatcaaaacagaacctctttaaagcataaatctcacaggacgtataaaacaaaaataccatttagaaaacaaaacaaaacaaaaaccaaggtatacaggcaacaaatagcacaatgaatg

SEQ ID NO: 15243 - DNA, 305 bp, Homo sapiens
tacggctccaaaaaacaacaaaagggtccggttgcaaaaaaacaacaaaagggtccggttgcaaaaaaacaacaaaagggtccggttgcaaaaaaacaacaaaagggtccggttgcaaaaaaacaacaaaagggttcttttttcaaaaaaccacacaaggttacgcctgcatgcagaccactgaggggtccctctgtgacaaaaccatcaacctttacggctgccccaataccaccaatgggtacgtctgcgccaaaactacagacggggacggtgtgagacctcaacagaagggtatgattttt

SEQ ID NO: 15244 - DNA, 387 bp, Homo sapiens
ggcacgaggtgagccaaggtcacgccactgccctcctgcctgggcaacagagcgagattcttatctccataaaatgaaacaaagcaaaacaaagggagagagaatggaggttgcctgttactgcatcataatcttgtttatgctgactgatgcattagaggtactaatggcatgagaggaacaatttcctgagacacagtttactgaccatgaatttcctcaaaaccccagagagcaggcttctcaggaggagactcagtgtggaatcccttgccaaggtagaccctggttctgtagcaggacgagccgcagacaaatctcctcaagacaccggattaaagaaggaaaaggtttatttggccaggagcgtcagcagatttgtgtctt

SEQ ID NO: 15245 - DNA, 368 bp, Homo sapiens
  misc_feature 368: n = A,T,C or G
ggatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatcttttatgtttgtttgtcttcctttaagcaacattgccttacttgttataan

SEQ ID NO: 15246 - DNA, 339 bp, Homo sapiens
gtggggcacgcctatattcccagctactcaggatgctgagatgggaggatcaactgggcctagggaggtcgaggctgcagtgagctgtgatcgtgccactacactccagcttgggcgacagagtgagacctcatctcagaataatatgaaataaaataaaatataaaataaaatactataaggagtcctttaggctgaaaggacaacaaattagatggctagttgaatccacacagagaaataaagagcattggcaaaggtcattgcatagataaatatacagtataaaaatatataggcttactctttccttcttttaactaaattaaaagatgaatg

SEQ ID NO: 15247 - DNA, 342 bp, Homo sapiens
ggctgatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatcttttatgtttggttgtctt

SEQ ID NO: 15248 - DNA, 406 bp, Homo sapiens
cgttgctgtcgaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaagcaaatgggattaaggactcatggaatgggaaggggaaaggggagtcttactatatgtggaataaacttgctcagtgttgccacagagttacattaccaat

SEQ ID NO: 15249 - DNA, 357 bp, Homo sapiens
ggattttgatagggattatattgaatctgtagatcaatttgggagaattgccatcttaatgatattaagtcttccaatttatgaacttaggatgtctttctatttacttaggtcttctttaatttctttttttttttttaaaaaaaaaaatccccctctgttacctccctgggacccccggggctcaagcagcccttccctttcacccccccaagaagttaggcccccgggggcccccccccccctctatttctggggggaggaaggcactcccctattttcctctctttagaaatctgggtcgcccattctcgcccccatttcgcctcccctcctttccttgtctcctcaacctct

SEQ ID NO: 15250 - DNA, 361 bp, Homo sapiens
gcccactggcgggactggacagatcaccgcagaaaactaacaaattctcgacttaaattgaagttttgaccaaatggacgtaatacacacgtacagaataccctacccaacaaccacagaatacacattttactcatctttgcatgctctaaaaatgaccacatgctcagtcataaagcaagtctcaataaattcaaaaaagcagaaatcataccaagcatctgtttggaccacagttgaataaaattagaaatcaataccaagaataactctgaaagccacgtaagtacatggaaatgaaacagtttgctcctgaatgacgtttggctaaacaaaattaaggcagaaatacaaatttttt

SEQ ID NO: 15251 - DNA, 341 bp, Homo sapiens
  misc_feature 341: n = A,T,C or G
cacatccatgaatgtcaagcgtccctaaaatgaggaccacattgtttacaacactaaaaatgtagaaattgtactcaatttagttgataaacatttttgaatattaagctattaaaaatggcagatcattaaaaaacatagaaacttcaattccaatctctagtaaatgttcacattcaaaaatatgtagtatttttaaaaattcagatggggttttactaggttgcccagaaagatctcaaactcctggcttcaagggaagagtttaatcctgccccagcctcccaagaagatgggattataggcatgcaccactaaccctggcctataaatacactttn

SEQ ID NO: 15252 - DNA, 357 bp, Homo sapiens
  misc_feature 357: n = A,T,C or G
ctctcaggctgtgtgagccatttgagaagatatacagcagagggaatacttcgtatgtcattctatgaagttcacatcacccatttaccagaaccagactaacaatgttcccgaaaaaaattacagattaatatctctcatgaccataaatgctaaaatcagaatattgggacatcaatcccacaaatttataaagagaattatacgccattaccaagtaaatttttttttccaggtttgtaagactggttcaacattcaaacgttgattaatatgattcatcacatgaaaaagtaaaatgagaaaacagtacaatcatatccctagattcagagagagcatttgacacaatccacn

SEQ ID NO: 15253 - DNA, 324 bp, Homo sapiens
  misc_feature 324: n = A,T,C or G
ggctgatgccattttcagcctcagcacgcctgcacccaggcgctcattaaaacagcatgttgctccccactgcctcgtgttgtctgttggcgcgctgtcggggttcgaaccgatacaagaaccttccacctacctggtgctttggcctcatctataagcttttccactgtcctgaaacaagatagagaatctgagcggccagtcatctgccctaagtgctgccgccgaagactgaatgtcctggaaagtttgctgtcacatctccattatgacaaaagcattgtgccgaacagatgaaaaaatgcattgtcaacggaatctttn

SEQ ID NO: 15254 - DNA, 309 bp, Homo sapiens
gctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcatcataagtgcatgctcttttcatctgctttggtatcatcacactctgataatgaaagtcttggtggattttctattgaagatgg

SEQ ID NO: 15255 - DNA, 305 bp, Homo sapiens
gctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcatcataagtgcatgctcttttcatctgctttggtatcatcacactctgataatgaaagtcttggtggattttctattgaag

SEQ ID NO: 15256 - DNA, 321 bp, Homo sapiens
actttaagatttatatgaaaaggaaaaagcattagaataatcaggagttttgaaaaagaaaaatgaagctgaaagaattacactaaccgattttgagatttgctataaagatacattaatcaagacaatatggtgttagtgaaaggatagacccataaatcaatggaacataatagagggtccagaaataaatccacacaaatatggttgattgatttttaaaagttgcaagaattctgaaaggtgaaagacagccattgctacaaatatgccataacaaacaaaaaagccattcttgacttatacaatactctatgatgg

SEQ ID NO: 15257 - DNA, 365 bp, Homo sapiens
tcaaaagaaagttttaaccctgtgatatgaatccacacaccacagagcagtttcatggataactaaccactttctagttttaactgggaataccccttttttcccttattactcaatgaactgcagaatgtccctttgcatattccaaaaagagtgtttccaacctgctgaaacaaaataatactttaactctctgagctgaatccacatatcacaaaggagtttctcagataggttctttctagattttgtctgaggatatttggtttttcctcataggcctcagagggctcccaaatgtctcctcacagattctacaaaaagagtgtttcaaacttgctggatgaaaagaaaaatttaactcc

SEQ ID NO: 15258 - DNA, 381 bp, Homo sapiens
  misc_feature 381: n = A,T,C or G
cgttgctgtcggataaaataagggttttaattcccagctatctctctcaaattttaagagagatgttatggactgtgctctccccacaacccggcccataagtcgcatgttgaagttcttacctctagtaccttggactgtgactatatttggaaacagggcctttaaagagacagttaagtgaaaaggaggcctttagtatgggcctagtgtaatctgaccagcccttatcagattaataaagttaaatacacagaaagataccacagatgcattagcgcaaaggaaagaccatgtgagcacacgaagagaaggcagccataggcaagccaaagacagtggccttagaagaaatcaaccctgccagtaccttgatcttgn

SEQ ID NO: 15259 - DNA, 124 bp, Homo sapiens
gctaaatctatccccatacccactcgaccttactacgctacaaccttagccaagccatttactccattaaatgtttagtcgatacaatttggttctttggcgccttacgatattgtttccggtg

SEQ ID NO: 15260 - DNA, 325 bp, Homo sapiens
  misc_feature 279, 285, 296, 297, 298, 299: n = A,T,C or G
cacgtgtgggggcttacgactcttaggctcccccttcaaaaggcctttgtttgcgaatcatgagatcctaatacttaaaccgtcctcaccatcatgtggaaaccatgtctttactacaactactgcatttattctattgttctggctcacatctgtagatcccaactgctctggaggctgaggcaggagaattgcttgagcccatgaagcataggttgcagtgagccgagatcattccattgcgctccagtctggcgacagaacaagactctgtctcgnaaaaanacattataaannnnttttggcggcctttttttctaaattg

SEQ ID NO: 15261 - DNA, 380 bp, Homo sapiens
cgttgctgtcggtgaaccaccgcgcctggctgagataggttgttttttgaattaactattcttttttttttttttttttttccgaaccaaaatttcctttggggtcccccggctggagggccgggggccaaaaaataaggcttctgggacccttggccccccaggtttaggggattccccggccttaatttcccaagcaggggggattaacgggttgggcccctccccccgggggattttgttttttgggaaaaaacggggtttttcaatgggggccaggcgtgttttgaatctcccaccctggggggaccacccctccttgggcctccaacggcccgcggctaccagctcgccaccccactcccatgcactgcagtctg

SEQ ID NO: 15262 - DNA, 352 bp, Homo sapiens
accaaaaagcatgacatatagaaaacaaataacaaaatgcagaagtcagtccttccttatctgtaattacattaaatgtaaatgaattaaaaggcagaaactggcagaacagatgaaagaaaaaacaagtccaactatgcacagtctacaagatactcactttggattcaaagatgcatataggttgaaaggagaaggatgaaaaaatatattccatgcaaaaaacaaggaacaaaagagtggctatactaatatcagacaaaatagactttaagacaaaattgttgggccaggcacagtggctcatgcctgtaatcctcagcactttgggaggccgaggcaggcagatcac

SEQ ID NO: 15263 - DNA, 404 bp, Homo sapiens
  misc_feature 404: n = A,T,C or G
ggcacgagccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacn

SEQ ID NO: 15264 - DNA, 398 bp, Homo sapiens
cgttgctgtcgctattattcctgagaatttgttatattaggattagcaaaaacaaagctgattggtaatataactaacataaattgcttggtaactttatttttttaagattatggtttagcgtgtgtcacattttatggagttaattctacagtgtaaagtttgagcttgattttagcatttcagtgacttgctaataaaataaataatttaccaccattgtcctataccatttcttttgacaacagtgagctactgttataattaaggcagtaattactattgagaaattcactgaagcaggtagaagaagatagattgacttgttgttttcctttaacagaaggatcaaaacccagcagagtgcaagcagcagtgaagcaagatgtatgtggccc

SEQ ID NO: 15265 - DNA, 360 bp, Homo sapiens
aattcgagcggctgcttcctttttttttttttttttttaaaaagaaatccaccttttgtccccagactatgaaggcaagggggccaacccagatgaatggatccctctgcccccggggtaaaagaattttttgccctaaccctccaaagaagtgggattaaaggcccctgacacaatgccagggtaattttttggaatttaaaaaaaaaaggggggttcaatattgtggctaaggcggttttgaacccccgacccgggggaccaccccccttggccccccaaaggggtgggattaacgggttggacccacgggccgggcctttccttgtttttttttaaaaaccaattaggggggtgtgg

SEQ ID NO: 15266 - DNA, 122 bp, Homo sapiens
gatggcagtgccaccatgctggatcttgccatggactgtggggtcaacttggtttatgctggacccggtgatgattcttttttcatgttggtactttgcatgttggtagttcgtacaagctt

SEQ ID NO: 15267 - DNA, 368 bp, Homo sapiens
agcatgaagaatttgctttcttctttcttcctaacattttcatgtgagatccagaaaggacacattggctctggccattcgaagaaagaaagaaagaaaaaaaaaaagggtttttaaagacagaaagagaaaaaggctgaaatgggttccctgggttctaaaaatccgcaaaccaaacaagcccaagttttttttttgggacttgactcacctggaaagtctactctcctttataaattaaagcttgctaaggatattaccaccatccctacaataggtttcaatgcggaaatgatccagttggaaaggaatctttcactcacagtctgggatgttggaggacaggaaaaaatgagaactgttggggg

SEQ ID NO: 15268 - DNA, 345 bp, Homo sapiens
  misc_feature 345: n = A,T,C or G
ccactacactaacaagcttccaatgaggaaacaaagttaccagaggaatctgaagtctctggtggccacagcagcaacaaaactcaacaatgacaaccaaagcaactaccaacatcaaacacagcccaattcctagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataatn

SEQ ID NO: 15269 - DNA, 319 bp, Homo sapiens
gcaccttgaggaccattcacttcttggatgcaatcaaagaacttttccatctcacttccttctcccagtgtccacatagtgcccctcaatgtttcattctcatggtttaaagcactggcttcaggcggtgaagatcagcaaagacactcgctcagctgggtatttgtatcaggctgggttcctcagagaaggagaaactaagccaacaggatatttgtgtgagtgtgtgtgtgtgtgtgtgtttgtgtgtgtgtgtaatatatgtcataaacatctatttactattgtatggtatttatttatgaataatattatatac

SEQ ID NO: 15270 - DNA, 352 bp, Homo sapiens
agaggttgaggctgcagtgagctgacatccccactgcactccagcctaggtgacacagcaagactttgtcccctgttattaaaataaataaagattgaggttggtccgagtacagaggtatttgcaactgattgattacaactaggtacagatttgtttgttccttctccactcccactgctttacttgactagcctaaaaaataataataataactctctctatatatatattttagacagagtctccctctgtcacccaagctggagttcaatgggcatgatcacgacttactggagcctcaacctttccaggctcaggttatccttccaacctaacttttctgaagagg

SEQ ID NO: 15271 - DNA, 310 bp, Homo sapiens
gagcaccatcccccccttttttttttttttggaaaagggaccctctttttgtcccccagctaaaaggggagggccgggatttgggttaatggaaacctccccctcttgttttaaggggattttcttgcctacccctccaaaaaattgggaataacaggggcctgccccccccccggggagatttttgttttttaaaaaaaaacggtttcaccggggggggccgggtggttttaaacctcgggccctagggggacccccccccctcgccctcccaaggggttgtttttacgggcaggaccccccccccccc

SEQ ID NO: 15272 - DNA, 326 bp, Homo sapiens
ggctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggcagctgaagactgatgctgcccgattgccttggaagcccccctagaccatcacagatgccgagcttcggt

SEQ ID NO: 15273 - DNA, 387 bp, Homo sapiens
cgttgctgtcggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtctattttaccccacacgtacctttatttaatgaagagggatggtaactatatcataagtctcaccatgacctgttataaatttctgatggaagctcgcgcagtatgggcctttgaaataccctgctgatgtcataggtcatattctcacatgagaactggaccaaagggcttgggctgaaactctgatgttgccactgtttgccaccttcaattggctgccc

SEQ ID NO: 15274 - DNA, 339 bp, Homo sapiens
ggaggataggcatgaaccaccatgacctgatgaaagaaatttttttaaaccaaactgttttacccaaaattttaatccagagctttcattagatgacatatcagagaaaataaagttgagccatataaacatgtctcttttagccagaaatataatttagattcaatactcttttataaactgaggttttattactatctatctcattactgaagtcctaaattaaagcaataagatctttgtgtgtgtatatatgttggatgtgttgacacataagtacatatgttatgttgtatgacttgtctatatagtaaattttggcatagttggccagaaatg

SEQ ID NO: 15275 - DNA, 343 bp, Homo sapiens
cacttcgggctcccaaagtgctgggattacaggtgtgaaccaccgcaaccgacttaacctcttttcattataaattaccgagtctcaggtatttatctatagccgtgcattaacacagtgtctggctctgtcacccagggagaagacagtgatgagatcatagctcaccactatggccttgacctcctgcactcaagtgattctcccaccttagcctcccaagacctgggatgacaggtgcccactgcacaactgggtaaattcttttttctatttaaacagcaggggtttactatgagacccagcctcgtctgcaactctggggtcaagtaatcataccgcg

SEQ ID NO: 15276 - DNA, 329 bp, Homo sapiens
tattcctagacaaaaaccttactattataaatatgtcaattctaaacaaattgattgataaattaaatataatgtcaatcaaaatcctaacagacttttttgaaactcaacaagcggattctaaaatgtgtatggaaaggcagaaagacaagaatagccaaggcactcttaaaaaagaagaacaggctgggcatggtggctcacacctgtaatcctagtaccttgggaggccaaagtgggaagatagcttgaggccaagaatttgagataagcctaggcaagacagtgagactctgtttccacaaaaatttaaaaactagccgggcatg

SEQ ID NO: 15277 - DNA, 332 bp, Homo sapiens
aattcacacacacccaagcagacacacactacaaaatatacatgcacatatgtaatagaaaaccctgtcttacatattattaattcccccaatttgtgaaaagacagttttttaattgtgaataattcagagttgttcttatggacaagtccatgaaaattgcttctactttttgttaactttcatcagcttttcatttctgctcttaattttctatggtcttaaaaaatacataaataaaccacttcaaattgtttccaaacaggctgggagaggtggctcacaccagtaatcccagtactttggaaggccaagacaggtggatcatctgg

SEQ ID NO: 15278 - DNA, 354 bp, Homo sapiens
ccctctgaagacttggagttctggatgggcctgagggtgggggaggcctgttagaagattttatttttttcgttttcctttttcctttttgtgcagaacggagtcgcactaagttgcccaggccggtctccaactcctgggctcaagtgaccctcccgcctcagcttcctgaagtgctaggaagtgagctatgatcgtgccactccattctggcctgggtgacagagtgagacccctgtgtctattttaaaaaggaagctagtggctgagcaccgtggcttacgcctgggatcccagcattttggcgaggtggggcgaaagcatcatttgaggtttgggaccattcctgccccc

SEQ ID NO: 15279 - DNA, 163 bp, Homo sapiens
cccaggagggttggccggacacagtggtagtggctcacacctgtaatcctaatgctttgggagcctgaggcgggaggaccccttgagcccaagaagtcaaggccacaatgggctatgatggtgccactggtcttcgggctgggcagcaaaacaaaaccctggc

SEQ ID NO: 15280 - DNA, 392 bp, Homo sapiens
ggcacgaggccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtt

SEQ ID NO: 15281 - DNA, 399 bp, Homo sapiens
cgttggctgtcgcagcccattcatgtccaccgaagtcttatcgtactacactactccatgtcatcgcatcccaccaggcatgccaacgcattcatccaggcgaccacccaggcatgtacccactcacctatccacccatccacctacctatttgtcacccatccacccatccatccatccaatcacccatccaaccatcaatccaaccattttcatctgatcattttcgatccatctacccgtccacccattcactactccatccacctacctatccatttatcagccatttacccatccatccatctatccatgcagatgtttattgagcacctgtgtgctgggtcctatttgggagccttgttaaccaccaagaccttcctaggccatattgtggta

SEQ ID NO: 15282 - DNA, 359 bp, Homo sapiens
actacgactgcgacatgacgacagacagggacgctgttagccacaccctcactcataagcagtgccgaaaaggcttcattcgagacctgtgggatggcattgctttaatcatagccataatacactgctataaaactgctttccacctcacgcgcactccttttatgtttcagcttcgcggctaggcaacttaagtcacttcctgtcttccgcctcaggctagagggcgagcgcttcgccgtgggacttcttctgcctggctccgcctcttgccccggaagtactcacagcgtacggttggtattgggcccgtttctgagcagcgcttcctttttgtccgacatcttgacgaggctgag

SEQ ID NO: 15283 - DNA, 344 bp, Homo sapiens
aggctgcagtgagctatgatcatggtactccattctggcctgggtgacagagtgagaccctgtctgtaataaagcaaacaaacaaaaacccttgaacaggaaaagctataataaaataaatggaagtaaacaatgatcaatgccaggcacggtggctcaggcctataatcccagcactttgggaagccaaggcaggaggatcgcttgggtccaggagttccagactagcctgagcagcacagcaaaaatctctaccaaaaaaaaaaaaccccagcccgggttaaggggttaacccttgaaatccaaccatttggggaggttgaggcggggggaaaaccggagga

SEQ ID NO: 15284 - DNA, 341 bp, Homo sapiens
gtctgacagcctaggtttaattataatcaataatctatcatcattaaactgttaataattatgtaagatttttggctctcacataagttaaactggcctgactagcaaatgcatgtaagtttttttaatatatatataactcagggcttcgcttttaattctaaataagtcattatggaaataaaatctatttatttagtagatcaagataatattctcagttgggcatggtggcacatctataatctcaactactcaggaggcaggtgggaggactgttggagcccaggagttcaagaccagactaggcaacatagtgaggccctgtctcattaaaaaga

SEQ ID NO: 15285 - DNA, 342 bp, Homo sapiens
atcattagattggagagccgccaaacacctaaactatatgaagctaaagtctgtttaagaaagagcccatccaggctgggtgtggtggctcatgcctgtgatcccagaactttggggggccaaggtgggtggatcatgaggtcaggagatcgagaccatcctggctagcatggtgaagccccgtctctactaaaaatacgaaaaaataattggccgggcgtggtggcgggttcctgtggtcccagctactcaggaggctgaggcaggagaatggcatgaacccaggaggtggagcttgcagtgagccgcgattgcgccactgcactccagcctgggcgacag

SEQ ID NO: 15286 - DNA, 340 bp, Homo sapiens
agcctgggcaacagagtaagactctgtctcaaaaaaaaataaaaaaaaaaaaagggaaagaaaaaccccaattgataaatttaccaaaaaaggacattaaccggattttactttacttatggccaaaagggaaaaaaaaaacataggctttaagggaaaacttgattgttgtaaaaaaaattaaaaaaaggccaaataaaacttttagggataaacccggccggggggggcccatccctgaagccccacctatttgggaggctaggcggaaaaattgtttaaacccaggaggggggggttacaaagagcggggatcggcccattgcactccaccctggca

SEQ ID NO: 15287 - DNA, 275 bp, Homo sapiens
ggcagaaatcaaaagcaccgaccagataggaaaaaaacagacaaattagacttcaacaaaactaaacattcgtgctcctcaagaggaacttttaggccaggcgcagtggctcatgactgtaatcctagcactttaggaggccggggcgggtggatcacgaggtcaggagttcaagaccagcctggccaagatggtgaaaccctttctctactaaaaatacaaaaattagccgggcccagctgggtgcggtggctcacacctgtaatccttgcact

SEQ ID NO: 15288 - DNA, 316 bp, Homo sapiens
agggtttatcacatgggtagactcaagtacccatgtgataaaatgtcacagaactatataccaaaacaaatagacaaaaagagtgcacgtatatcctggcgaaatccaaataatatctgcacctgagttaacagtattattgcatcacagtcacttttctggctttggccatttactatggttatataacattattattggaagaagttagctaaagagtatatggggactttatactataatttttgcaactcttgtgtagtctctaactgggtagtgtgaaatagttctgccacctctgacgcaccactgtcaa

SEQ ID NO: 15289 - DNA, 312 bp, Homo sapiens
ttcatgaggggctgatctggctttggggtggtattaattgttttttttttcccctttttttttaaaaggggaactggcggggttgccaaggcgggtctcaaactttggggctaagggggcctccccatcccacctactcggggggttgagccaggaaaatccttcgaccccggaaggcaaaggtggcaagggcccacaatggtcccacggccctccaccctgggggacaaaccaaaattccctctcacacaacgagagaaggaaaactaaaggaaatcccccggaaacccccgtgaaaggccggaaagcccc

SEQ ID NO: 15290 - DNA, 329 bp, Homo sapiens
gcacgcacacacacacacacacacacacacacacacggtattgaaactagaattctttcaatggtgtattccccatacttatttatgtctcaaagactgatcttcaaagaagacagagacttccagtgtaagacagttgaaaatatttggctgtgaccagcaacaaaaggcaaacaagtgtcaaaaaggtctttgctattgtaaggagattctcttttactgatctaaacaaaaggctcttctcacttctctatttcccatcctggcgcattaaccatttatatttaattaagcccttcttatatttctcaaacagcagtatttatgct

SEQ ID NO: 15291 - DNA, 375 bp, Homo sapiens
  misc_feature 94: n = A,T,C or G
gagaattgcttgaacccgggaggcagaggtggcagtgagccgagattgcgccactgcactccagcctgggtgacagagcaagactccatctcanaaaaaaaaaaaaaaagaaaaaaaaaaaccccggccccggaaactaaaccctgaaacccaagaatttgggggggccggggggggggaataacaaggcggggatttaaaaaccacccggtttaaggggaaaccccatttttaataaaaaaaacaaaaataagtggggggggggggaggccccctggatccccaattcctcggaaggctggggcaaaaaaatccttgaaccccggggggcgggggtttcagagacccaaaatggccccattgaactcaagtggg

SEQ ID NO: 15292 - DNA, 382 bp, Homo sapiens
cgttgctgtcggtgaaccaccgcgcctggttgagataggttgttttttgaattaactattcttttttttttttttttttttttggaaaaaaattttcttttttttcccccacctggggggcaggggggcaaagataaaagttaattggaacctttgcctcccaggttaaagggattccccggctttaatttcccaaggcggggggattaaggggaggggcccttacccccgggtgttttttttttttggggaaaaacggggtttttcctttggggcaagggtggttttgggttccccacccggggggaataaccttttttggccccccaaaggggggggaatataggggggggccctgggccccaaccttttttttaaaatt

SEQ ID NO: 15293 - DNA, 349 bp, Homo sapiens
gcgcgcaggctgcgcatgcgcgccggcgaccacacctaaatagccgcagcctctgcgcgtcgccctccacggttaccccggctctccgcccctccttctcgcggggctcgagggaccatggccgatcctcgcgtgagacagatcaagatcaagaccggcgtggtgaagcggccggacaaagaatatttgctgatgattttctaggcatacatgttgtggaatccattgtaaaatggaccttggtgccgggtgagtataggaataaacccggctgaaaaaatacgtggcttaaaacatgtctgtttagtttagacgggtcgaatttcaataagctctttctggggtctcc

SEQ ID NO: 15294 - DNA, 349 bp, Homo sapiens
actacttgctatgtatgttcccctagctgcatttgaacccctgggttcaagtgatcctcccacttcagcctccccggtagctgggactataggtgcatggcaccgggcctggctgttcactcctcctttcataagcaaaggcacagtttcttttcttgtaagagatgggctaggttgtgtagattgagctttctaataaaaacaactaaaagtgttgaataaaaatgtcttaaaaacatcgaaaagttaacacggtagaaatgaaattgggaactcagataagctgaacgtggaaactgcttttgccttgcgaacatttgctcaactaagtgaacttgaactttggttt

SEQ ID NO: 15295 - DNA, 352 bp, Homo sapiens
  misc_feature 352: n = A,T,C or G
actacttgctatgtatgttcccctagctgcatttgaacccctgggttcaagtgatcctcccacttcagcctccccggtagctgggactataggtgcatggcaccgggcctggctgttcactcctcctttcataagcaaaggcacagtttcttttcttgtaagagatgggctaggttgtgtagattgagctttctaataaaaacaactaaaagtgttgaataaaaatgtcttataaacatcgaaaagttaacacggtagaaatgaaattgggaactcagataagctgaacgtggaaactgcttttgccttgcgaacatttgctcaactaagtgaacttgaactttgggtttgn

SEQ ID NO: 15296 - DNA, 346 bp, Homo sapiens
ggcactggaggaagataactcaaaataagaggcagctatgacaatcccacagcaaacatcatactgaatgggttaaagctggaagcattcctcctaaggactgaaagaagacaagaatgttcactcacaccatgcttattcaacatagcactggaagtcttagccagaacaattagtcaaagaaagaaatagacatccaaattggaaaaaaggaagtcaaattatctctcttcactgacgatatgattctatacctagaaatactaaagattctgccaaatctcaggatacaaggattagcttacaaaagttaatagcatttccatacaccaataactaagctgag

SEQ ID NO: 15297 - DNA, 347 bp, Homo sapiens
  misc_feature 347: n = A,T,C or G
gctcttcaagtaaatactactgatttgtcaccaaaggaggtcaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttggaattgttaactttattttaagtaccaccatttgaacctn

SEQ ID NO: 15298 - DNA, 389 bp, Homo sapiens
cgttgctgtcggtcggagagccagcggactctgacaagcgtcatgccagtgacttcgccctgtggaaggcggacaaaccccaggaggtgttctgggcctctccctggggacccgggaggccgggctggcacatctagtgctctgccatcgctagtatggtatttggaagtcaactggatatccattcaagtgggatagatttagcttttccacatcatgagaacgaaattgcacagtgcgaagtctttcatcagcgcgagcagtggggaaattattttctgcattctgggcatttgcacgccaaaggcaaagaacaaaaaatgtgccaatcattaaagaactacgttactattaaggactttctgaagaccttttcccccgatgtctta

SEQ ID NO: 15299 - DNA, 189 bp, Homo sapiens
  misc_feature 62, 63, 69, 70: n = A,T,C or G
gacccactacctaaaaaatcccaaacatataactgaactcctcacacccaattggaccaggnnggaagnnaaaagaaaaaggaaaagggggcggtttttttcggaaaccccaacttggaaaaaacctttgggggggtgggcacacccccattttaaggggggggaaaaaatttttttttttgggaattg

SEQ ID NO: 15300 - DNA, 215 bp, Homo sapiens
  misc_feature 101, 215: n = A,T,C or G
tacggttgctagaggacgacggatgggctgatgccaatttttctgggagagcccactttaaaaccccctataccagaggagctacctaagaacaggtttcnagagcacaccccgtctatgtactcacaatagcggggagaatttataggttgaggctgacaaaccttcccagcctgggggatttctgggtttgccaaaatagaactcttagttcn

SEQ ID NO: 15301 - DNA, 390 bp, Homo sapiens
  misc_feature 333, 334, 347, 357, 365, 368, 372, 380, 390: n = A,T,C or G
cggtttataaaagccttgggttccaaccaggcagtagatgtgcttctgaaccgcaaggagcaaacactgaaataaaatagtttatttttcacactcaaaaaaaaaaaaaaaaaacctccgggggccgttttttccgtaaacccaaacttgaaaaaacccttggaggagttgggccaacccccacctaaagggcggggaaaaaagggcttttttggggaaattggggaggctttggttttattggaacccattataggcggcaaaaaacaggtaaccaccaccaatggctttctttttatgttccgggttcgggggggggggggggggtgttannccccccccccccncccccccccncccccccnccncccnccaccccncccccccccn

SEQ ID NO: 15302 - DNA, 394 bp, Homo sapiens
cgttgctgtcgcacggttttgttttgttgcccaggctggagtgcaggggtgcaatcgaagctcactgcagcctcgaccacctgggctcgggtgatcctcctgcctcagcctcccagtatctgtggccacaagcacaccccaccatgcccatttaattttttaagggatttcttgtacatatggggtctcactatgctgcccacgctggacttgaactcctggccaccaaggggagctcctatctcggactccggaggggctatgattacccgtagatagacatttactttaggaagaggctcttaaaggcaataaaacgcttcccatccaagagaatcacgctgcaatcctgggccacagagctttttaaaaaatcgatgcctgaccttcaacg

SEQ ID NO: 15303 - DNA, 404 bp, Homo sapiens
  misc_feature 404: n = A,T,C or G
tacggctgctacaatatcacagaagggctggtcttgaactgctgggctgaagggatcagctggtcttggtctcccaaaaggctggggttacaggcatgagccatggtaccccgccaagtgaactattaatacacacaacctggatacatctcaagagaattatgctgagtgaaaaaacagacaacacacatacggccacctaatttatgactaagggatactgcagccaactaaaggaagttatcttcaataaatggtgctgtgtcaactgaatatacatatagaagtatataaatcttgatttctacttcgtataaacaaaaaagatctaatttctaattatagacctcataaacttaaggaagaaacaataaaacttatggaagaaaacatacgagaatatn

SEQ ID NO: 15304 - DNA, 353 bp, Homo sapiens
  misc_feature 319, 342: n = A,T,C or G
ctggatgtcagcaagaatggaatacaggagtttccagaaaatataaaaaattgtaaagttttgacaattgtggaggccagtgtaaaccctatttccaagtaagttctcaggctccctgatggattttctcagctgttaaacctaacccagttgtatctgaatgatgcttttcttgagttcttgccagcaaattttggcagattaactaaactccaaatattagagcttagagaaaaccagttaaaaatgttgcctaagtaagtaaaggtgctattctttaaaaaacttaatttataatttttaatgattaagtctttanaaatgtaaatttttattacctanaatgtggtgcg

SEQ ID NO: 15305 - DNA, 367 bp, Homo sapiens
gtgcgtccgtcgattgagatttgacgacagacagggtcccgtgtgttgctgccacagctacagttcagtgacaagaaagctatatctgtaatggctgtgatgcgattgctttatttgttgcctgtattctctgcactttgcgaaccgacgccgacagttgcattgatttcatgatttaggtaccgaccaaggtgtgcgaagttcaggactctgtctctccacccctcatataaaagaaaaaaggaaaggcatgactctgagggtaattctaggaaggcatgtggggtgggaaaaggagccagcggtgtgattaaagaatgacatggtactagagggatgcagatctagataatattgaaaggccagg

SEQ ID NO: 15306 - DNA, 382 bp, Homo sapiens
  misc_feature 369, 382: n = A,T,C or G
tacggttgcgagaatacgacagaagggctggatgtcagcaagaatggaatacaggagtttccagaaaatataaaaaattgtaaagttttgacaattgtggaggccagtgtaaaccctatttccaagtaagttctcaggctccctgatggattttctcagctgttaaacctaacccagttgtatctgaatgatgcttttcttgagttcttgccagcaaattttggcagattaactaaactccaaatattagagcttagagaaaaccagttaaaaatgttgcctaagtaagtaaaggtgctattctttaaaaaacttaatttataatttttaatgattaagtctttaaaaatgtaaatttttattacctanaatgtggtgcaan

SEQ ID NO: 15307 - DNA, 386 bp, Homo sapiens
cgttgctgtcgggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatg

SEQ ID NO: 15308 - DNA, 323 bp, Homo sapiens
aggtaactgaatccaacaacatatcaaaaagataatccatcatgtgatcaagtgggtttcataccagggatgcagggatggtttaacatacacaaatcaataaatgtgacacaccacataaacagaattaaaaacaaaaatcacatgatcatctcaacagatgcagaaaaagcattcaacaaatccagcatccctctatgattaaaactctcagcaaaattggcatacaagggacatacctcaatgtaataaaagccaacagccaacataatactgaatagggaaaagttgaaaacattccctcttagaacttgaacaagaca

SEQ ID NO: 15309 - DNA, 319 bp, Homo sapiens
  misc_feature 319: n = A,T,C or G
gtatacctggactttatagaaagtattaaacttgtatctattactttataaagcagggcactgaatatattgagagagaataccagctagaaactttaagaatataacatctttttggaaacaacaatgtttatttaaacaattatttaccatgaccaagtggtatttatcccaggaatgcaagggtggttcaacacaagaaaatcaattgatgaaatatatcacattaatggaagaaaaaacatatatatcatctcaactgatgcaaaaaatatatttgacaaaattcagcactctatcagaaaaacctttagaaaan

SEQ ID NO: 15310 - DNA, 386 bp, Homo sapiens
cgttgctgtcggcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctg

SEQ ID NO: 15311 - DNA, 359 bp, Homo sapiens
attctccgtattcaccttctgtctctccagtttgggggcagctgtttgacctgtgacttaacttctcttacagatctaagaaaagttgttgatttttcagtttgtttagctttttacttgctcttaagattgagtgacagatttttttttgcatttttttattgcgataaaatgtattaatacaaaacatttatcatttacgtgtacagttctgtggcattagatacattcacactgtgcaattaggactcttaaaaggaaaaagtcacatactgttagaagggtcatacaaggctttatagaaaggatttttaagatgagcttctatatatcaattaggagaacatttcagtagaact

SEQ ID NO: 15312 - DNA, 354 bp, Homo sapiens
atacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaaaaaagcaggtaaaaaaaaattttttttgtataaagccaaaaatatataaaagggcaaaaataggcggggggggggggctacccctgaaaccccaccattttggaaggccagggggggcaaatcacgaggccgggaaattgaaaccatcctggttaacagggggaaaccccggctttactaaaaaaa

SEQ ID NO: 15313 - DNA, 402 bp, Homo sapiens
  misc_feature 402: n = A,T,C or G
ggcacgagaggggctggatgcctttcatcccaactattctctgtggtatgaaaaagaaaaaaaaaaaaaaaaagggatccgggcccggccgggggggttcacccctgtattcccacctttttggaaaaccaagtcgggcattcttttgaagtcgggagttaaaaaccacccggcccaactggggaaaagcttgttttttttaaaaaaacaaaatttacccggccggggggggggccccctgtattcccaggtttttggggggactgaaacagaaaaatcctttcaccccggggggggggggttgcataaattcaaaagggcccccttgggctccaccctgggggacaaagcgaaactccttttaaaaaaaaaaagggatcggccaaaaaacccccgggggtn

SEQ ID NO: 15314 - DNA, 331 bp, Homo sapiens
tgctggccacaccagccccctttcacctccagtgccacaataaacctgtacccagctgtgtcttgtgtgcccttcccctgtgcatccggaggggcagaatttgaggcacgtggcagggtggagagtaagatggttttcttgggctggccatctgggtggtcctcgtgatgcagacatggcgggctcatggttagtggaggaggtacaggcgagaccccatgtgccaggcccggtgcccacagacatgaggggagccactggtctggcctggcttggaggttagagaagggtagttaggaagggtagttagcatggtggctcatgcctgtgg

SEQ ID NO: 15315 - DNA, 313 bp, Homo sapiens
  misc_feature 188, 189, 190, 192, 193, 194, 195, 196, 197, 198, 200, 201,202, 206, 208, 209, 210, 211, 212, 215, 216, 217, 222, 225,270: n = A,T,C or G
ttgtttgcagaataaacttcagtgttatactcggcttaatcatttgcatcaagtgtaccaagaataattattttcacataggcttttaaaattggctctgatggaattctattccatacggaatctcagataagactgtttttttttgagttggagttttgctcttgttacccaggcttgagtgcagnnncnnnnnnntnnnttantnnnnnctnnnccttnttnactcaattgatcctcccacctcatcctccccaataacttttacancctttccataccaccactcctttttaatttaaaaaaaaatttt

SEQ ID NO: 15316 - DNA, 324 bp, Homo sapiens
aggctggtgtgcactggtgcgatctcggatcactgtaacctctgcctccagggttcaagcaattctctgcctcagcctcccgaggagctgggattataggcgcccaccaccatgccccgctaactttttgtatttttagtatagatggggcgtcaccatcttgtccaggccggtatagaacttctgtcctcctggggacccaaaatgggctcctaaaaaaggaggtttgggacctgatgtccagggctttttgaaggtgtgggactgccgcgccccccctccacccgggccagtatttttgtttaaaaatataaacggtgcgcc

SEQ ID NO: 15317 - DNA, 398 bp, Homo sapiens
ggcgggatggaggcggcggccgagcctttatattttgtccggcgtcaggcacatcatcctggtcctgtcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcaggttgtgtccgacgtggcctggggggagctggactacctggtgg

SEQ ID NO: 15318 - DNA, 360 bp, Homo sapiens
actatcgattgcgagacgacgacagacggggatcagtctgttcctaccacacttctggggccataacgaaatggctgcatgagtgaagactgtgatgctatcgctctataccaaaccattatgatctgcaataatctggttagcaaccacagttgcgttcattttgtgttttatggtactaggggtggcgtggaaagatcacgataacatccagaattggcatctcttctttacgtttagatgaactagaggagcgcgagcatacacattcaaaagctagcagaaggcaagaaataactaaaatcagagcagaactgaaggaaatagagacacaaaaaacccttcaaaaaattaatgaat

SEQ ID NO: 15319 - DNA, 313 bp, Homo sapiens
ccaaagtgctgggattacaggtgtgagcaaccacaccccggcctcatgctataacttttttttttttttttaaaaaaagcctcactttgtacccaaggctgaagggggtaggggaataaagggggttaattgaaacctttgcctccggggttaaaggaattttccggcctaaccctcctgagaagctggaactacaggggcctgccaccaacccgggttaatttttttgttttttaagaaaaaacggggtttaaccacgtgtggaaggcgggtttcaaacaactgacctcaggggatccacccacctgggcct

SEQ ID NO: 15320 - DNA, 352 bp, Homo sapiens
actgtggatctgtccccaggtttggctgggggtttggtttttagtagagatgaggtctcactatgttctcaaactcctgggctcaagtgatcctcccaccttggccccctaaagtgctaggattataggtgtgagccactgcatttgggcgccgtgaaaagctttgagaaggctaacggaaaagcaagggagagccctgggcacacagccccctcgaggaggcaggtagggccccacctcacggtgtgggtcacagagctttactccctgcatttccagccatgaggggttgggggccatccacccatcagatactggttaggaaggtgatcacggctcagtgcaagggact

SEQ ID NO: 15321 - DNA, 352 bp, Homo sapiens
actgtggatctgtccccaggtttggctgggggtttggtttttagtagagatgaggtctcactatgttctcaaactcctgggctcaagtgatcctcccaccttggccccctaaagtgctaggattataggtgtgagccactgcatttgggcgccgtgaaaagctttgagaaggctaacggaaaagcaagggagagccctgggcacacagccccctcgaggaggcaggtagggccccacctcacggtgtgggtcacagagctttactccctgcatttccagccatgtgggtttgggggccatccacccatcagatactggttaggaaggtgatcagggctcagtgcaagggaag

SEQ ID NO: 15322 - DNA, 275 bp, Homo sapiens
  misc_feature 275: n = A,T,C or G
ctcatcatggtaaagactttatatgaaaaattcacagctaacatcacattcaattatgaaatgatgaaagcatttcccctaagattaataacagggcaagggtgtctactatcctcacttatatttaacataatattgaaagttctagccagagaaattgggcaaaaaaaaaaaaaaaaaaaaattgggggggggttttttcggaaaatccagcctggaaaaaatccttggggggtgtgggccccccccccttaggagggggggaaaaaagggtn

SEQ ID NO: 15323 - DNA, 384 bp, Homo sapiens
gaagacttacttaccctaagtatatatgcacccaacattggagctcccaggtttataaaacaattacttctaaacccaggaagagacttagtcacacaacaacagtgaggaacttcaataccccactgacagcattagacagatcatcaagttataaaactaacaaagaaattctggacttaaaaattgaacacttaaccaataggaccttataaatatataaagaatattccacccaacaaccacagaatataaattattcttatctgcacatgaaacgtactctaagatcaaccacatattcattcataaaaaagcctcaataaattcaaaaaaattgaaattttaacaagcatattctccaaccacaggggaattaaaata

SEQ ID NO: 15324 - DNA, 332 bp, Homo sapiens
tgtgtggtggcggcaccgctcacaaacacccccactccggccgcccgacagtctgaacagctcagagttgaaccggcagcgtcgggcatgctggttgcaggagcaggctaggagcaaaatggggtgggggcgcatcagggccgagtgtgctgctccccagtcctcagctttcttcccatggccctgccctcatgaaaggaagccgtgagtgtccaaggtagaagagaatgcctgggtcccaggacacctctattattatctttttttttgagacggagactcactctgtcacccaggctggagccgaatatttttttgccaattctgttacg

SEQ ID NO: 15325 - DNA, 387 bp, Homo sapiens
  misc_feature 387: n = A,T,C or G
cgttgctgtcggtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcn

SEQ ID NO: 15326 - DNA, 381 bp, Homo sapiens
tgggacaacaggggctcaccaccacacccagctagttttttctgtagttttattagagaagtggttttatcgtgtaggccaggggggtctcaaacttctggtctcaggtgatccacccatctcagccttccaaagtacttggattacaggagtggccaccacgcccaacctacacatagctctttttttttttttttttcaagaaaaaaatttttttttgtcccccaggtgcaggaagatggtttttttgggtacaccagaatctttttttccagggtttaagccagtatggaggccgatatctttgggtgcgcggggtatacacacgaactgtccaaacccggtgtgattgttggtcttacaaaagatgctggagcatat

SEQ ID NO: 15327 - DNA, 399 bp, Homo sapiens
cgttgctgtcgacggttttcctgccttagtctccctagacgctgagactgccggcatgtgccaccacgtccagctaatactttgcgcttctagaagacatggggttactccctgtatttgaggctggtctgagagctcctgacctatttggaccagtccacctctgcctcccaaagggctcggaaacaagcgtcgatccttctatgcctgaccgacaaccttatgtcttagcctgagttcctcagccttaatgtgagatcctcaaactgttgacatactaattaatatgtatctactgagactgagaaagacactaatttctttctaaatcatgaagatttactgattatcttatatgtaaaacattttagcctatatgttggaatctggagccaatga

SEQ ID NO: 15328 - DNA, 335 bp, Homo sapiens
tggaaccagcaaagcatgaaaggtttaagacacttcatcagttgggttttcttgccttgaaaaagggggaatagaaaatgatttggtaagcactccctctttcacttcctttggaagggattgggcaaaataagtattatttcctcctcatatacgtagaattagtttttttggttttttgtttgtttgtttttgagacagagtttttgagactctgtcacccaggtgggagtgcaaggtcgcgatctttgctcactggtttctctgcctcccaggtacaagcgatttttctgtcttatccccctgagtatctatgaatgatatttgtctgccct

SEQ ID NO: 15329 - DNA, 336 bp, Homo sapiens
  misc_feature 336: n = A,T,C or G
ggattccttaaaccttgagccttggaggttgaggctgaagtgagccaagatcacaccactgcattccatcctatgtgacagagtgagacactgtctccaaaaataaaataaagatttaatcaaaataaaatatggtacataaaaatcaaggaagaccatgtggccatataaaaacacaaagccaggcactgtggctcatgcctataatcccaacactttgggaggctgacgcagatggattacttgagatcaggagttcaagaccagcctggccaatatactaaaaccccgtgtctactaaaaatacaaaaaatcagctgggcgtcgtggcaagtn

SEQ ID NO: 15330 - DNA, 172 bp, Homo sapiens
  misc_feature 93, 100: n = A,T,C or G
cgttgctgtcgggcttggcttcagtgaacgcaccgtgatgtgcaggccgggaggtataggcaggctgatgggggaggtgtgggaggtttttcnacacctngcaccaaatgctttatctactgaagctgcgatgctctagctatattcaacaccattattcgttacattatat

SEQ ID NO: 15331 - DNA, 322 bp, Homo sapiens
gggcaatcttttcggattctcttccatgctgtggcaggtgagcctcatccaatttgtgaaagcctgaatagaacaaaagtctgaccctccgctgagtaagagagaattcttcctgcctgaatgccttcacactgagatatgggtttttgtcctgttttcagagtagaaccaaaacattggctcttcctggaccttcaacctaccagcttttgaactgaacctacaccattggctctcctggttctcatgccttcaaattcagactgccaatatcatactgaatgggcaaaagctggaagcattccctttgaaaaccaacaca

SEQ ID NO: 15332 - DNA, 295 bp, Homo sapiens
  misc_feature 128, 131, 135: n = A,T,C or G
gctttgcatctgaaactgtcagccccagaatgttgacagccgctctcctagcccttctctgtgcctcagcctctggcaatgccattcaggccaggtcttcctcctatagtggagagtatggaagaggnacntaanctcttgggagctctatggccctgcccattggctgacaaacccacatatgtatccaggtgaccttaaggcaagcttgtatcagctgatgatctcttaaaagtgctaccttctggctggaggataaccaacaactagcacaaccagcatttcgagaaaaccc

SEQ ID NO: 15333 - DNA, 317 bp, Homo sapiens
  misc_feature 317: n = A,T,C or G
gggcaatcttttcggattctcttccatgctgtggcaggtgagcctcatccaatttgtgaaagcctgaatagaacaaaagtctgaccctccgctgagtaagagagaattcttcctgcctgaatgccttcacactgagatatgggtttttgtcctgttttcagagtagaaccaaaacattggctcttcctggaccttcaacctaccagcttttgaactgaacctacaccattggctctcctggttctcatgccttcaaattcagactgccaatatcatactgaatgggcaaaagctggaagcattccctttgaaaaccn

SEQ ID NO: 15334 - DNA, 374 bp, Homo sapiens
actcagcgtggtgtcacgtgcctggaatcccaactactccggagggtgaggcacaagactcgcttaaacctgggaggcagaggttgcgtgagccgagaacatgccactgcactccagcctgggcaagagagtgagactctgtctcaaaaaaaaagtttatatttatatacacacatatatttatatactcacacacacacgtgcacacacttaaaaatgccaagaaaaaaattgtaccaaacaatcatgatctgaatcatgaagcaaattaaaatgtggcatgattttgaacaagtgatggagaatacaaaaagatttgattgtgtaaaagggttatgatttgagattggggaggaaaaaaaacataatccctg

SEQ ID NO: 15335 - DNA, 324 bp, Homo sapiens
aatcccaacactgggcagctgaggtgggtggatcacttgagcccagaaggtcgagagaccagcctaggcaacatggtgaaaccccgtctctactaaaaattcaacaataaaaaaattagctgggcgtggtggcaaggacctgtggtcccagctactcttgggggctgaggcgggaggatcaattgagcctgggaggtcgaggctgtggtgagtggtgaccacaccacttcactccagccggggtgacaaaacaagaaaacctgtcacctttctgggggaccctggtttccctggggtaattcaaaaaatcttcccaaaagggag

SEQ ID NO: 15336 - DNA, 394 bp, Homo sapiens
cgttgctgtcggaaaacaaggggttagatgttgcatttcataaaactaaccgaagttctgtctactgatgcagcacaagagatgtaaaaaaaaaaaaaaaaaaacccccccccccggggaaaaacccttttaaggtttggtttggttttttttttggggttgggtttttggtttttttaccccagggaaaaacctggaaaaggggcaaaacccctttccgggttttttttttaagggcccttttctaaaaaatagggtcaaccgggaatggaaaaagggggggggggggggaaaaaaaaaaaaccttgggggttaggggtttaaaaaaaatttaggcccattggttaaaaaaaccgcaactttaaaaaaaaaaaaatcccccccccaaccaacc

SEQ ID NO: 15337 - DNA, 289 bp, Homo sapiens
tgctaaaagtacattgaagatagattgccccatccaacctcctacatcaagggtaaacaaactctttctgtacgggccagatggtaagtatttggggctttgtgggccatatagtttctgttagatctactcagtgctgccattgtagtgcaaaagcagccacagacaatatgtaaacaattgaatgtggctgttttccaataaagtgttatttacacaaccagattttaccggtgggttatagtttggtgaatcatgtcctagatcatcattaggaagtggcatggtg

SEQ ID NO: 15338 - DNA, 339 bp, Homo sapiens
gtgggttttgtcattactttcaacgggaaaattgcaattacttttgtaccaacttatcatatgaaaaacatatttttaatatcttaaaaacttgagcctgccatacaaaattgtgtgtgtgtgttgtgtgtgtgtgtgtgtgtgcgtgagtgtgacttaagatcatgattttattaccacactgggcatcattgttaagccccatcttcactaacagtacacaattagccccgtgtagaggtggctgccagaaatcccatcctactaaggaggttgagtgaagagaatcacttgaacctgggatgcaaatgaaacagtgagtctagatcgtgcgactgg

SEQ ID NO: 15339 - DNA, 326 bp, Homo sapiens
tatttgtataatcgctgataactttccttgctttcaagtctgccccaactgaaatgaatacaggtactcctgctttcttttgattagggttagcatggtacatctttcctcacccatttatttttcatctatatgggtttttatatttaaaatgagttccatctcttcatgataaaaactgacaacaaactaggcatcaaagaaatatatctgaaaataataagagccatctatgacaaacccacagccaaacccacatcatactgaacaggcaaaagctggaaccattctccttgagaactggaacaagacaaggatgtgtattc

SEQ ID NO: 15340 - DNA, 132 bp, Homo sapiens
  misc_feature 132: n = A,T,C or G
cgacagaagggtaaatgggattacttttatttctttttcagattgtccacctttggtatatataaatgccactgatttttgtatgtcaattttgtatcctgtaactttactgaatttatcagttccaatagn

SEQ ID NO: 15341 - DNA, 183 bp, Homo sapiens
gctaacaaaacacgtacaggatctctatgctaaaaattacaaaacgttgatgaaaggactaaaagaaaacctaaagaaatggagagggatactatgttcatgttttgaaagactcaatgtagtaaagatacagattttccctaaaccaacttataggtttaattcaatacttatcaaaatctg

SEQ ID NO: 15342 - DNA, 376 bp, Homo sapiens
gcgggcggatcacctgaggtcaggagttcaagtccagcctcgccaacgtggtgaaaccccatgtctactaaaaatacaaaaaaaattagccagacatggtggcgggcacctgtaatcctagctacccggaaggctgagacgggaatcacttgaacctgtgaagcagaggtttcagtgagtctagattgcaccattgcactctagcctgggcaacagaactagaccccatcttaaaaaaaaaaaaaaggtgatccccaaaaaagggggtttttctaaatcttagtggaaaggccaccatgattaaagtatacaaactttttgaagcaaattaaatttttatttcttttaatccaaagtttaaatttgaattaaaccc

SEQ ID NO: 15343 - DNA, 438 bp, Homo sapiens
tctctttttgaggatcccatcgcctctaattccgttgctgtcgggcacacacctgtagtttcagtttctcaggaggctgacgcgggaggattggcttagcctgtgaggtggaggccacagtgagctgtgattgcgccactgtactccaccttgggagacagagtgagaccctgtctgaacaacaaaaaagaattgtggccagtcatggtagctcacatctgtaatcccaacactttgggaagctggggcgagtggattgcttgtggttacgaggtcaggatcagcctaggcaacatagcaaaaccttgtctctctaccaacaagaaaaagaaaaagaaaaaaaattaaccaagtgtgatggagcacacctggtggaaagccctaactactcggggaggcttatctgggaggaataattggagccccagaggttttggg

SEQ ID NO: 15344 - DNA, 376 bp, Homo sapiens
tacggctgttagaatacgacagaagggagcaccttgggaggccagaggcaggaggatcacttgaggccaggagttcaagaccggcctgggcaacataatgagaacccatctttaccaaaaaaataaaattacattaaaaattagctgggcacggtgacgtctgcctgaggtcacattcaagaagctgatgtgggaggatcgcttgagcccaggaattggaggctgcagtgagctaagatcataccactgcacttcagcctgggcgtcagagtgagaccctgtttctaaaataataataattttaaaaaatgatatttatggttgcattgggaaaagatcaatctattaatatatgtgaagacatttttggcctaaa

SEQ ID NO: 15345 - DNA, 367 bp, Homo sapiens
  misc_feature 210: n = A,T,C or G
tacctacttcgattgcgacatgacaacatacagtggtgtgtttacccaagccacgacttaaaggcagaggacaagatgctatatttgtgaaatgagacatgctatggctttattagataccgtactctgctgcaagaccacaatgtacgcatcgacggtggccttcattttatgttgcagaatgaatccgacgtataggaagtctttcangatattatccaggagaacttccccaacctagcaaggcaggccaacattcaaattcaggaaataaagagaacaccacaaagatactccttgagaagagcaactccaagacacacaattgtcagatttaccaaggttgaaatgaaggacaaaatgttaa

SEQ ID NO: 15346 - DNA, 331 bp, Homo sapiens
  misc_feature 331: n = A,T,C or G
ggtaccactagaaaaatccacccaaattaataagagaaaaagaaacaaagaatacataaagcaagaaaacaaccatacgacagaaacaaacctgtcatataatcgcctcaaatgcaaataggttaaatgctccagaaacagaacggctgaatatattttaaaaacatgatccaactaaatgctgcttacgagaaactagccttgtcagtaaagacacatatgaaccgaaattaaagggatggaaaaaaatattttgtacaaattggaaaccaaaagtgaccagaagctacagttatatcagataaaatagactttaagtcaagaaaggtan

SEQ ID NO: 15347 - DNA, 135 bp, Homo sapiens
aggcgctggttaaaagaggcctaacccctggctttagatttacagtccagagcttcactcatccattttacctgacccccaaggtttttttgggaaaattggggggcggggggcctttttttagcgaaaaccagg

SEQ ID NO: 15348 - DNA, 305 bp, Homo sapiens
taaccaataggccaaagaagaaataacaagagaaattagaaaacacttagagttaaattaaaatggaaagacaacttacccaaacttacaggatatagttaagcagtgctcaacaggaaatttatagctgtaagtgtttacattaaaaaagaaacatctcaaatcaataacctaaatttacatcttaagtaactagaaaaagaaggcaatactaaaccccaaaccagaaagaagtaaataaagattaaagttaagataaataacatagagaatagaaaaattagagagaatcagcaaaacccaag

SEQ ID NO: 15349 - DNA, 339 bp, Homo sapiens
gtctcgctctattgcccaggctggagtgcggtggcactatctcagctcactgcaacctctgcctgctgggttcaagcaattttcgtgcctcattctcccaggtagctgagattacagatgtgggccaccacaccaggctaatttttgtatttttactagagacggggggatacagggctggcccgactcacactgagctgtaagactacaggccgggatccaaggtgaactacaaggaggtggtggaagctcgaaccactcgataaacaccacccttgtcggtagtgggcattgtgctctcttggaaacccttgatggctcccaccttcaaactgcttc

SEQ ID NO: 15350 - DNA, 343 bp, Homo sapiens
aacaacctaacataaaaactacaggaagtagaaaagaaagagcaaaccaaactcaaagctagcaaaagacaataaataaccaaaattggagaagaagtgaatgaaattgaaacacaataaaattacaaaacagatgaatctaatggtggttatttgaaagattagataagattgataaacttctagctatactaatgaaaaaaagagagaagatttaaataaacacaatcagtaatggcaaaggggacattatcactgaccccacaaaaacacagaaaaccctcagagactactacaaacacctctatgcacacaatgtagagaaccttcaagagatggatag

SEQ ID NO: 15351 - DNA, 381 bp, Homo sapiens
aatcccaacactgggcagctgaggtgggtggatcacttgagcccagaaggtcgagagaccagcctaggcaacatggtgaaaccccgtctctactaaaaattcaacaataaaaaaattagctgggcgtggtggcaaggacctgtggtcccagctactcttgggggctgaggcgggaggatcaattgagcctgggaggtcgaggctgtggtgagtggtgaccacaccacttcactccagccggggtgacagagcaggagaactgtcacctcctggggaccctgtttccctcgggtattcaaaaatctcccaaagggaggcaagcatgggctacgcagaagaactctcagtaaggactgctgagtctcttcatatgagctgcag

SEQ ID NO: 15352 - DNA, 411 bp, Homo sapiens
ccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtg

SEQ ID NO: 15353 - DNA, 401 bp, Homo sapiens
cgttgctgtcggcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattaagactttgcgggggggtgtaattagcccg

SEQ ID NO: 15354 - DNA, 219 bp, Homo sapiens
ggactatgagaatcgaacccatccctgagaatccaaaattctccgtgccacctatcacaccccatccgaaaaaaaaaaaaaaaaaaactttgggggccgttttttacgtaaatccaaactggataaagaccttggaggagttgggccaaccccccccttgaaggcggggaaaaaagggcttatttggagaaattggggaggctatgggcttaatttgga

SEQ ID NO: 15355 - DNA, 344 bp, Homo sapiens
ttatttcactatgatctgcaattctgttttaattaaatgttttatactttttgacatatttggccagctttctcaatgtcagagttctaaatgaagtcttttcaacctagaattatctttgagattttctagttgggctcctggagagcctcaaacaatgtatttttcagcttgtagagctgttaaactaattaggcttgtttgatgtattgagttgtatgagaagcgttggaggcacagatgggatcaaataacaaagtgacactaagtcttctctaaggtatatttatatggctatgttattgatgtgaaagatctaaaaattatgtaaaatttataaatgg

SEQ ID NO: 15356 - DNA, 367 bp, Homo sapiens
  misc_feature 367: n = A,T,C or G
ggtcttgaactccagaccttgggtgatctgcccgcctctgcctcccaaaatgctgagattacagacgtgagccactgtgcccggccgcctgagacattttgggcaacatctgtgacagaagaaatgtgcatcctttccgggcaggggatttaagaagcggctcatggctgaatatggtatctttgcatctgtctgtggaactgcgggagcatcttctgggataagggactacctgtatgagtcttgtaatgtgttctaaccacgcgcactcccctgtgctcccctatcaccatgactattcacttgaaagcctgatgggcctacgccctcttctgtagcctgtggaggcccaaaatgtttcattgcn

SEQ ID NO: 15357 - DNA, 378 bp, Homo sapiens
gttctccaaccatatggaatcataacagaaatcaaaacacaaagttaactctctaaatacatgaaaattaagcaacatacttctagaaaatccttggatcagagtcacacaaaagaaatatatagcactgaattagaatgaaaataaaaacatacgaacatatgtgggatataactaaaggattgctgagaagaaacctcatagcactagatgcttacatcaaaatagaggaaggaattcaaatcaataaccaaaattctgacctaaagaacctagaaaaagaagagcacattaactcaaagcaagcacaagtaataccggtaataacagaagtcaatgcgaaagaaaaacctgagagaaaatgatacaaagtcaatt

SEQ ID NO: 15358 - DNA, 340 bp, Homo sapiens
tagcactccactcgcagtatgcacagatcatccaaacaaaaaaaaaaaatcagagttaaactaccccctaaacctagtgggtctaactgacatttatagaacatttcacccaactgtggcaaaaaacaaattcctttctttaaaacatgaacattctccagattaaaccttattttaaactacaaaacaagtctcaaagagttcaaagaagtaaaaatcacctcaggtatcacttgggaccacattgaaataaaactagaaatcattacccaagcgaatctcaaaagcttcataaacacatggaaattcaacaacaggcttttgaacatattaaggcaat

SEQ ID NO: 15359 - DNA, 337 bp, Homo sapiens
  misc_feature 337: n = A,T,C or G
ggtaccactagaaaaatccacccaaattaataagagaaaaagaaacaaagaatacataaagcaagaaaacaaccatacgacagaaacaaacctgtcatataatcgcctcaaatgcaaataggttaaatgctccagaaacagaacggctgaatatattttaaaaacatgatccaactaaatgctgcttacgagaaactagccttgtcagtaaagacacatatgaaccgaaattaaagggatggaaaaaaatattttgtacaaattggaaaccaaaagtgaccagaagctacagttatatcagataaaatagactttaagtcaagaaaggtaaaagacn

SEQ ID NO: 15360 - DNA, 365 bp, Homo sapiens
gtcacaagaaagggaagcttatccattaaggaaattgagccccaaattaggaacgatcgggcaaataaaactccaggcctagatgacttccctggggaattccaccagacactgaaggaagaaaggatcccagtcttacatcaaatctcccagagaagacagaaagcaggaacactgtctaactcatgttatgagtctagcaaaactttaatgctaaattctgatgaagacattacaacaaagaaacatcatgggtcaactcttcccatgaaaatggatgtgaaaatccttaaaaatattagcaagtcaaataaaacaatatcacaaccaagtgggatttatttcaaaatgcaaggttgggtgag

SEQ ID NO: 15361 - DNA, 335 bp, Homo sapiens
gtcagtgcggtcacatacttccagaagagcggaccagggctgctgccagcacctgccactcagagcgcctctgtcgctgggacccttcaggtaggacagctcccaatgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggc

SEQ ID NO: 15362 - DNA, 129 bp, Homo sapiens
taccatctactacggaggctgaagcaggaggatcacttgagctgggaggtcgaggctgcagtgaactgtcatcgtgccactgcatttcagcctgggtgactgagcaaaatcaaaaaagggttgggcgtg

SEQ ID NO: 15363 - DNA, 328 bp, Homo sapiens
acgacagaagggaatacatttaaccaaggcagtaaaagatctctataaggagaacaacaaaacactgctgagagaaatcatagatgacacaaatggaaaaatatttcatacacatagattaaaagaatcaatatcattaaaatggccatactgcccaaagcaatttacagtttcaatgctattcctatcaaactaccaatgtcatttttcacagaactaaaaaagctattctaaaattcacagggaatcaaaaagaagcccaaatagccaaagcaatcataagcaaaaagcacaaagctggagacatcaaattaccagacttaaaact

SEQ ID NO: 15364 - DNA, 344 bp, Homo sapiens
tattctcctgcctcagcctcccgagtagctgggattacaggtgccgactaccacacccagctaattttttgtatttttttggtagagacggtgtttcaccgtgttggccccgctggtttcattctctcgacttcaggcgattcacctgcctcggcctacctaagaggtggcattactggctggatgctccgcgcccggtcagaagcctctatttttaaaaagcccattagcttagacaacgctttacccttccttccatttcccctaagatcctgaggctttgtcgaacctaatgaacatcatgggaccattggatcggcccttaagccttttgggaagacatg

SEQ ID NO: 15365 - DNA, 309 bp, Homo sapiens
agtgctgtagggcctcttctccaaaagtctagattctgataactccattctcttccctttgttcccataaccccagggagagtagctgtttcctaaagtcagtgtcccatctttgctttgtcaattctctaatatttatcaatttccttgtattagatcctctcttttaaaataccaagtgtgaggaggctgggtgcagtggttcatgtctataatcccagtatttgggaggctaaggcgggaggattacttgagcctaggaattcaagaccagtctgggcaacatagtgagatctcgtgtctaaaaat

SEQ ID NO: 15366 - DNA, 333 bp, Homo sapiens
tcaagcaattctcctgcctcagcctccagagtagctgagattacagacatgcgccaccacacccggctaatttttttttttttttttaaggggagacggggcttttccttgtggggcagcctggccttgaactcctgaccacggtggggaagaaagctgaagccgacaagaatgataatgccttagaagaccttcagctgctgatgtttgaagccagccttactatctgtgggaataaccttgatgatcccccaacccactggaaccgcctttattgaaaggtcaaacagaggctctgtattggcgaagaggcaatggcacctgaaggaaccc

SEQ ID NO: 15367 - DNA, 292 bp, Homo sapiens
aagttctaatcagagtaatcagacaagagaaagaaatatagggcatccctacaggaaaggaagaagtcaaaccatctctttgctgatgatattattctatatctaaaaaaccctaaagaccaaaagtctcctaaatttgatgacttcaggaaagtctcaggatacaaaatcaacatacaaaaatcagtagcatttctatacaccaataatatgcaaactgagagccaaatcaagaatgcaatttcatttgcagtagccacacacacaaaaataaaatacctaggaatacatc

SEQ ID NO: 15368 - DNA, 398 bp, Homo sapiens
cgttgctgtcgcatttacagaattttttttgttaaaaaaaactgtagaaatgaaggcttgttattctcatttccattacataaatggttgctcaaatgtgaatttctaatttatcatagtttatggtgatacattaagagactaatgtgtcatttgtgttttgatttctacattctagagagacagtttaatcagtccgtgaccaaaatcaaacagagtaaactgtgtcatcatggagatctgcccaggaaatccccaaaatacagaaggatcagaagtagatggaaataatgtcatagaacgtctctcacaactgtgttataagaatgacagggaagctacaggttacaacagatttgtgaactcagccaagcacagtggtggcagggcctagctgc

SEQ ID NO: 15369 - DNA, 324 bp, Homo sapiens
  misc_feature 324: n = A,T,C or G
acacagatacacacaacactcctctaaacaccaccaaaatagacattcttctcaagtgcctatggaacaatcttcaggagagagcacatgttaggctacaacacaagtcttcacaaattcaaaagaaattgaaatcatataaagtatttttgacaataactataaaataaaactaaaagtcaatattataaagaaaatgggaaaatccacaaatacgtagaaattaaacaacatactcttcaatgaccaaaaagtcaaggaaaaagacacaaggaaagttgtaaaatacatcgattattctatcttcttggtgaattagccaan

SEQ ID NO: 15370 - DNA, 389 bp, Homo sapiens
cgttgctgtcgattcaagtcctttgcctatttttttctttttttgaggagaatcgcttgaacctgggagaaggttgcagtgagcagagatcatgccactgcactccagcctgggcaacagagcaatattctgtacaaaaaaaaaaccaggacaaattgaaaaaaaaatggaagcggggcatgggggctcacatgttaaatcctacctagttgggaggctgaaatgggaggattgcttgagtcccgggggtcaaggctggagggagctattatggtaccactgtgctccagccagggcaacaaagggagaccctgctgtatcttaaaaaggaaaaagggtggggcgtgagggttcacgcctgtaatcccagcactttgagacgccaaggg

SEQ ID NO: 15371 - DNA, 336 bp, Homo sapiens
  misc_feature 293: n = A,T,C or G
atatgatatatcaacttaagttattttaaataacttacaagacacattgaaaacaagtaacaaatgttaatcctttgtgatcattattttaaatgtaaatagattagactccctagtcaaaagactagagtggctgaattctgaatggattaaaagaaagaaaaagaaagattcgattttaaactttgtaaaggaaactcactttagatttaagatcacttacaggctgaaagtgaatggatggaaaaacacattctgtgcaagttgtaaccaaaagagagcagagatgactntacttatatgagacaaaataaactttgaaaaacactgtcaaat

SEQ ID NO: 15372 - DNA, 327 bp, Homo sapiens
tctagcagtagacagtatataacttagagtcaagaaatgttgggccaggcgcggtggctcacgcctgtagacgaaaggctcccggagtgatgatcgtctagagacttgatagaacatggaagggggacgttgcccacatatatgcaaatctattgcactggagatattgcagacataaaggaaatgggtactgttcataaaagaatgccccacaagtgttaaaaatgtgcctgataaaatataagtgactactggcctggagcagtggctcacgcctgtaatcctagcactttgagaggccaaggcaggtggatcacctgaggtccg

SEQ ID NO: 15373 - DNA, 331 bp, Homo sapiens
ggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaa

SEQ ID NO: 15374 - DNA, 319 bp, Homo sapiens
aggctgaagtgcagtgatgcgatcatgactcactgcaccctcaacctcctgggctcaagtgatcctcccaactcagcctgccaaggggctggtaccacaggaatgcaatcataaacttctgggctcaaatgatgactcttgatttggtactcccaaagagcaggaactacacgcatgagccactgagcctggctggaactaaacagatcacactgtgctaaaagaaaatatttcccacgtattacttctaacagctgttacacaaatgcgtctaggttcataaactatatcacttgtaaaattccctttataacgctca

SEQ ID NO: 15375 - DNA, 332 bp, Homo sapiens
ggagttcaaggttacagtgagctatgatcatgccactgcactccagcctgggcaacagagcaagacttgtctctaaaaaataaaaataaaggtgagatgcacaggacctgtgtgtagaatgttatatgagtaaggaaatatagtctaaagtggaaaataaaaaggttatagcaggcatttaaagggagacaggaagagcaagtggatagaaaagtatttgaagagttagggaacaagggagtaacacctgacttgcttctcagtctacccgaagaatctgtaaatcaccaggcatggtggctcatgcctgtaattccaacactttacgaggc

SEQ ID NO: 15376 - DNA, 193 bp, Homo sapiens
agacaaaaaaggaaggaatcgaaccccccatagctggtttcaagccaaccccatggcctccatgactttttcaaaaaaatagaaatgaatactataatgagggggcgcttttctcttgaatccccaaatttagaaaacctttggggggtgggggcccccccccctttttatgggggggaaaacattttttttt

SEQ ID NO: 15377 - DNA, 378 bp, Homo sapiens
ttccaaccttcctttttttaaattttctccagtccctgggagcaagttgcagtcttttttttttttttcccttttgggcccaaccccccttgttttaagggccttttttttaaccccaggggcccaaattaaatgggggggaaaacccttggcccaaaaaccaggggaaaaaaatccttacccctttttggtcaaaagtaatttttaacccttcccccttgaacaaaaaccggtgggaaacaaccccccccgaccttggggaaaaaaaaaaaaacctgccccctttctttttgtggaaactggagggggcgaagcccccgggaaaaagccaaaaaaacccaacctttttccccccttcctgggaaaatgggcccaaaa

SEQ ID NO: 15378 - DNA, 343 bp, Homo sapiens
tctgcaggctgcagtgcaatggcatgatcatagctcactgcagccttgaacccctgggctcaagtgatcctcccactttagtgtcccaagtattaaatagctggcattacagacatgtgccaccatgcctggctgtttctcgttttttttagagatgggatctcactatgttgccaaggctggtctcgaacttctggcctcaaatgatcttcttgccttggcccctcaaagagctggattacaggagtgagctactgtgtccagcctaatcttcgttcttggagtcaagttgtgtaggctttgttttttgctttgcttttttttttttcccccaccctaagtg

SEQ ID NO: 15379 - DNA, 147 bp, Homo sapiens
cggtacggttgcgagaaaacaacagaaggggctctttccgccatctttccgcgccgccacaatggtgcgcatgaatgtcctgtcagatgctctcttgagtatccacagtgccgaaaagagaggcaaacgccatgtgcttattatgcc

SEQ ID NO: 15380 - DNA, 382 bp, Homo sapiens
ggcacgagctggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcaccctgaagaactgggaggccctccactgaagaagctgaaacaagaggttggagaacagagtca

SEQ ID NO: 15381 - DNA, 460 bp, Homo sapiens
  misc_feature 460: n = A,T,C or G
ctactaaacaagctacgcaggactttctgcaagatcccatcgattcgtagttccgtagctagtagcaactacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctacccactcacccatccatccaaccttccaaccatttatccacccatccaactatttccatctgttcattttccacccatttacccn

SEQ ID NO: 15382 - DNA, 385 bp, Homo sapiens
cgttgctgtcgttcaatttcttgaatgttttaagacttgttttgtgaacctaacatatggaatatcctacagaatgatccatatgctgaggagaagaatgtgtattctgcagccattagatgaaatgttcggtaaatatctattaggtccgtttggtctttagtgcagattaaatccagtgtttctttggtgattttctgtctggaagatctgtctgttcaatgctgaaagtagggtgttgaagtctccagccattatcgtcttgagatctcgctctctctttagttctaatatttgctttatgtatctcagtgctccagtgatgggtacatatatactcacaatcattgtatcctcttgctgcattgactgcattatcattata

SEQ ID NO: 15383 - DNA, 333 bp, Homo sapiens
ggatttatccctgggatgcaaggatgggtcaacatatgcaaattaattaatgtgatatatctcattaacagaatgaaagataaaaattacatctcaatagaagcagaaaaaaatttgacaaaattcaacactcttttacaataagaattatcaacaaagtatggaaggaatatacttcaacatgttaagagctataatacgaaaagcccagagacaacatcacaactagtggtgaaaacctgaaagtgtttcctctaagatcaggaaaaaggcaaggaggccaactcttgctacatctatttaacatagtactggaaattctagccagagcaa

SEQ ID NO: 15384 - DNA, 311 bp, Homo sapiens
atactgctttgtgatctgtggattcctcttacagggttaaaccattttttttgattcagcaggttggaagtactctttttgaagaatctgcgaggaaaggttgggagcccattgagacctatggggaataacagaatatctccagataaaaacaagaaagaaattatctgtgcaactgctttgtgatgtgtggattcacctcacagagttaaacctttcttttgattcagcatgttggaaaccctgtttttgcatgttctgcgaagagacagttaagagcccattgaggcctatggggaaaaccaaatatc

SEQ ID NO: 15385 - DNA, 313 bp, Homo sapiens
taaaggccagatgttatcagcagctgaacagcatctacagaaaccagctgcaaagacagaagcagaaaaactggtttggtggagagacccgataacaaaaagttgggaaataggtaaaataataacctggggtagaggttatgcttgtgtttctccaggccaaaatcaacagccgatttggataccatcaagacacctgaaaccttattatgagccagatgctgaggaagagattctgggaggatcccaaggactccccagttgcagccatgtcgagactgatgctgaagaggaccccaactgtcacaagcaa

SEQ ID NO: 15386 - DNA, 355 bp, Homo sapiens
attaaaggaactcttaggtgaaaaatcagataatgaaatttacatctcaaagtacagagagaatctgatggtgcttgagggagattaaaaatgaatgccgaatcaaacataaaattatagaaatctatcatagaattatgtaataagaccaattttattttgctagagaccacctatctcctaactgggtatctgagctttgggcagagcccatgttcaatcctggttctccaaaaaaggagaattcttatgtggctaggccaggtgattgttctacagtacatcaaggaaatctttttaacaaagacatttctatgtgtctaagctatactattcctttaagatccaagagtag

SEQ ID NO: 15387 - DNA, 405 bp, Homo sapiens
cgttgctgtcgctttttcccagaaaacaaggggttagatgttgcatttcataaaactaaccgaagttctgtctactgatgcagcacaagagatgtataaaaaaaaaaaaaaaaaaccccccccccgggggaaagacccttttaaggtttggtttggtttttttttttgggttgggtttttggtttttttacctcagggaaaaacctggaaaaggggcaaaacctcttatttggattttttattagggggccttttttaaaaaaaaggctccactgggaaaggaaaaaggggggggggggggggaaaaaaaaaaactttgggggtagggggatataaaaaaattttggccctttggttcaaaaaacccgcattttaaaaaaaaaaaaattcccaccccaaccaccc

SEQ ID NO: 15388 - DNA, 386 bp, Homo sapiens
ggcacgaggtttactggtgcagagaaccattgcaggacttctcctaaagaaaatttgtaggggtgtctttgtccaagacaccccccagaatctaaaaatgctgcgtatagtggaaccttatgtgacctggggatttccaaatctgaagtctgtgcgagaactcattttgaaacgtggacaagccaaggtcaagaataagaccatccctctgacagacaataccgtgattgacgagcacctggggaagtttgtcgtcatttgcttggaagacctcattcatgaaattgccttcccagggaagcatttccaggagatctcatgggtcttgcgccctttccacctctcagtggcccgtcatgctaccaaaaatagagtgggctctctca

SEQ ID NO: 15389 - DNA, 350 bp, Homo sapiens
atagttgttcacactgagcctctagcagttcatcaattacagttcaggtttcttatggaagtttgctgtgtgagtgtttctgctctgattactcgtgattctccgtattcaccttctgtctctccagtttgggggcagctgtttgacctgtgacttaacttctcttacagatctaagaaaagttgttgatttttcagtttgttcagctttttacttgctcttaggatcgagttgactgatctcttctcgcctgcttctttttgtgttcccttttttttttatactcaacttctttcctcctttatttgctcgcgtcctggttctcatcgattctctcttctccccttcct

SEQ ID NO: 15390 - DNA, 323 bp, Homo sapiens
attgagagctataacaagaaggcaaagtatcttcttgtgtgacctcagctgggaacatgcacattgagagactcaaaccttttgctgccccacacacatccatgaataactacaacagtgctgcaagtattgatttgggggttttgaataaattttaatgagcagataaatttgcaaatacagaatctgcaaataatgagggtcactggtatttggtgctttttcgagaatgggtggaagacggcactcagctgggactgtccaatggggagaggtccatgtgtggccctccaacatgtcacagggcacttggacttcttatt

SEQ ID NO: 15391 - DNA, 317 bp, Homo sapiens
aggtagataaacggatggacagatgctgggtgaatggatgggtggatagatggataaattgatatatggatggatgagtagatacatgggtagatgggtggacgaatatatgagtggactagtaaatgggtgagtgaatgcatggatggatggatggatattttgacgagttaatatatattttggatgtttaaggatatttattttttgtatattggattttattttatttatttttgtttttttgtatattatttatattttttgttttttttataaatatgttgtttttgatatttgcggtgtgtttatttttg

SEQ ID NO: 15392 - DNA, 387 bp, Homo sapiens
attctgtacacacagcctatggggtagccctgctccacagttgcggttgtacactgctgcttcaataaaagttgctgtttaacactaccagctcacccttgaattctttcctgggtgaagctaagaaccctcccacgctaatccgcgattttggggcttgcctgtcctttcaataggacattgctaaattgctctctagaattgcttttccaggttgggcgcagtggctcacatctgaaatcccagcactttgggaggctgaggcaggcagatcacctgaggtcaggtgttcaagaccagcctggcctacatggcaaatccctgtctttactaaaaatacaaaaattagctgcgcatggtggcctatgcctgtaatcccagctactt

SEQ ID NO: 15393 - DNA, 328 bp, Homo sapiens
attctgtacacacagcctatggggtagccctgctccacagttgcggttgtacactgctgcttcaataaaagttgctgtttaacactaccagctcacccttgaattctttcctgggtgaagctaagaaccctcccacgctaatccgcgattttggggcttgcctgtcctttcaataggacattgctaaattgctctctagaattgcttttccaggttgggcgcagtggctcacatctgaaatcccagcactttgggaggctgaagcaggcagatcacctgaggtcaggtgttcaagaccagcctggcctacatggcaaatccctgtctt

SEQ ID NO: 15394 - DNA, 343 bp, Homo sapiens
gactttcagagacaaacaaaagctgaggaaatttatcaacaccagacatgtcttacaagaaatgataaagggagttctttaatctaaaataaatggacactagatgcaacaagaaaccgtctgaaggtattgaactcccaggtaaaagaaagaaaatagacaaacttaaaatactcctaatactgtaatcgggataagtaaatcatatatcctatgtatgaagactaaaagacaaaaatgttaaaaataactgcaggccaggtgcggtggctcacgcccagtaatcccagcactttgggaggttgaggcgggcagatcacgagatcaagagattgagaccagc

SEQ ID NO: 15395 - DNA, 318 bp, Homo sapiens
gagtgcggtcacatacttccagaagagcggaccagggctgctgccagcactccactcagagcgcctctgtcgctgggacccttcaggtaggacagctcccaacgctgtggggactctcagcaaaacttctccttcctttccacggctctgcttcttctgacctcatcttagctttgctttttcttttcttccttcgctatttttctatgatcctctaagaaccaagtccttgaaacttttggctcaaagtggatacagagacaactttttctagaaagttcagaaaagtgtattttgaggacggagtctggggaaatc

SEQ ID NO: 15396 - DNA, 302 bp, Homo sapiens
ccatccatccatcctttcagccagccagccagcctgccttctgtctaaccattaatccactcagccacctatccacccatccatccatgcattcagtctatccatccctgcatccaatccatcctttcatgtatctgtccgctcatccatccacccattcatctgtccattcaaccacccacaaatctacccatccatgtgtgggagagcatgatttaactcatatataaacaatttataattactgtgataagagctgcaaagggaataaacatggtattaaaggataatagtcactagtg

SEQ ID NO: 15397 - DNA, 347 bp, Homo sapiens
catatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcgacaaaaacaaaaattgacaagtgggacctaaactaaagagtttctgcacagcacgagaaactatcaacaaagtatacagacgacctacagaataggagaaaatattcacaaactatgcatctgacaaaggtctaatacccagaatctataacgaacttaggcaattctataagcaag

SEQ ID NO: 15398 - DNA, 374 bp, Homo sapiens
ttccttggcttataaaacgtttttcagtttgatgcaaaatgatgcgcttattttggtttttgttggctgtgcatttggagtcagagccaacaaatcattgtcttgaagcttttcaactatgttttcttctagcagttttatagtttcaggtcttaggtttaagtctttaattcattttgagttggatttgtgtgtggtgtgatgtaagggatgcatgtggatattcattttcctgacaacatttattgacgagattgtcttttccccatcatgggttcttggcacctttgtcaaaaatcagttgaccttaaaaatgtggatttatttctgggctctctattcttttccattgaatgatctgtttgtttttatac

SEQ ID NO: 15399 - DNA, 387 bp, Homo sapiens
  misc_feature 49: n = A,T,C or G
agcactctgggaggccggggcgggctgtttgcttatgttcgggatttcnagaccagcctaggtaacatggcaaaaccccgtctctacaaaaaatacaaaaattagcctggcctatattcccagttacttgcggggctgaagcaggaaagattgcttgagcctacgaggtcgagactgcagtgagctgagattgtgccactggcactgtggcctggatgataaagtgagaccctgtcttataaaatcaagagaaaagagaagaatcagtattgtgattaataagggagaattccacgctgggcatggaggctcatgcctgtaatcccaacactttgggaggccgagggggcatggatcttctgtgggcaaggattttcagaaccagcg

SEQ ID NO: 15400 - DNA, 149 bp, Homo sapiens
gctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagg

SEQ ID NO: 15401 - DNA, 402 bp, Homo sapiens
  misc_feature 318, 368: n = A,T,C or G
attccacattccagccagtgggaaaaggaaagggggaatggcataccctttccctttaaggtacaccctaggctgggcacagtggtgtgagccagaagtcccagctactcgggaggctgaggcgggagaatcacttgagtccaagagttctgggttgtagtgcgctgtgtcaatcgggtgcctacactaagctcagtatcaacatggtgatctccctgggagaggggaaccaccaggttgcctaaggagggctgaaatggcccagatcggaaaggtcaaaactcccgtgctgatccagtagtggaatcactcccgtanatagccaaaacactccagcctgggcaacaaagtgagaccctgtctctaanaaaaaaaaaaaaaaaaaacaccctggctgggcag

SEQ ID NO: 15402 - DNA, 336 bp, Homo sapiens
gctctgccagccactggagaatggacgtaatggagccaaggatggcaccaggaagtcacgggggcagtgtttgctgctgtccaggcaatcacagtattggtgtcgtgtctcagcaggctgggggttggggccctggattcaaagcatccatctgaacatattgtcacccgtgcatcctgagagagacagcttcatggagtggaggtgtgtggcctggaggccccacgtaggccaccaggcatgttttccacgaaaaccgaaacttctgacgggattactaacattgggagatttccgtttcttggacgccagtggaggggctgcaccagccttaaa

SEQ ID NO: 15403 - DNA, 362 bp, Homo sapiens
  misc_feature 362: n = A,T,C or G
gatgacttcccttacctactttgtccagaggctgttcacctgggagacctgctggtatatgggccacggagatttgcacccccttccccggattctcaagtgccactagaagtctccagaactgtgaatttattctagcacgccctgcacttcacaagaaaaagagatctctccctgggctcctgccggctcctccaggatacagcactggagaaggcaacttggtgtttcctatctccgccactctggatttgggaatccaaacccaactccctttctatcactgacagcgattgaggccaatgcctactcctttgggatgatgctcgcctgtctcaagaccgactgacccatgttcaacn

SEQ ID NO: 15404 - DNA, 278 bp, Homo sapiens
tgcggatgcgatcatgccacggcactctagcctgcatgatagagcgagatcctgtttatgaagaaaaagagactgggcacggtggctcacgcctgtaatcccagcactctgggacgccgacgtgggcggatcacgaggtcacgagatcgagaccatcctgggcaacgtggagaaaccctgtctctactgaaaatataccaaataactggggatggacgggcacacctgttgcctcagtttcttgggaggttaaggcctgggaaccacttgggcccggt

SEQ ID NO: 15405 - DNA, 316 bp, Homo sapiens
actggaatggaatattttcagatatgaccagattgctttgaggaattgaagttgactttatagagctaataaaaaacccagtttctttgcaagtttcctgacctgtgtaccttgactgaaaaggtacctttacaaggtacacagtttcttcacaaggttcctgacctgtggtaagtgacgagtgttactttctgacgtgcccaggaacctcaagttattttgggacctcaagaagagaagaatttacccaattcatacaggcattgcagacagtcaatgattaatgacaaatccttgccttggttttatagcctcc

SEQ ID NO: 15406 - DNA, 340 bp, Homo sapiens
ccagctacttgggaggctgaggccggagaatcacttgaacccggggggcagaggttccagtgagccgagatcctgccactgcactccagcctgggcgacagcatgagactccgtctcaaaaaaaaaaaaaaaaaaaaatggcccgggaaggggggctaatccctgaaatccggcccctttggggggccgggggggggggatcacctggggtaaggatttcaagacccccctgaccaacagggggaaatcccatctttcccaaaaaaccaaaatttatttgaccgtgggggcgggccctttgatccccaatttttttggagggcttgaaacgggaaaattg

SEQ ID NO: 15407 - DNA, 136 bp, Homo sapiens
gagccacctcgcgcgcgcctccaggagcaagtatggagaggctggtgatcaagatgcccttctctcatctgtctacctacagcctggtttgggtcatggcagcagtggggctgtgcacaacacaagtgcaagtggg

SEQ ID NO: 15408 - DNA, 408 bp, Homo sapiens
ggcacgagccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatatagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcg

SEQ ID NO: 15409 - DNA, 322 bp, Homo sapiens
attccacattccagccagtgggaaaaggaaagggggaatggcataccctttccctttaaggtacaccctaggctgggcacagtggtgtgagccagaagtcccagctactcgggaggctgaggcgggagaatcacttgagtccaagagttctgggttgtagtgcgctgtgtcaatcgggtgcctacactaagctcagtatcaacatggtgatctccctgggagaggggaaccaccaggttgcctaaggagggctgaaatggcccagatcggaaaggtcaaaactcccgtgctgatccagtagtggaatcactcccgtaaatag

SEQ ID NO: 15410 - DNA, 334 bp, Homo sapiens
gactcactctgccagccactggagaatggacgtaatggagccaaggatggcaccaggaagtcacgggggcagagtttgctgctgtccaggcaatcacagtattggtgtcgtgtctcagcaagctgggggttggggccctggattcaaagcatccatctgaacatattgtcacccgtgcatcctgagagagacagcttcatggagtggaggtgtgtggcctggaggccccacgtaagccaccaggcatgttttccacgaaaaccgaaacttgtgacgggattactaacattgggagatttccgtttcttggacgccagtggaggggctgcaccaa

SEQ ID NO: 15411 - DNA, 132 bp, Homo sapiens
gagccgcctggataccgcagctaggaataatggaataggaccgcggttctatttcgttggtttttcgagctggggccatgactcacatggggtgtcgggcgtatttggattgtttcgagtggaggggtgggg

SEQ ID NO: 15412 - DNA, 321 bp, Homo sapiens
taaacttaagtaaaggagtggaaaagggcatttcatgcaaatggacaccaaaaacgagctggggtagcaattcttacataagacaaaacaaactttaaagcaacaacagttaaaagagacagagatgttatataatggtaaaagtccttgttcaacaggaaaatatcacaatcctaaacatacatgcacctaacactggagctcccaagtttataaaactatgactaatagacctaagaaatgagatagacaacaacacaataatagtgtgggacttcaatactccactgacagcactaggcaggtcatcaagacagaaag

SEQ ID NO: 15413 - DNA, 312 bp, Homo sapiens
  misc_feature 312: n = A,T,C or G
ggagcactgggccaaaaacaaaatcaagagggaaattaaaaacattctttgaattgaatgacaataacagcacaacctatcaaaacctctgggagcagctaacgtggtgcaaagaggaaagttcgtagccctaaatgcctacatcaaaaagtctgaaagagcacaaacagacaatctaaggtcacacctcaaggaactccagaagcaagaacaaaccaaacccaaacccagcagaaggaaggaaataaccaagatcagagcagcactaaatgaaattgaaacaaacaaaacaacaaaatacaaaagacaaan

SEQ ID NO: 15414 - DNA, 157 bp, Homo sapiens
tccttttgggaggtgacgacctacgggcactttaacgtgcctatcacctaggatctccataatatgtctctagaagaggagatgaggaatccctctacaaaacacgtgatgcggagccccaattcctacttcctggatgtgaaacgcccatgatgct

SEQ ID NO: 15415 - DNA, 336 bp, Homo sapiens
tgctttgagtagtaagggcattttaacaatgcttatttttccagtccatgaatatggaatatctttccatttatttggatcttcttcaatttcatgcaccagtgtttgatagtttttgttacagagatctttcacttctttggttgattcctagggattttataatatttattgatttgcaaataatatttattgatttgcaaatgttgaaccatgcttgcattctagggataaatcccacttgatcatgatgaatgatctttttaatgtgttgctgaatttgatttgctggtattttgttgagaatttttgcatcaatacttaattgcatttcag

SEQ ID NO: 15416 - DNA, 413 bp, Homo sapiens
  misc_feature 386: n = A,T,C or G
gactcactctgccagccactggagaatggacgtaatggagccaaggatggcaccaggaagtcacgggggcagtgtttgctgctgtccaggcaatcacagtattggtgtcgtgtctcaacaggctgggggttggggccctggattcaaagcatccatctgaacatattgtcacccgtgcatcctgagagagacagcttcatggagtggaggtgtgtggcctggaggccccacgtaggccaccaggcatgttttccacgaaaaccgaaacttctgacgggattactaacattgggagatttccgtttcttggacgccagtggaggggctgcaccagccttaaaaagaaatcatgtgagcctccacgaatcagcagacacaggagaaantaagggtctgcccactttagtgggttg

SEQ ID NO: 15417 - DNA, 338 bp, Homo sapiens
gtaacaaactgtggtcaaggcagaaacaaacagtgagatcaaatcagtaatttaaaaattgccaaaaaccaaaagcccaggtctaggcagattcacagctgaattataccagaccttcaaaaattaatggtattaatcctattaaattatcccaaaagattgaaaaaaagggaatcttccctaacatagctgtgaaatcagtatcactttgacaccaaagtcaggaaaggacatagaaaagtggaaagtagagaccaatatccctgatgagtatacacgcaaaaatcctcaacaagataccagcaaatataatccaacagcacattaaaattgtaatt

SEQ ID NO: 15418 - DNA, 333 bp, Homo sapiens
ataagcaaaaggcccagtccctgtcctcaggagctcatggtccaagtcaaaatcacataaaaacatttgagtcccctttgaaatgagtattgttttcttgaacaaattttcaacttgctgtagtttttttcctgatcactttcatcctgtctttccaagatgggatatgtttatttagaaattacttcacctgggacagctgcttctctcttttgctcaggcccgtagcactgcaggatgggcaagtgtcgtggacctcatactgctaggagtctctgtagtcaccaacaagatcagaagtggcatgataaacagtacaagaaagcccatttg

SEQ ID NO: 15419 - DNA, 344 bp, Homo sapiens
cagtgttcaagatacaaaatcaatgcacaaaaatcagtagcatttctatacaccaacagcatccagggtgcacgtggaataaaaaacacaatcctactcaaaatagccacaaagaaaatgaaattatctaggaatacagctaaccaaagaggtgaaagacctgtacaaagagaaccaccaaacactgctgaaagaattcagaaatgacacacatgaacagaaaacattccatgctcatggattgaaagaatcaatgtcatttgaaatgtccatactgcacgaagtaatttaaagattcaatgctattcctatcaaactaccaatgtcattcttcataggattag

SEQ ID NO: 15420 - DNA, 400 bp, Homo sapiens
gggaaatgcgtgttctagctttctgtgtgcttaggtgcccgagctactgagggtctaagtccgggcagccgaagagtgtggtcgcaagatgaacaaagatgcgcagatgagagcagcgattaaccaaaagttgatagaaactggagaaagagaacgcctcacagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtggtgg

SEQ ID NO: 15421 - DNA, 354 bp, Homo sapiens
ggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctaacaagaataagaacatt

SEQ ID NO: 15422 - DNA, 278 bp, Homo sapiens
cgccggtgtgatacactgacctgactattaacagcccaatatctacaatcaaccagcaagtccttattaccctcactgtcaacccaacacaggcatgctcgtgggaaaccaccctttatttgagattaaaaaagggggcttttttttaaaaagccccaccacttggcatatcctgggaggggttggcccccccccccccttggtggccggggaaaagggccttttttttgaatttttggaacccccggggttttttgggccccttataacccggcatt

SEQ ID NO: 15423 - DNA, 336 bp, Homo sapiens
gggaaatgcgtgttctagctttctgtgtgcttaggtgcccgagctactgagggtctaagtccgggcagccgaagagtgtggtcgcacgatgaacaaagatgcgcagatgagagcagcgattaaccaaaagttgatagatactggagaaggagaacgcctcaaagagttgctgagagctaaattaattgaatgtggctggaaggatcagttgaaggcacactgtaaagaggttattaaagaaaaaggactagaacacgttacttgtgatgacttggtggctgaaatcactcccaaaggcagagcccttgtacctgacagtgtgaaaaaaggagctcc

SEQ ID NO: 15424 - DNA, 334 bp, Homo sapiens
agaacttgagaaactataaatacatagaaactaagcaacatgctcttgaatgatcattaggttaaggacaaaattaaggagaaaatcaaaaaaattcttgcaacaaatgaaaattgaaacacaacataccaaaaacctacgggatgtggaaaagaaggaaaatttccagcaataaatgcctacatggaaaaaatagtaagatttcaaataaacaatctaacaatgcaactctataagctagatacacaaaaacaaaccagactcaaaattagtaaaataaataataagatcagagcaaagctaaataaatacgagagatcaatcaaacaaacat

SEQ ID NO: 15425 - DNA, 331 bp, Homo sapiens
ttctgtctcagcctcccgagtatctgggactactggtgcccaccaccacacctggctagttttttgtatttttagtagagacggggtttcaccatgttggtcaggatggtctcgatctcttgacctcgtaatgtacccgactcgggctcccaaagtgcctggatgacctctacgtatctgttagatttacttctccacgttcttatcaacctgtttgcgtatgctcatgagctgtttcttgttccgggagtgaagccaggccttttcctttctcttatgcagagtaactgccactgcctgggactttcagtcaacctcgtgcgccaggcac

SEQ ID NO: 15426 - DNA, 334 bp, Homo sapiens
aaattaacaatctaacatcacacctagaggaactagaaaaacaaaaacatactaaccccaaactggcagaagaaaaaaaaataactaaaatcagagcagtactgtacagaattgagacccaaaaaaatcatacaaaaattcaacaaaaccaaaaggtggttcttccaaaggataaacaagattgatagaccacaggctaaattaacaaagaaaagagaaaagatccaaacaagcacaatcagaaacaacaaaagtgaaattaccatcaatcccacaaaaatacaaaaaatcctcaaaaactattatgaaaacccctatgcacaccaactaaaaa

SEQ ID NO: 15427 - DNA, 337 bp, Homo sapiens
agtgagccatgattgtgccaccacactccagcacaggcaaaaaagcagaccctatttctaaaaaaaaaaaaaattaaaattaaaaacatttttaaagaatgacatttcacaatgataaaatgacaaacccatcatgatgatataataattacaaacatatatgcccctaacaacagagcctcaaaatacatgaagcaaaagctgacagaattgaagagtaaaatcatcaatacaaaaataatatttggagccttcaatatcccactttcaattatgaacagaacaactacacagaaggtcaatgaggaaataaaagattgaataacacttcaaacca

SEQ ID NO: 15428 - DNA, 343 bp, Homo sapiens
  misc_feature 13, 14, 15, 16, 17, 18, 19, 20, 21, 22, 23: n = A,T,C or G
tacggttgttagnnnnnnnnnnngggtactgtttttctgagcacaggatataggaatcaatctgttcttattttatatttcaggtaatatctcccagctgtaatgatgacatcacagtgaaaaaggatcagtgtttagttcgatcatttattgattctaaattgtgagtaatgaatcctttaatgatgttacgtgggaggaaaaaaaaaatagaattacaatgatagacacctcccccaccaaaactttatttttaaaagtctaatcattcatgaactgagaagttgttacctaataggttttgactttttgtaatgtagggtatttttcactaataaatttg

SEQ ID NO: 15429 - DNA, 354 bp, Homo sapiens
agggggtgcggcgcgggtcctccatatgctgagcgccggtcccctgggcccacttttctttctctatactttggctctgttgcctttcttttctcaagtctctcgttccacctgaggagaaatgcccacagctgtggaggcgcaggccactccatctggtgcccaacgtggatgctttcctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagccttgcggtaagcttgtgtg

SEQ ID NO: 15430 - DNA, 317 bp, Homo sapiens
gatataaattaatatacaaaaatcaattgtatttctatacacttgcaatgaatcatccaaaactaaaattaagtaaacaatttcatttacagtaacatcataaagagtaaaacatttacgaataaatttaacaaaaacattttcaacatatactctgaaaactacaaaacattgtttaaagagagtcaaaaatatctacagaataggaaaaagaatgcacattcacgaataagaaggcttgatattgtttaagatgacaatattccccaaactgatctacagattcaaagcagtctgtagcagaatcccagctgacc

SEQ ID NO: 15431 - DNA, 318 bp, Homo sapiens
gcatggatgattttcaaggatagaccatggctaggccacaaaataagtctttaaaaactaaagaaaaaatataattatgtcaaatatcttttccgattacacaggaaaaagctagaaataacaggaattttggaaaatatgaaaaataaacagtatgaatgtcctgaatgactagtgagaaaacacagaaattaagaaaaaataaaaataaattgaaacaaatgagaatgaaaacacaacataccaaaacctatgagatacaacaaaagcagtactaagaggaaggtttatggcaataagtgcctacatcaaaaaagg

SEQ ID NO: 15432 - DNA, 234 bp, Homo sapiens
  misc_feature 167, 234: n = A,T,C or G
cccaggagggttggccggacacagtggtagtggctcacacctgtaatcctaatgctttgggagcctgaggcgggaggaccccttgagcccaagaggtcaaggccacaatgagctatgatggtgccactgtactccggcctgggcagcagagcaaaaccctgtctcanaagagagagagaaagccgggtgtggtggttcacacctgtaatcccagcattttgggagcccaaggcn

SEQ ID NO: 15433 - DNA, 345 bp, Homo sapiens
agataaataattgtgtctttccttgtgttcattctgagctttatatatacttaatgcataacacctatcacattggactacaactaactgtttcttcccttctaggtaatgatctccaaaatataaacatgatttatcacttggcacatgatatttcataaatgcttgttgaacaaacaaataaaatactatcaaaggtgggaaggaaggaacaaaagggaaatagtatgagatagtttttacctgcacgagttcattgaggacaacagcatcaaagccagaaaggtactgcacgtaatacctctgcattacaggtccgtatttcctcacatgtgctctaaggtc

SEQ ID NO: 15434 - DNA, 402 bp, Homo sapiens
cgttgctgtcgatttcgattttctggaaatataatttgtcactttaaaaattatgtaaattgctattggtattaagtgtaagaaaactttgcttcatctatgatcacaaatattttcttctgaaaaaaaagctctctgaagagttttttttttcaatgaaggggttttctttcttctctccatatgttatcttctgaatagctaagcaatgtttacattatttattcaggcctttccatccactttcacggattccactgaaggagaaattgggtttgaaatcctcttttctcaaaaactaatgagtcatgcgggcccatgatgagctgtaacttctcaagaggaaagaaccccgtagaaaactatagctggaaggatctaggttgacctgtctgtgattta

SEQ ID NO: 15435 - DNA, 303 bp, Homo sapiens
gaaggaaattggaaaaaaaaatttaaacaaatgataatgaaaacacaacattccaaaaactatgagatgcaacaaaagcagtactaaaagggaagttaatagatacaagtgcccacatcgtaagagaaaaaaaacttgaaataacctaatgatgcatcttaaataactagaaaagcaagagcaaaccaaacccaaatttatgagaagaaaagaaagaataaatatcatagcagaaataaattaaattgaaacaaagaaaacaatccaaaacatcaatgaaatgaaaagttggtgtgttgaaaa

SEQ ID NO: 15436 - DNA, 314 bp, Homo sapiens
tcttcactgatgatatgattctatacctggaaacccctaaacatttcaccaaaaagcttctagacttgatgaacaacttcagtaaagtttcaggatacaaaatcaatgtgaaaaaatcaataccatttctatacaccaataatgtttaagctgagaaccaaaccaagaacataatctcatttacaatacacacacacacacacacacacacacacacacacacacacacacacagagataggtatatatctacgcgggggggtgagagatctctacagagagatctacaacactctggtgagagaaatcagaga

SEQ ID NO: 15437 - DNA, 320 bp, Homo sapiens
ggcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattggagacaaggtgaccagagaggcccaagtacgtcg

SEQ ID NO: 15438 - DNA, 313 bp, Homo sapiens
gcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagt

SEQ ID NO: 15439 - DNA, 341 bp, Homo sapiens
ggatctcgctccgggtcccgcagtgggtcccggagaggaagcttcgacgccacagggaattcttcctactcttattcctactcatttagcagtagttctattgggcactagtagtcagttgggagaggacgctataccttgacttcatttataagactatccactttattaagtagtagaaaacaaaataaaggtgctgtgtttatgatagacaagatattctcctgcttacaacataacttaagacagatgggggggcttttacgcatcgcgtctttcgggctctatgttctccttatcccaaaaattcgattttccgcgttgtgtatataaagtgaggg

SEQ ID NO: 15440 - DNA, 372 bp, Homo sapiens
  misc_feature 372: n = A,T,C or G
tacggctgttagaatacgacagaacgggattgtgtaaggagaccaatctatttagatacgagactacctatattctaactggatctctgagctctgggcagagccatcactggaatcctgggtctccaccaagggagaattattatgaggctagaccacacgatgcttttacagagcacttaaaaaaaaatcttttttttttgagacaaaaatttttttttttttgaaagggagtttggttttgtcccccaggttgaagggtaaggccagaatttaagctcattgcaggctttgggcccggggttaatgccgttttcctgcctcaccctccaaagtatctggaactacagggccccgccaccaaaccgggtn

SEQ ID NO: 15441 - DNA, 328 bp, Homo sapiens
gcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagc

SEQ ID NO: 15442 - DNA, 286 bp, Homo sapiens
  misc_feature 286: n = A,T,C or G
acaacctggaaaggtcttcctcactacacggagtagtcaaacagtcaaaaatcaaagacaaagacaaaattctaaaacagcaagaaaaaaagtatctagtcacttataagataaatcccaactgacaaacaacaaatttctcaacagaaacctcacaggccaggaaagaatgggttgatacattcaaaatgctgaaacaaacaaaacaatgccaaccaaaaatactatacccagcaagggtaacctttataaatgaagggaaaataaagtatttctcagataagcn

SEQ ID NO: 15443 - DNA, 360 bp, Homo sapiens
aaaaccactttaatacagtttcaagatacaaaatcaatgcacaaaaatcagtagcatttctatacaccaacagcatccagggtgcacgtggaataaaaaacacaatcctactcaaaatagccacaaagaaaatgaaattatctaggaatacagctaaccaaagaggtgaaagacctgtacaaagagaaccaccaaacactgctgaaagaattcagaaatgacacaaatgaacagaaaacattccatgctcatggattgaaagaatcaatgtcatttgaaatgtccatactgcacgaagtaatttaaagattcaatgctattcctatcaaactaccaatgtcattcttcataggattaaaa

SEQ ID NO: 15444 - DNA, 345 bp, Homo sapiens
aaaaccactttaatacagtttcaagatacaaaatcaatgcacaaaaatcagtagcatttctatacaccaacagcatccagggtgcacgtggaataaaaaacacaatcctactcaaaatagccacaaagaaaatgaaattatctaggaatacagctaaccaaagaggtgaaagacctgtacaaagagaaccaccaaacactgctgaaagaattcagaaatgacacaaatgaacagaaaacattccatgctcatggattgaaagaatcaatgtcatttgaaatgtccatactgcacgaagtaatttaaagattcaatgctattcctatcaaactaccaatgtcattc

SEQ ID NO: 15445 - DNA, 358 bp, Homo sapiens
gcaagtaaagcaggtgcatctaaaccaggaaggagaacatacttggcccttgcttcttcccatttttgttttttctcatcaaaagctttcttcataatttggtaccactttctgaaatcaaaccatggcttatctgaaagaaataaaatccaagattattaaccaaataaaccacactataataatatacattgttcatctgagttttcattaattgactgcactgggcagttggtgtgagtgtgtgatcaagatgtagacattagagagacaacagaactgaatgcagtaaagtataaaaactcactcctcactctttcactccatacagggattattctccattattctctggcga

SEQ ID NO: 15446 - DNA, 407 bp, Homo sapiens
  misc_feature 97, 98: n = A,T,C or G
cgttgctgtcggttgctcctggtcactccctttatagccattactgtcttgtttcttgtaactcaggttaggttttggtctctcttgctccactgcnnaaaaaaaaaaaaaaaaaaaaaaaatttacccccttaaaaaaataaaaggggggaaaaccctcccccccaatttttggggtttttgaagaggaatttttttttttccccttggggggaaaaaaatttttttttttggccattttaaacccccccctttttggggggggcccttttttggaaagggccccttaacaaaaccttaaccggggtttttttaaccccggggggggggggggggcggggcaaaaattttttttggggcccctggcggggttttttttttttttaaaagaaattgggggcccccat

SEQ ID NO: 15447 - DNA, 328 bp, Homo sapiens
aattctcaataattaagtatagaaggaaggtaccgccaaacaataaagaccacatgtgacagactcacggctaacatcatattgaatggggaatagctgaaagtaagaactggaacaggacaaggaggcccattttcactactgttttgtgatatggtactggaaatcctagtcagaataattagggaagagaaagaaataaggggaatccaaattagaaagaaggaattcaaattgtccctgttttcacaggacatgatcttatatatagaaaaacctagactccaccaaaaaactcttagaactgataaacaaattcagtaaagtt

SEQ ID NO: 15448 - DNA, 305 bp, Homo sapiens
gggccccggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggc

SEQ ID NO: 15449 - DNA, 394 bp, Homo sapiens
cgtggctgtcgaccgtttatatgtttttcttttggtctgaaatacttctgaacagaggttattttttttagaaaaaggccgagacggggctttactatgttgcccaggctgctgtctaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttataaaaacaaacagaaacaaaaacgggaaatttccttcaacggcctttattgggggtaaaggggatccttaacccccttttttatggaactctcaaagcggggtccg

SEQ ID NO: 15450 - DNA, 240 bp, Homo sapiens
gagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagctttgctttttattttcttccttcgctatttttctatgatcctctaagaaccaagtccttgaaactt

SEQ ID NO: 15451 - DNA, 398 bp, Homo sapiens
gggaacttctgtgttattttactcttaaaaccaaactctaccttttcttggtgtttttttttttttttttgggaacccttcaaattcaggcaaagaagggggttaattttaaaaaccagggaaaaaacggcccccccatttggttgacgaagggttttaagggcctaactgggccccagggcacacccgggccaaattaagcccggaatgttgcccgggcccgaaaaagcccggggcccctgtttctttatggggaattaaagggcggggggtaaaggaaccattcctttttctgggaaataaaaaccgcaaagttgccatggcccgcccctttttttgtttcggggaatccaatgggggggaacttggggaaaacgggccttgggaaaaaaaaaaaa

SEQ ID NO: 15452 - DNA, 310 bp, Homo sapiens
ggattgctctagctatttggggtctttcatgattccctatgagttttaggattttttttctatttctgtaagaatgtctttggtattttgatagggattgtgttggatatgtagattgttttggatagtatagagattttaataatattcattcttctagtccatgagtgtgaaatatatttccatttttttgtgtcctcttcaatttattttatcagtgttttgtaggttttcttttagagatttttcacctctttgatttaatttattcctgttttgtagctattgtaaatgggattgttttcttgat

SEQ ID NO: 15453 - DNA, 226 bp, Homo sapiens
  misc_feature 3, 4, 5, 9, 13: n = A,T,C or G
tgnnntttntatnttacttacagaccgaagcctcaacatcacttttttttaccctgccggaggaggagaccccattctataccatcacgtattctgattttggggtggccctgaagttttttttttattctatctggcttcggactaatctccattttgtgtgttgttattctggccagaatatccatttttttacattgggtgcggcctgggcttccttgtactg

SEQ ID NO: 15454 - DNA, 403 bp, Homo sapiens
tgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggct

SEQ ID NO: 15455 - DNA, 397 bp, Homo sapiens
  misc_feature 397: n = A,T,C or G
cgttgctgtcgcgacctgcttctgggtcggggtttcgtacgtagcagagcagctccctcgctgcgatctattgaaagtcagccctcgacacaagggtttgccgttgctgtcgctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtcn

SEQ ID NO: 15456 - DNA, 307 bp, Homo sapiens
ggctgactctcttttcggacttagcccgcctgcacccaggtgaaataaacagccttgttgctcacacaaagcctatttggtggtctcctcacatggacgtgcatgacattgggtgctgaaacccgggacaggaggactccttcgggagaccagtccccttcccctgtcctcgccctcactccttgaggagatccacctgcaacctcgggtcctcagaccaaccagcccaaggaacatctcatgaatttcaaattggatcttcttgacttagcagctgaagactgatgctgcccgattgccttggaaa

SEQ ID NO: 15457 - DNA, 313 bp, Homo sapiens
aaagaccattatgggccactggacaaacacatgaatacacagaccattgacactataaagcaaccacacactcgagaggacagtaataattagctgacgacacaagatcaggatcagagccacacctataaactctaaccttgaatgtaaatggcataaatatcctgattaaaaggcacagagtggcaagctggataaagaagaaatacccaatcgtatgttgtcttcaagagacccatttcacatgcaatgacacacataggctcaaaataaagggaaggagaaaaatctggcacccaagaggaaaacagaa

SEQ ID NO: 15458 - DNA, 364 bp, Homo sapiens
tgcgtccagaggacctgtccggcagcacctccatgcctgagcccaagccagggctcatgtgaaggctcctgaagtaactccaagcccagaggagcagtgggacaaggcagggagacaggggcggcaacgcgagctcttcaggggaggctcctggactgcctaagcattgttcctcccacccactgggcagaggccccctacccccaggcagcgccagctggaccaagccaggaaccacgagccagcggcctgagcactcaccggtctccacatcctgcacgtagaagtgcaggtcatcagtgatctcagtcacaaacacgggcttgtagctagcagatcgctccttgtctcagcactggcatca

SEQ ID NO: 15459 - DNA, 176 bp, Homo sapiens
tgggagggtgaggagggcatatcacttgaatccaggtgttcgagatcagtgtggacaacatgatgaaaccctgtctctaccaaaaatactgaaattagctgtgcatggtggcactcgcctgtagtcccagctatttgggggactaggccagaggatcacttgagccagggaggttg

SEQ ID NO: 15460 - DNA, 178 bp, Homo sapiens
  misc_feature 105, 107, 108, 110, 111, 114, 115, 117, 118, 120, 121, 122,123: n = A,T,C or G
ttggaaaccacagtttcatgcccatcgtcctagaattaattcccctaaaaatctttgaaatagggcccgtatttaccctatagcaccccctctagagacgggggncnnannatnntnntnnnnaaaaagggggtgtttttaaggaccccaacagatgagctccgctctgcagctggcg

SEQ ID NO: 15461 - DNA, 354 bp, Homo sapiens
agtgggcatggctggggctgcacactccatggagccaacggaagccaagaacaggcgggagccctactcccttctgagttggcagggccagtgcagctgcagccaaccagctgtagctgtggacccaggcatccctgcactcttgactcaggaagccccctgcccccacaggctcaaaaatgcctgctcccactgcctggcctcttcctgttcctggtgcccgctccaattttggagcaaagttgaggctgagcccaggcactgtcgcaacctgccacagtgcacgcatgctcagggcagcactgatacaccagccccctgccaacttggccctctctgggctttgggcagaga

SEQ ID NO: 15462 - DNA, 313 bp, Homo sapiens
gtgatccacacacctcggcctcccaaagtgccgggatgacaggtgtgagccactgtgcctggcctgaaatgattatgtctctatgtataaataaatgaaaatcaaggccaggcacggtggctcatgtctgtaatcctatcactttgggtggccgtggcaggtggatcacaaggtcacgagttcaataccatcctggccaatatgatgaaaccccatctttattagaactacccatatttatccggtcgtgatggagaaaacctgtagtcccagctactccggaggctgttggaataacttttttaatctttct

SEQ ID NO: 15463 - DNA, 327 bp, Homo sapiens
tgttgcagtcgaggactgcaacagcccactgacagcactggacagatcaccgcagaaaactaacaaattctcgacttaaattgaagttttgaccaaatggacgtaatacacacgtacagaataccctacccaacaaccacagaatacacattttactcatctttgcatgctctaaaaatgaccacatgctcagtcataaagcaagtctcaataaattcaaaaaagcagaaatcataccaagcatctgtttggaccacagttgaataaaattagaaatcaataccaagaataactctgaaagccacgtaagtacatggaaatgaaacg

SEQ ID NO: 15464 - DNA, 387 bp, Homo sapiens
  misc_feature 375: n = A,T,C or G
agataaacataaatggaaagatatcttgtgttcatggattagaaggcttaacattattaaaatagctatactaccacaaacaatctacagattgttattccaatccaaatccccaaagtatgttttacagaaatagaaaacaccatcctaaaattcagatgcaatgacaaaagagcaatagccaaagcaatctcgagaaggaaaaacatagttggaggtatcacatttcctggtttgaaaatagattacaaagtcatggtaattaaaacagtatggcacaggcataaagacacatatagaccaatggaatagaatacaaagcccagaatgaaattcacacacatatggtcaactgcctttgacaaaggttcgaanagtacacaacag

SEQ ID NO: 15465 - DNA, 256 bp, Homo sapiens
  misc_feature 94: n = A,T,C or G
accttactaccagacaaccttagccaaaccatttacccaaataaagtataggcgatagaaattgaaacctggcgcaatagatatagtaccgcanaaaaaaaaaaaaaaaaaaaaacctttggggggcggttttttcggaaatcccaaccgggaaaaaaccttggggggggtgggcccacccccccctaaaagggcggggaaaaaagggtttttttgggaaattgggagggctttgggttttttgggaccccataaa

SEQ ID NO: 15466 - DNA, 330 bp, Homo sapiens
gttccctagaacgtgcaatgccacagtcagagacgttcaaactggaagccaggacaacaagatgctgacttaaagctgtggacagccttctccaagatggcagaagaagactccatgtcataatgactcttaccccttttaatttttttttacttatgcctgcctctttcacttgggaagaaaatgctggcaccacaatttcacaattcgcatcttttggggaaaaaaggctggatggttcacccctttttagctgctgttatttgtttattttggcgcccgccttttttacttggcgtgaagagggctgctctttaaaatttccacacc

SEQ ID NO: 15467 - DNA, 319 bp, Homo sapiens
ggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggttgaagaagagagacaaaaagaacaaaactaagaagaccaaagcagcagcagcagcagcagcagcacctgccgcagcagcaacagcagcaacaacagcagcaacaacagcagcaacagcagcacagtaaagggcatacatttcctgctttcac

SEQ ID NO: 15468 - DNA, 380 bp, Homo sapiens
tactacggttgcgacatgacgacagacagtgatcagggcgcacacaccccaactgacaggcggtgcctctgctggcttatatgtgcttgtctggcagctatggctagagctgtggccctcccaacctgcaactggcgatctgacaacgggcagacgcgtctcctctagtgtttccgtgacccctgacccgcgagcacgctatctgggaggcaccccctagtatgggcagactgacacctcacacggccgggtactcctctgagacaaaacttccagaggaacgatcagacagcagcattcgtggatcacgaaaatccgctcttctgctgccaccactgctgtgacccaggcaaacagggtctggagtggacctctagcaa

SEQ ID NO: 15469 - DNA, 346 bp, Homo sapiens
atttttctcttccccaccacagcatctttgcgtgtgtgtgtcggcgggtgttggagggggcaagttaagcctcattccctataatttggaacattccttcggatttgatcgagtcagatagagttggtcaaacccaatgggaaaaagactaaaggaactacaaaacagaaacaaacaaatgacaacaacaacaaaaaaacaggtaagcaaaacaaacaatcaattgcacaacttatacaattagtgagcactctaatggtaaggagaaattaagtccagctggttgttaatcttaactttggccaagacaaaccccagttcagttacttacctgcagacgggtctc

SEQ ID NO: 15470 - DNA, 144 bp, Homo sapiens
  misc_feature 97: n = A,T,C or G
cactacctataaaatcccaaacatataactgaactcctcacacccaattggaccaatctatcaccctatagaagaactaatgttagtataagtaacntggagaaaagggccattttttggaattaatagggggggggttttttt

SEQ ID NO: 15471 - DNA, 316 bp, Homo sapiens
atctgtgaaaagatatttggtaacacattaaggcctatggtgaaaaaggaaatatcttcagataaaaaccagaaagaagttttcttagaaactggttttgcttgtgtgcatttatctcagagagttaaaactttctttggattcagcagtttagaaacactgtttttgtccattctgtgaatggacgtttgggagctcattgaagccaacgtcaaaaaggtgactaacccaggattaaaacttgaagaaagctatctgagaaatagctttctgatgtgtgcattcatctcacagagttaaaactttctcttcattc

SEQ ID NO: 15472 - DNA, 366 bp, Homo sapiens
aaagatctcaatgaaggatctaacatcacacccagaagaaacagaaaaacaagaggaaatcaaccacaaagctagcagaaaaaaagaaataaccaaaatcagagcctatttgagtgaaatggaaatgacaaaaagatacaaaaaatcaaggaaactaaaaattgtatttttgaaagactaaataagattgatacaccagtaactagactaatacagaaaaaaagagagaagatccaaataaacacaatcataaatcacaaggaggacactaacaccaaccctacagaaatacaaaagatttctcacagactattatgaattctctatgcacacaaagtggaaagccagaagaattagataaattct

SEQ ID NO: 15473 - DNA, 451 bp, Homo sapiens
  misc_feature 181, 183, 369, 419, 451: n = A,T,C or G
gtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggcgncncctatcgcggcgcccctggcccttgcctcctggcctgctatcctggcggcgcgcccccctgtctcccccacgcgcttcgccctggtggtacccggaggatttcactcgaacgtcctccacggcctgttgccgccttgtccctttcgcggcctccctttctcctggggcccattctgccggagaatngactatctctcccccctgacactagcttccgtcactccctgaccccgcancctatctcttcctcccaccggggccccccacn

SEQ ID NO: 15474 - DNA, 385 bp, Homo sapiens
  misc_feature 385: n = A,T,C or G
ttagcagaaacgatagcctgttatagtggacagcttgctgctctgacggatgaaaacacaacgctccgttctaaactggagaagcaaagagagagcgggcaaagactggaaacagaaatgcaatcataccgttgtagactgaatgctgctctatgtgatcatgatcaaagtcactcatcaaaaagagaccaagagcttgctttccagggcacagtagataaatgttgtcatttacaggaaaatttgaattctcatgttctgattctttctctgcaactttctaaagctgagagtaagttcagagtcctcgaaactgagctccattacacaggagaggctctgaaagaaaaggctttggtttttgaacacgggcaaagggagctan

SEQ ID NO: 15475 - DNA, 417 bp, Homo sapiens
cgttgctgtcgggcaagcgttcgattttttgtcgttggatcgcgagcggtgtctgcttgtgccgccgagggctcccaggacagggcagggatctagggggtttgcgcacctgctttttaatgccccgccccccctttttttttttaaaggggggggggtgaaagtgagggaggaaaagggacaaaatactgactggaacgtaaattcgagcatttcttatgcgaagagcggataaccagttccggattcttttttaagtttctccattagataaatttaattttcaaaggctccggtttgcaggctaaattttgaaactagcccggggtttggcaaaatttgactgaatcctggggggagaggctggacccacgcccaagggtatctagaatattgagcccggcagttcaaaccagg

SEQ ID NO: 15476 - DNA, 410 bp, Homo sapiens
  misc_feature 410: n = A,T,C or G
cgttgctgtcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgn

SEQ ID NO: 15477 - DNA, 413 bp, Homo sapiens
  misc_feature 341: n = A,T,C or G
ggcacgagaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggnagaggtcctgctggtcaatctttgtgaaggaaccttcttaatgtcggttggtgatgaaaaagacatcctgct

SEQ ID NO: 15478 - DNA, 328 bp, Homo sapiens
gccaacagtaagttttttacaatagccatcctaatgagtgtccatatacggttttttttttttggttggaaagggagtctggttttgttccccagcctgaagggcaggggggcaatttttgttaattgaaaactccgcctccaaggttaacgcatttttctggcctaaccctccaaggtagctgaaactacaaaggcccgcccccaccccgggctaattttggatttttaagaacaaacggagtttatttacgtgggccgggtgggtctaaaactccggacctaaggggacccccccgcctggccctcccaaggggcgggaataacgg

SEQ ID NO: 15479 - DNA, 327 bp, Homo sapiens
cactgcaaggtccacctcccgggttcacgccattctcctggctcagcctcctgagtagctgggactacaggcgcccgccaccatgaccggctagttttttttggatttttagtaaagaaggggtttcaccgtgttagccatgatggtctcgatctcctgacctcgtgatttgtccgcctcagcctcccaaagtgctgactctgtgcgcgggcagttgctaatcggactgatgcgtgcttcattcgagttattggatctgagcttgtacagaaatacgtcggtgagggggctcgaatggttcgtgaactctttgaaatggccacaaca

SEQ ID NO: 15480 - DNA, 397 bp, Homo sapiens
cgttgctgtcgctccctatctaccctcaccccacgagacagccccttcaggtatgtgtgtgtgtgcatgtgtgtgcatgtgtgtgcatgtgtgtgcaggggtgtgtgtgtgtggggggggttcccaaatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagggggggcttctacaggcttttgaaagtaaggtggaagtggtaaggctgataagaaaaaacaaacttattttgtagcg

SEQ ID NO: 15481 - DNA, 337 bp, Homo sapiens
aacaaaacaattatcagccaagaattttgtatccagtcctatgtttgccctccttaaacaaaacaattatcagccaagaattttgtatccagcaaaactaggcttcataaatgaaggaaagataatctttcagacaaacaaatgctgagagaatttgccactaccaagccaacactataagaaatgctaaaaggagctctaaatcttgaaacgaatcctcgaaatacacaaaaatagaatgttcttaaggcataaatctcacaggatctattaaaacacacacacacacacacacaatgaaaaaaaaacacaaggcttttaggtaacaaataccacg

SEQ ID NO: 15482 - DNA, 334 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaagacatgaaaacg

SEQ ID NO: 15483 - DNA, 322 bp, Homo sapiens
gagcactttgaggcctatggtgaaaaagaaaatatcttcagataaaaactagaaagaaactttctgagaaactgctttgtgatgtgtacattcatctcacagagttaaaactttcttttcattcagcattttgggaagtatgtttttgtccattctgcaaaaggacatttgggagctcattcagaccaatggcaaaaaagaaaatatcccaggataaaaactagaaggaagctgagaatccatttgtgatgtgcgcattcatctcacagagtgaaaattttcttttgatacatcagtttggaaacatggtttttgtagaacc

SEQ ID NO: 15484 - DNA, 295 bp, Homo sapiens
gctaaacctagccccaaacccactccaccttactaccagacaaccttagccaaaccatttacccaaataaagtataggcgatagaaattgaaacctggcgcaatagatatagtaccaaaaaaaaaaaaaaaaaaaaaaaaaaaaggggggggttttttccggaaaccccaaagggaaaaaaacctttgggggggggggaaaacccccccttaaaggggggggaaaaaaagggttttttgggaaaattggggagggtttggttttttttgaaaccattaaaagggggaaaaaaaaa

SEQ ID NO: 15485 - DNA, 314 bp, Homo sapiens
  misc_feature 294: n = A,T,C or G
gatttgccatagtagttaagataatacaggctttgccctttcaaatgccataggtgttattgactagtaccatataatcgcctttaattcttaaactagttcacgtcatacattttaattatcctagtctctgtaattgatatttatcatgaagattgcattgctcttatttcagaaaaatatgttgagaaactttttggagtaaacaaagatcgaatgtcaatggaccagatggctgttctccttgttagcaatatcaatgaaagtaaaggtcatagtaagtacatatataantgtgtgtgtgtgtgtgtgtg

SEQ ID NO: 15486 - DNA, 313 bp, Homo sapiens
actgaatgactgattggtcaatgaaaaaaattaagaagaaaaattttaaaattctttaaacaaatggaaatggagacacaacataccaaagcctatgggatacagcaaaagcactactaagaggaaagtttatagcaacaagtgcctacatcaaaaaagtagaacttccaataaacaacttaatgatgcatcttaaagagctagaaaacccaaatagtagaggaaaagaaatagtaaagaccagagcagaaaaaaataaaattgaaattaaaaaattacaaaagatcaatgaaacaaaaagttggatgtttga

SEQ ID NO: 15487 - DNA, 332 bp, Homo sapiens
gagcactttgaggcctatggtgaaaaagaaaatatcttcagataaaaactagaaagaaactttctgagaaactgctttgtgatgtgtacattcatctcacagagttaaaactttcttttcattcagcattttgggaagtatgtttttgtccattctgcaaaaggacatttgggagctcattcagaccaatggcaaaaaagaaaatatcccaggataaaaactagaaggaagctgagaatccatttgtgatgtgcgcattcatctcacagagtgaaaattttcttttgatacatcagtttggaaacatggtttttgtagaacctgtgaagggg

SEQ ID NO: 15488 - DNA, 327 bp, Homo sapiens
gatatacttagaacattttatccaacagcagcaggacacacattcttcttgagagcagatgagacattctccaggacagcttatcttttggaccacaacacaagttttaaaacatttaagaagactaaaataatatcaactatcttttccaattgcaatagtatgaaactagaaatcaataatagggggaaaactagaaaacacaaatatgtggaaatgaaacaatgcattcctgaacaatcaatgggacaaaagaggaatcaaaatataaattaaaaattaccttgaaccaataaaaatggaaacacaacacatcaaaacttgtag

SEQ ID NO: 15489 - DNA, 416 bp, Homo sapiens
tcccatcgattcgaattcggcacgagctggcccggtggcgccagagctgtggcgcgtcgcttgtgagtcacagctctggcgtgcaggtttatgtgggggagaggctgacgctgcgcttctgggcccgcggcgggcgtggggaaaaaaagaaaaaaaaaaaaaaaaaaaaaaaaaaaaaaaaaaaaaaaaaaaaaaaaaaaaaaaactttctccaaaaaaaaaagaaatgtatcataagccatgcaacaattacaaacgcacacgctgggtctcccaacaaacacaaacccaaaatattttacaaagcttttcttttggaaaagacccagacccacttattaataggaaacccaaaaaagggcaacaagcaaacaaaacacagctttaccacttgtataagtgtgacctacaggggg

SEQ ID NO: 15490 - DNA, 339 bp, Homo sapiens
ggtctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgcctttttctggttcaacaacctgttgacttccctggaacaggagatggaggaattaggccaagtgggttttttaaactaccggttctttctcaccggatgggacagct

SEQ ID NO: 15491 - DNA, 124 bp, Homo sapiens
ggacgcttttcatctgtcccgctgcgtgttttcctcttgatcgggaactcctgcttctccttgcctcgaaatggaccccaactgctcctgctcgcctgttggcttctgtgcctgtgccggcttc

SEQ ID NO: 15492 - DNA, 385 bp, Homo sapiens
  misc_feature 238: n = A,T,C or G
caaacagtgtttccaaacagtgaatgaaaagaaatgtttaactctgccagatgaattacacaacacatagcaatttctcacatagcttccttctcgtttttacccttaggtagtccttttttgccattggcctcaaggagttccaaaagtctatttgtagaatggacaaaaagagtgtttgcaaactactcatacaaaagacatgtttaagtcagcaagatgaaagcacacatctcanagaggtttcccagatagcttccttccagtttttatcctaggatattccttttttctaccttggcctcaatgatgtccaaaatgtttattttcacagtggactaaaacagtatttccaaactgctgaaacaaaagaaagatttaactt

SEQ ID NO: 15493 - DNA, 337 bp, Homo sapiens
ctcacataaacttaaggtaaaggggtggacaaagatattccatgcaaatggacaccaaaagtgagcaggagtagctattcttatatcagacaaaacaaaccttaaagcaacagcagttaaaaaaagagggaccttatataatgataaaaggactagtacaaaaggaaaatatataatgataaaaggactagtacaaaaggaaaatatcacaatcctaaatatatatgcacctaacactggagctcccaaatttataaacaattactgctagacctaagaaatcagatagatggcaacacagcaatagtgggggactttaatactccactgacagcac

SEQ ID NO: 15494 - DNA, 418 bp, Homo sapiens
aaacaaaatgcccatgttggtcctctgccatggacctgcgatattctggactatttctgcgtttatttgcggccgagtgtaacaaccatataataaatcacctcttccgctgttttagctgaagaattaacacaaaaaaaaaaaaaaaaaaagaaaaaaaacaaaaaaaaaaaaaaaaaaaatggaaatctgaaagccatcccaaaagaagacccacccccaaaagaaagtagaaccaaaaccctggagagcctcccctaccataggactctctcgctagatccgtgactataaaaaaaaccggggggaagagccgggccaccccattctacaggccaactagggaccctcgagatacccccttatttctggcgccctgagagaaggggccccaaacggaccccgaaatttacccccg

SEQ ID NO: 15495 - DNA, 328 bp, Homo sapiens
ttacacatcagtttctcagaagacttctttctagtttttatctgaagaggcttccttttttaccatgggcctcaatgctcagtgaaatattcctttgcagatcctacaaaaacagtgtttccaaacagctgaatgaaaagaaaggtttaactctgtgagatgaatgcacacatcacaaagcggtttctcagataggtttcttcgagtttttatcctgggatattcgctccttcgccattggcctcaatgagctccaaaatatccattctcagaatggacaaaaacagtgtttccaaactgaggaatccaaagaaagggttaactctgg

SEQ ID NO: 15496 - DNA, 390 bp, Homo sapiens
ctaaaaatcaatgattggaggaatttgggaaactatacaaatacatgaaaattaaacaatatgcttctgaatgaccagtgggtcaatgaagagattaagaagaaaattaaaaattttcttgaaacaaacaacaatgaaaacaaaatatagaaatcctatgggatacagtgaatgcagtactaaaaggaaagtttatagtcataagtgcctaaatcaaaaaatggaaaaacttcaaataagccatgaaatgatgcatcttaaaaaagtaaaaaagtaatatcaatctaaagtcaaagttagtagaataaaatgagatcagagtagaagtaaatggaattgaaatgaaaataatacaaaagatcaatgaaacaaaaagctgcattaaaaaat

SEQ ID NO: 15497 - DNA, 336 bp, Homo sapiens
ttggtgggaaattcaatactctaagcattagactgttgatctagaatattaacagatgaacactgtatttaaactgcacataggaccaaatggacctaacagatatttacagaacatttcatctgacagttacagaacaaacattcttctcatcagcacatgaaacattctccagaagagagcatatgttaggacacaaagcaagtctcaacaaattaaaaaaattgaaatcatattgtttcttctcagaccacaataaaataaaactagaaatcaataacaagaggaactagggaaactgtacaaatacatacaaattaaacaacatactcctgg

SEQ ID NO: 15498 - DNA, 384 bp, Homo sapiens
  misc_feature 384: n = A,T,C or G
cgttgctgtcgaattcggctggcgtttccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcn

SEQ ID NO: 15499 - DNA, 381 bp, Homo sapiens
tcagtagcatttctataggccaacagtgaacaatatgaaaatgaaattttaaaaagtaatcccatgtacaataaccacacataaaattaaatacctaggaattaacttaaccaaagaagtgaaagatctctataataaaaactataaaacgctgatgaaggaaattgaagaaaataccaaaaaatggaaaaacattccatgttcatgtgttggaagaatcaatgttgctaaaatgtccacactaccctaagcaatctacagattcaacgcagtccctatcaaaatactggacatttttcacagaaatagaaaaaacaattctaaaatttatatgaaaccacagaagacccagaatagccaaagctaccctaagcaaaataa

SEQ ID NO: 15500 - DNA, 450 bp, Homo sapiens
  misc_feature 23, 37, 39, 40, 41: n = A,T,C or G
gtactggcttttgaaaagacccnacgaaagctcgcgngnnnttttgtgcgaagcggcctacggtttttagaagacaacagaagggtggtaaaatcactgaggctttaccaaaaggttatggggacaatgcacctaaaaaaatcagcagtttacaaatggataacttgtaacaagggaaaagatgacgttaaagatgaaggctgcagcagcaggacatccacatcaatttgcaaggaaagaaattaatcctctttgtgccctaactgaagagtcagccaggtgtggtggctcatgcctgtaataccagcactctgggaggtcaaggcaagtggatcacttgaggtccagagtttgagaccagcttggccaacctggtgaaatccattctctactaaaaaaatacaaaaattatccattcatggtggcgcacgcctatatgtccatctactt

SEQ ID NO: 15501 - DNA, 275 bp, Homo sapiens
tttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggtaaagttctctgagcgcccgtcctccagctgttaggaaagctgagctgccctggagtttagagatacgtggcgcagtcagccctccggatctgtgggctcaggctcagtgtacggg

SEQ ID NO: 15502 - DNA, 400 bp, Homo sapiens
cgttgctgtcgattttaacaagctctttgctagagagactgcagtgacagatggttgggagtttgcccctaaagctgtgacaccaatcttctaatgagcatatttgttctgggtcgccctgccagattctttctctatttcagaaagggacaacagaataagtgacttcaaaagaagaccatgaggaagagatggatgaagatatataagacttagatcactatgagatgaaagaagagcctattattgagaacaagttggaggatgaaggaactgaataagaaaattgggcaatattatagaaaattaggaagactgaaaggttgaccctgatagtcctttgcacagtgatctttatatcttaacaagaagcgataggagacattcttgttatctttca

SEQ ID NO: 15503 - DNA, 337 bp, Homo sapiens
gatgcccataagatatgggaagctatgttatcaagccatattagatatcaagcattaatatggaaataaaccagcctgtttggtgggctcttcacatggacgcgcatgaaatttggtgccgtgactaggatcgggggacctcccttgggagatcaatcccctgtcctcctgctctttgctccgtgagaaacatgcacctatggcctcatgttctcaaaccgaccaaaccaagaaacatctcaccaattttaaatccgcctggcttgtgaggccttttgaccccaattcaagtcttttgataccctgtgaattgcacccatactgcccagatggctag

SEQ ID NO: 15504 - DNA, 341 bp, Homo sapiens
agacacactgaagcattgcatttgaatcataattatgaaccatttaaaaattggggatttattttttaattatgaaaaattctgttgtaatagtaccacatccaatttatatgttattagctgtttgttacccactatttcattatattggaatgagggcaaataatcctgtaggcaagcacgatattttaaaagttaggaattctgacacatctcaacttttaaatctaatagattgatatgctgctgaaagaatatttactctctggagacatatctgaagctgaacattgccttaaggaactggaagtacctcattttcaccatgagcttgtatatga

SEQ ID NO: 15505 - DNA, 144 bp, Homo sapiens
  misc_feature 144: n = A,T,C or G
tgcgtgtggaagactacgaaccttacccggatgatggcatggggtatggcgactacccgaagctccctgaccgctcacagcatgagagagatccatggtatagctgggaccacccgggcctgaggttgaactggggtgaacccn

SEQ ID NO: 15506 - DNA, 393 bp, Homo sapiens
ggcacgagggagctggatgatgacatggacgggacggtctcggtgactgagctgcagactcacccggagctggacacagatggggatggggcgttgtcagaagcggaagctcaggcactgcccaccgaccttccagcaccttctgcccctgacttgacggagcccaaggaggagcagccgccagtgccctcgtcgcccacagaggaggaggaggaggaggaggaggaggaggaggaagaagaggctgaagaagaggaggaggaggaggattccgaggtgcagggggagcatcccaaggaggccccaccgtcactgtcacccccgcagccgggcagccctgctgaggaagacaaaatgccgccctacgacgagcagacgccggccttcatcgat

SEQ ID NO: 15507 - DNA, 312 bp, Homo sapiens
cattatcactatagaaaaccacccaatcacaaaaattaacaataagagaggaagtaagtaatgaaggatatacaaaacaactaaaaaacaatcagtaaaataacaagagtatgccctcatctatcaataataatcttgaatgtaaacagattacattccccatttaaaagataaagactgactgaatggataaaagacatgacccaactatatgctgcctagaagaaactcacctcacatgtaaagacacacatagactgaaaataaaggaatggaaaaatatattccacccaaatggaaaccaaaagtaag

SEQ ID NO: 15508 - DNA, 391 bp, Homo sapiens
gttgctgtcgcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgag

SEQ ID NO: 15509 - DNA, 382 bp, Homo sapiens
cgttgctgtcggcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcgggggggctggagcggttgccttacctcctcgtggcttacagcctggacgcctcagccgcctcactcctgggcctgctggccctggggctcg

SEQ ID NO: 15510 - DNA, 370 bp, Homo sapiens
ggattagaaacagctcaatacacccacaccagaagacctaggataaattctgggaagcatgcaacctcccaagataaaccaagaagatattaaagccctgaaaagatgaataatgagctccaatattgaatcagtcattataaacctaccaaccagagaaagccctggaccagacagattcacagctaaattataccagatgtataaagaagagctgatagaaatcctactgaacatattccaaaaaatcaaggaggaataattcctccataactcattctatgagacagcatcattcagaaacacggtgataaaaggaatctttaggccaaaatcttggaggaacatagatgcaaaaatcctcaaccag

SEQ ID NO: 15511 - DNA, 400 bp, Homo sapiens
  misc_feature 400: n = A,T,C or G
ggcacgaggagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcagctgacctn

SEQ ID NO: 15512 - DNA, 368 bp, Homo sapiens
ggaagtagaacattctgaagggcatgtcacacgttcttcaagctcactctgccagccactggagaatggacgtaatgagccaaggatggcaccaggaagtcacgggggcagtgtttgctgctgtccaggcaatcacagtattggtgtcgtgtctcagcaggctgggtgttgggggcctggattcacaacatacatttgaacatattgtcacccgtgcttgctgatagagacatctctatggagtggaggtggcgaatgttgcgtcgaagtctttgcctttttattatttatattctcttgttggggggactactccttatattttcttctctcttcgctgttacggagggtgacatcttatttttttt

SEQ ID NO: 15513 - DNA, 385 bp, Homo sapiens
ggcacgagggacctcctaccgttacttttttattcactcaagaaatgatttcttgagttcccggcctttgttagagagatgaacgaggcacggtccgtgtccagctaaaggacagtaggactggaagagcgttgttttccaaggtacaggatgccgcgcctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggctgtcgtgaagacatctgcgtgtgcggcgtgcgtgggtgcctggagatgaagctggaaagagctgctgc

SEQ ID NO: 15514 - DNA, 344 bp, Homo sapiens
  misc_feature 270: n = A,T,C or G
gagaacattctgaagggcatgtcacacgttcttcaagctcactctgccagccactggagaatggacgtaatggagccaaggatggcaccaggaagtcacgggggcagtgtttgctgctgtccaggcaatcacagtattggtgtcgtgtctcagcaggctgggggttggggccctggattcaaagcatccatctgaacatattgtcacccgtgcatcctgagagagacagcttcatggagtggaggtgtgtggcctggaggccccacgtangccaccaggcatgttttccacgaaaaccgaaacttctgacgggattactaacattgggagatttccgtttcttg

SEQ ID NO: 15515 - DNA, 396 bp, Homo sapiens
ggcacgaggagaagctgacgggcatgtggtggaaacagctggtggccggcgcaatggcaggtgccgtgtcacggacaggcacggcccctctggaccgcctcaaggacttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcatgagcgcttcgtggctggctccctggctggtgccacagcccaaaccatcatttaccctatggaggtgctgaagacgcggctga

SEQ ID NO: 15516 - DNA, 314 bp, Homo sapiens
gaccgtttatgtaactttatattgggacaatgaatcctttgaggccacttgcctaccgagccggttgatcgctgaggagccactatttagactctattaaactttcttgttgcccgcggaaccctctaaatccccttgtaaatttaactgttagtccaaagaggaacagctctttggacactaggaaaaaaccttgccgagagagtccccaccttaaaggggcgcaaaaaaaacggttggggggtaattttgggagacctccctgttttttaaaccactatttagtgggaaaaaaccccttttaaaaggcgggg

SEQ ID NO: 15517 - DNA, 364 bp, Homo sapiens
actgaattacaataatgacacaacctatctaaacctgtgggatacagataacgcggggctaagaggaaagttcacagccctaaatgcctacatcatagtctgaaagagcacaaacagacaatcccaagtcacacttcacggaactagagaaacaagaacaagccatacccaaacccggacccagcagaagaaaagaaataacccagatcagagaagaactaaatgaaaatgatgcaaaatacttacctaagataaatgagacacaactggttctttgaaaagataaataaaattataaactgttagcaagactaaccacgaaaagaagaaaaaaaggccaataaccttgctgagtaatgaaccc

SEQ ID NO: 15518 - DNA, 311 bp, Homo sapiens
caagcttaaccataagtacaataagccccagcatttgcatggtagtcaagctcattcaagcaaaactctctccagtagggaatttcccctgcagagaccatgtgcatttttatttcacttgtcctcagactgactctttgttcattataatagtaaaaaacacatccctgggtggagatttagagctaataagacatgcgatgtatgaacaagcatgtaaagctactgcacatgtgcagccaaagaaccacccataacatgcttaccagcaacactctttcccacccccttaagaataaccacggaaggct

SEQ ID NO: 15519 - DNA, 123 bp, Homo sapiens
actccccgccctaagatctctgtgtgtgtcctgggggaccagcagcactgtgacgaggctaaggacgtggatatcccccacatggacatcgaggcgctgaaaaaactcatcaagaataaaaaa

SEQ ID NO: 15520 - DNA, 127 bp, Homo sapiens
tagaatctttggaggtctggacatgttagctgaaaaactcaaatctcacacatctaaacttaagtggaaataaactgaaagatatcagcaccttggaacctttgaaaaagttagaatgtctgaaaag

SEQ ID NO: 15521 - DNA, 348 bp, Homo sapiens
ggctcactgcaacctccacctcctgggttcaagcgattctcctgcctcaacctcctgagtagctgggactaactacaggtgcgtgccaccatgcccagctaatttttctatttttagtagagacggttttcaccatgttggccaggaagcgccttaattgtgtgaatcttgatgacatgcgagatcagcttccagagcatggctctatatgctgacgcccctgaaaacagatccctgttactttaggccaagatgtggggcgatatcatgtattctggaacctggaccacaagagcccccacgcaggcccctaagatggtagattcttcgacgaagattcctaccctc

SEQ ID NO: 15522 - DNA, 359 bp, Homo sapiens
actgaattacaataatgacacaacctatcaaaacctctgggatacagctaaggcggtgctaagaggaaagttcacagccctaaatgcctacatcaaagtctgaaagagcaccaatcagacaatcccaagtcacacttcaaggaactagagaaacaagaacaagccaaacccaaacccatacccagcagaagaaaagaaataaccaagatcagagaagaactaaatgaaaatgaaacataataaatacaaaagataaatgaaacaaaactggttctttgaaaagataaataaaatttatagactgttagcaagactaaccaagaaaagaagagagaaagtccaaataacctcactgagtg

SEQ ID NO: 15523 - DNA, 154 bp, Homo sapiens
  misc_feature 3, 5: n = A,T,C or G
cananggcttgttttggaccacagaccacggtatcctgatatgataaaaagggcggaggatgcatacatcctcacttgtaacgtgacattagagtatgagaaaacagaagtgaattctgtctttttttaccagagggcacaacattgagaaaaa

SEQ ID NO: 15524 - DNA, 401 bp, Homo sapiens
ggcacgagccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcggtaaagaggcagctccgagtgaggaccatctacgagagcaaaatgattgaatacgatcctgaaagaagattaagaatcttttgggtgagttgtgaggctggcacctacattcggacattatgt

SEQ ID NO: 15525 - DNA, 124 bp, Homo sapiens
gcagtggacgtggatttggtgatggctataatggttatggaggaggacctggaggtggcaattttggaggtagccccggttatggaggaggaagaggaggatatggtgctggaggacctggata

SEQ ID NO: 15526 - DNA, 124 bp, Homo sapiens
ggtttttcagctcacttcaagggtacctgaagcgaattggcaccaaagcagcagctgtattggcgcagttctagcttcaccttcacgatgtttcccttggtcaaaagcgcactaaatcgtctct

SEQ ID NO: 15527 - DNA, 147 bp, Homo sapiens
ggagaatcgaggcactcgctggcgtacccatgtatcgaaatgagttcacggcctggtaccggcggatgtcggtggtctacgggatcggcacctgggctgtgttgggctcactgctttactatagccggacaatggcgaagtcgtcag

SEQ ID NO: 15528 - DNA, 341 bp, Homo sapiens
gttctgtcgcccaggctgaagtgcagtggcatgatcccggctcactgtaggctccgtctccccagttcacaccattctcctgcctcagcctaccgagtatgcacccgccagcatgcctgcgtggccgagttcttctcattcggcatcaacagcattttatatcagcgtggcatatattcatctgaaacctttactcgagtgccgaaatacggactcaccttgcttgaactactgatcttgagctcatatatacctaactaagggtcgcgcccttcgaaatatgatttactatcttgcctagcattctggagctctctagcacattctggtttctactatgt

SEQ ID NO: 15529 - DNA, 363 bp, Homo sapiens
cgaaccacaatagtgacacatcctatcacaatctttgggacacaccagaggcagtgctaacaggaaagttcatagccctacacgcctacctcaaaagggctgaaagagcatctacagacaatctaaggtcacacctcaagcggctagagaaacaagaacaaccaaatcctcacccagctgaagaaaggaaatagcctggatccgagcagaactagatgaaattcagacaaacaaactccacttgcgctccaaaaatacgtaagacgaagagctggttctttgaaaagataaataaaattgatagaccattagcaagattaaccaggaaaagaagagtgaaaattcttataagctcaatgagaa

SEQ ID NO: 15530 - DNA, 348 bp, Homo sapiens
cggcctactgctgcaagaagacaacagaaggctactgctgcaagaagacaacagaaggctgctgctgcaagacgacaacagaaggctactgctgcaagaagaccacagaaggctacggctgcaagaagacaacagaagggtactgctgcgaagaccacagaagggtactcctgccagaagacgacagaagggggagcgccgctcctgctgcaccgtgcttgctacgagtttcatgctcgtgctaaactagcgccgtcgtcttctttcttcagtcgtcatgatgattatctaccgccacctcatcacccacgatgagatgttctacgacatctacaagatgcaggagat

SEQ ID NO: 15531 - DNA, 393 bp, Homo sapiens
cgttgctgtcggtgcatcctctcccagtggatgcgatcacctgtgcctcccctccccttttattcacatcgcgtattttggcattttccagataatgacaaggcacagacagggtgggggatggactgaagcaccatgtcttgtttactggctcctaatttattttcattctttgttgactaaccacacatgtgccctcggaggttacatgtgtggtgaccactctacattctggatgttttattaaacattgaacgcgcctacgaggagcgaacttaaaataatacatccactggctgataaagggaagctgcaataccaaggcgaagattgataatgcacacgcttttcttttttgtaccgtacatattttcacaccatcttagatataat

SEQ ID NO: 15532 - DNA, 408 bp, Homo sapiens
ggcacgaggtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaac

SEQ ID NO: 15533 - DNA, 357 bp, Homo sapiens
  misc_feature 357: n = A,T,C or G
atgacctcaacggtgccgtgatgatacaataccacctatggagaaagctctagggaaaatggacattcagatagctcttccttctggatggtacagaagagtagctccatggtttggattagctgcaaaacactttattgatagatgaagattactgaggaaatgttggtgctgtactgtttaattttggcaaaaaaaagtttaaagtcagaaaaagtgatcgtactgcacagctcatttgtgaatgaatttttaatccagaaatagaagttcaagctttggatgatgctgaaaggcattcagaagagttaggttctattagaaagtattaaaatttatgctaagaatagaaaatgn

SEQ ID NO: 15534 - DNA, 399 bp, Homo sapiens
atcccatcgattcgaattccgttgctgtcgactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaagg

SEQ ID NO: 15535 - DNA, 322 bp, Homo sapiens
gcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggagatagtaccttcaatacttagaaatagtcttccacaaaaaatactttatttc

SEQ ID NO: 15536 - DNA, 329 bp, Homo sapiens
attgatagaccattagcaagattatcgagaaaagaatacagaaaatccaaataagctcaattagaaacaaaacaggagatactacaactgacaccactgaaatataaaagatcatttcaaggctactatgaacacctttacatgcataaactataaaacctaaaggagatggataaattcctggaaaaataaccaccctcctagcttaaatcaggaagaattaaatacccttgacagaccaattaccaaccgagaggatgaaatggttaccaaaaaaaattaccaatggaaaaagccaggaccacaccgattcacaggtgaaatttatg

SEQ ID NO: 15537 - DNA, 230 bp, Homo sapiens
gtagtaccatgcacattattgaggaatgttctaaaggtatatctctcggggtatttctctacttacctgtgataatgcttttgtcttaatagggtggttctcttccctaagcgctagccaaattcatgaattatgtgaagaattgctttcggatgactgaccaagaggctattcaagatctctggcagtggaggaagtctctttaagaaaatagtttatacaatttgtta

SEQ ID NO: 15538 - DNA, 323 bp, Homo sapiens
gactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcag

SEQ ID NO: 15539 - DNA, 317 bp, Homo sapiens
  misc_feature 317: n = A,T,C or G
ggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaagcctcggtgaagcagagctcgtgggattcctgctgctccaggtgtcctcagctcacctgtcccagactcaggacaggggagttcctgcatttcctgccagggcagaggcccagaggagcgaccccctgcttccactgcttgn

SEQ ID NO: 15540 - DNA, 316 bp, Homo sapiens
gcattgggtcaaaaacaaaatgaagatggaattaaaaaaattatttgaactgaatgacagtaaggacaataatgacctctgggatacagcaaaggcagtgctaacaggaaagttcatagacttaaattcctacatcaaaaagtctgaaagattgcaaatagacaatctaagatcacacctcaaagaactagagaaacaaaaacaaaccaaacccaaacccagcagaagaaaggaagtaaccacgatcaagcagaactaaatgaaattgaaacaacaacaaaaacaatacaaaagataaatgaaacaaaaagctagt

SEQ ID NO: 15541 - DNA, 322 bp, Homo sapiens
gcattgggtcaaaaacaaaatgaagatggaattaaaaaaattatttgaactgaatgacagtaaggacaataatgacctctgggatacagcaaaggcagtgctaacaggaaagttcatagacttaaattcctacatcaaaaagtctgaaagattgcaaatagacaatctaagatcacacctcaaagaactagagaaacaaaaacaaaccaaacccaaacccagcagaagaaaggaagtaaccacgatcaagcagaactaaatgaaattgaaacaacaacaaaaacaatacaaaagataaatgaaacaaaaagctagttctttg

SEQ ID NO: 15542 - DNA, 326 bp, Homo sapiens
ggcgtcgtagtctcctgcagcgtctggggtttccgttgcagtcctcggaaccaggacctcggcgtggcctatcgagttatggcgacgaaggccgtgtgcgtgctgaagggcgacggcccagtgcagggcatcatcaatttcgagcagaaggaaagtaatggaccagtgaaggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgcttg

SEQ ID NO: 15543 - DNA, 130 bp, Homo sapiens
aacataaccattcttaatttaactgtttatattatcctaactactaccgcattcctactactcaacttaaactccagcaccacgaccctactactatctcgcacctgaaacaagctaacatgactaacac

SEQ ID NO: 15544 - DNA, 406 bp, Homo sapiens
  misc_feature 406: n = A,T,C or G
cgttgctgtcgccggggcggaggagaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcan

SEQ ID NO: 15545 - DNA, 245 bp, Homo sapiens
tgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggggggggtgagctcccatgtctacgagcacagggggtctttggctatccggcctgataggtggtatcgttacatcctcttgtgctg

SEQ ID NO: 15546 - DNA, 375 bp, Homo sapiens
  misc_feature 375: n = A,T,C or G
tgagccaggcatggtggtgcatgcctataatcccagctacttgggaggctgaggcaggagaactgcttgaacccgggaggtggaggttgcagtgagtcaagatcgcgctattgcactccagctctgggcaacagagcaagactccatctcggggaaaaaagcaaaacaaaacaaaacaaaaatcaaaaacataaataaagtgtgacagggtgtcctactatgcagtagagtaacacatcagaaaaaacaaaataggctgggcacattggctcatgcctgcaatcctagccctttgggtggctgagtgggggcgggtcccttgagctgaggagttggagaccagcctgtgcaccaaaacacaaccttgtctctacn

SEQ ID NO: 15547 - DNA, 394 bp, Homo sapiens
cgttgctgtcggtttcaccatgttggccaggctggtctcgagctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctataacagaggggctggggagaggaaggggcagagggaccggtca

SEQ ID NO: 15548 - DNA, 149 bp, Homo sapiens
gaggttctgggaagatggcgaaggtctcagagctttacgatgtcacttgggaagaaatgagagataaaatgagaaaatggagagaagaaaacttcagaaatagtgagcaaattgtggaagttggtgaagaattaattaatggagatgcg

SEQ ID NO: 15549 - DNA, 218 bp, Homo sapiens
  misc_feature 150, 152, 173: n = A,T,C or G
aacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccanangagatataaaaaaatttaaanggggggggcgttttttttttttttccgacctgtgaaaatattttt

SEQ ID NO: 15550 - DNA, 141 bp, Homo sapiens
gaactgacaattaacagcccaatatctacaatcaaccaacaagtcattattaccctcactgtcaacccaacacaggcatgctcataaggaaaggttaaaaaaagtaaaaggaactcggcaaatcttaccccgcctggttac

SEQ ID NO: 15551 - DNA, 325 bp, Homo sapiens
atgttagctgagtgatggccaagttttttctctggacagtaatgtaaatgtcttactggaaatgacaagtttttgcttgatttttttttttaaacaaaaaatgaaatataacaagacaaacttatgatagatcaggggtgttgttatgtttttttaatttaaaaatgcaaccctgccccctccccagcaaagtcacagctccatttcagtaaaggttggagtcaatatgctctgactgacaggcaaccctgtagtcatggagaaaggtttttaaagatctagtccaatctttttctagagaaaaagataatctgaaactcacaaa

SEQ ID NO: 15552 - DNA, 359 bp, Homo sapiens
gtgacacaacctatggaaacctctgggatacagcaaaattgatgctaagaagaaagttcatggcattaaatgcctacatcaaagagtctgaaagaacacaaatagacgatttaaggtctcacttcaagggactagagaatcaagaacaaacaaaacccaaacccagcagaagaaataagatcagagcagaactaaatgaaattaaaacaaaacaaatacataggacaaatgaaacaaaaagctcgttattagaaaagataaacaaaattaatagactattatcaagattaaccaagaaaagaagagagaagatcgcaatgggctcaattagaaacaaaacaggagatatcacaaccaag

SEQ ID NO: 15553 - DNA, 376 bp, Homo sapiens
  misc_feature 362: n = A,T,C or G
cgttgctgtcgctgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctaaaacagaggggctggggagaggaaggggcanagggaaccggcact

SEQ ID NO: 15554 - DNA, 150 bp, Homo sapiens
gaactgacaattaacagcccaatatctacaatcaaccaacaagtcattattaccctcactgtcaacccaacacaggcatgctcataaggaaaggttaaaaaaagtaaaaggaactcggcaaatcttaccccgcctggttaccaaaaaaaa

SEQ ID NO: 15555 - DNA, 396 bp, Homo sapiens
cgttgctgtcggtccggggctatggctgtgactctggacaaagacgcttattatcggcgagtgaagagactgtacagcaattggcgggtgaggaagatcctgtaatttttcctagggagcccccttagccatcccataataaccctgtttctcggcgcccttttttctctttcggtcaggaattcccgggttctgtgcctcacccttttcgttgctcccgaatcattcaccggaggcggccacgaacgctgccccttaacagggaatcccccgcattcaccctgtcctgcggccatcaccatcttccccgcgtgccagccttggtcatgcatagcagcacctctcgcagtctcttcccgccctagaagaggcaacatccttccctcctactccgtg

SEQ ID NO: 15556 - DNA, 353 bp, Homo sapiens
gagagttcctccttgctctggcccctactctttctggtgttagatcgagctaccctctaaaagcagtttagagtggtaaaaaaaaaaaaaaaaccccccaaccgctcgaacccccaaaggggagaaaatttttttgggacatcctcctgcttttcccgatactgaacgttggctccctaaagcccttcgggaagcttttttttcctaaaaggaaaaaatcaccccccgggaaaatcgggctgattacaggacctggcctgggaatgggaaaactgccggcctataaatttgctaaactaaaaagcaagcgggttttttggaataaaaataaccatggactggaggaaacaccg

SEQ ID NO: 15557 - DNA, 131 bp, Homo sapiens
tagtagactacacaacagcgaaggaatttgctgattcccttggaattccgtttttggaaaccagtgctaagaatgcaacgaatgtagaacagtctttcatgacgatggcagctgagattaaaaagcgaatg

SEQ ID NO: 15558 - DNA, 328 bp, Homo sapiens
ggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctcccccg

SEQ ID NO: 15559 - DNA, 385 bp, Homo sapiens
cgttgctgtcggatgaaattggagctctggataatgcagaattggaaggttctattcaagtggacagcaatcgcttacaggaagctttgaatgactactataaagagaacgcagacaaccgtgtacaactgaatacccttgaacccttggaggatcacgacctgcctatgaatgatctcgacgactctgagaaggactacttgaggactgtagaccttgagcaaacatatgagacgtgggtaacgctgtcatggacgcggttaaacagcacaagccataactgttcaccactattaccaaaaacctaggggtcgggacgggaattgaaatccgcgaaggctccctagtcttccatagccttaatcaatacaggccgaacagagga

SEQ ID NO: 15560 - DNA, 334 bp, Homo sapiens
  misc_feature 332: n = A,T,C or G
atatcaaaacctccaggataccgcaaaggcagtgctaaaaggaaagttcatagcgttaaatgcctacatccccaagtctgaaagagcacaaatagacaatctaaggtcacacctcaaggaactagagaaacaagaacaaaccaaaccccaacccaaacccagcagaagaaaagagataaccaacatgagaccagaactaaatgaaattgaaacaacaacaacaacaaaaaccaacaaaaaataaataaaacagaaagctggttctttgaaaagataaataagattgatagaacattagcaagattaaccaagaaaagaagagagaagatccnaa

SEQ ID NO: 15561 - DNA, 426 bp, Homo sapiens
cgttggtgtcggcattagtcactttgaaatgtaacaaatggtactacaaccaattccaagttttgatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttgaaaagggattttttttttttcccccgggtgggggggaaaaacaaaaattgggtttaatggcccctccgttttttggggtaaaaaaattggcgggctcacccccccgaggaggtggaaataagggggcccctttcccacccaaagttatttttggtttttttaaaaaaaaggggggttcaccattctggccaggctgggtttaaa

SEQ ID NO: 15562 - DNA, 391 bp, Homo sapiens
cgttgctgtcgtttttttttaaatatgggtattggcgttttttcttttttactctttccttcttaactcaagacttgtagtgttgtaaacctgcctcacaaaatacatggaaataacttttctttaaaaaaaaaaaaaaaacagccttaacccattttttgggggcccactttttgggcaaggatggacaccaatttatttcccccttggggcccccaaaaacttatttaaatacccttttttaacccacccttctctttattatagggacatgcccttaaatggacaaaaaaggtttaccctttggaataaaaatgcagagcaggcaaaaccattacacctgtggcgaaaagttaaaagttagggaaaaaccggggcagaggaaaagggg

SEQ ID NO: 15563 - DNA, 331 bp, Homo sapiens
  misc_feature 166: n = A,T,C or G
ggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgcagagagagtanaaaaaaaaaaaaaaaaaaaaaaaaaaagggggcctttttttccgtaaacccaacatggaaaaaaaccttggggggtttgggccaccccccccttaaagggcggggaaaaaagggttttttttggaaaattggggaggttttggtttttttggaaccctttaaagc

SEQ ID NO: 15564 - DNA, 235 bp, Homo sapiens
cagtagacactgaggcctcacctcagactgggcaaggagcagggagcatacctgggccccagcatcagcatcagcctgctcctccccacacagcactcgggccaggccctctcccctgtccttcttaaactccgcctgggaagacagagaaacatggagagcaagagatgaaattactgctctgccctaaactgcacccagagtctctgattacagtcatactcttaccccgtcc

SEQ ID NO: 15565 - DNA, 414 bp, Homo sapiens
cgttgctgtcggggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttttttttttttttttttggggcccctccccttccgggcaagggggggggtccttttttaaacccagggaaaaaccggcccccccctttggtggacgaagggctctaagggcccccccgggccccagggcccacccgggccccatttggcccgggtggttgcccggccccggaaaaccccggggccccggttcctttacgggggatttaggggcggggggtccagggaccattccctttcccggggagttataccgcgaaag

SEQ ID NO: 15566 - DNA, 377 bp, Homo sapiens
ttgcaaaggctaaagagttgggtgccactgaatgcatcaaccctcaagactacaagaaacccattcaggaagtgctaaaggaaatgactgatggaggtgtggattttttgtttgaagtcatcggttcggtcgataccattactgccttccctgctatgatgtcattattcttatatgtttcgtacctctctttgggtttctcttgttttcttaatttttcctcttgactctttctttggtctatctccccacctcttttattcctcttttccttttttgtataatactgtctcctatcattcctttctttatcttcaccctctacgtccttttctttggtttaatccttctgactttttcgtttcctcttccgctct

SEQ ID NO: 15567 - DNA, 412 bp, Homo sapiens
ggcacgaggcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagataattag

SEQ ID NO: 15568 - DNA, 342 bp, Homo sapiens
tacgtctgctagaacacgacagaaggggaaccggatgctggacaggcaccccggcttggcgctgtctctccccctcggctcggagaggcccttcggcctgagggagcctcgccgcccgtccccggcacacgcgcagccccggcctctcggcctctgccggagaaacaggtgaagggggtgcagggtggggccgttggggaggcctggggacccgggggctccgcagcggcagggggcctctgggaccttggggatgttgtgatggacgctgcagtggggccgggagagatgaagagacgcggagggtcgccctgagggaagactcttcgggatgacaggagc

SEQ ID NO: 15569 - DNA, 169 bp, Homo sapiens
cgatggtagtcgccgtgcctaccatggtgaccacgggtgacggggaatcagggttcgattccggagagggagcctgagaaacggccaccacatccaaggaaggcagcaggcgcgcaaattacccactcccgacccggggaggtagtgacaaaaaaaaaaaaaaaaaaaa

SEQ ID NO: 15570 - DNA, 141 bp, Homo sapiens
cacccaccagtgggaccaccagagatgtggatgggatggtttctgtgatgaccagcaaaaacacagtcagagaaagcaggactgaaatacaaagcgtcactttttcaccacagtccgaaggaaggtaaaagaccaacacgg

SEQ ID NO: 15571 - DNA, 318 bp, Homo sapiens
gaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaaatcaatggtcagctcagttgaacagaaaaaagggcctacaagacagcgcaaatggggcttttggtagtcaaatagagacaaagaatgtggacagttactaatatctgaaaaccagaa

SEQ ID NO: 15572 - DNA, 151 bp, Homo sapiens
cgttgctgtcgcttaaagcgggccttcgtgaggatgagtacaagccctgaggctttcctggcgctccgctcccacttcgccagctctcacgctctgatatgcatcagccactggatcctcgggattggagacagacatctgaacaacttta

SEQ ID NO: 15573 - DNA, 298 bp, Homo sapiens
cctcctctctgccttccaacctccagaggacgagacctaaagggtgcctgattggctgcggagggcggggctaagacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaaaaaaaaaaaaaa

SEQ ID NO: 15574 - DNA, 390 bp, Homo sapiens
cgttgctgtcgcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagcccccca

SEQ ID NO: 15575 - DNA, 391 bp, Homo sapiens
  misc_feature 348: n = A,T,C or G
cgttgctgtcgcgcacaccaaggcgcagcatcagcaggcactgtcctccctggagctgctcaacgttctcttcaggacctgcaaacatgagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaatcgcaagaaacgcangtcataggatggcacgccaacgtaggaatgcacacctgcaacc

SEQ ID NO: 15576 - DNA, 389 bp, Homo sapiens
cgttgctgtcggtggatgtcttgcagtgatgattctgcaaaacctcttttctaaccctgagaaattcttcagtattcgtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttttctcacccccaccctagcctccaccatccccgcacaaagcggctctaaacctcaggccacatcttttccaaggcaaaccctgttcaggctggctcgtaggcctgccgctttgatggg

SEQ ID NO: 15577 - DNA, 159 bp, Homo sapiens
  misc_feature 107: n = A,T,C or G
gagtcggactgcgacacagcccatcccctcgaccgctcgcgtcgcatttggcctcctccctaccgctccaagcccagccctcatccatggcatgccccctggatcangccattgggctccttgtggccatctttcacaagtactccggcagggagggtg

SEQ ID NO: 15578 - DNA, 147 bp, Homo sapiens
  misc_feature 147: n = A,T,C or G
ggtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacn

SEQ ID NO: 15579 - DNA, 148 bp, Homo sapiens
  misc_feature 148: n = A,T,C or G
tgattatctaccgggacctcatcagccacgatgagatgttctccgacatctacaagatccgggagatcgcggacgggttgtgcctggaggtgtaggggaagatggtcagtaggacagaaggtaacattgatgactcgctcattggtgn

SEQ ID NO: 15580 - DNA, 391 bp, Homo sapiens
  misc_feature 302: n = A,T,C or G
cacgccattctcctgtctcagcctcctgagtagctgggactacaggcgcccgccaccatgcccagctaatttttttgtatttttagtagagacgggttttcaccgtgttagccaggatggtctcgatctcctgacctcgtgatctgcccgccttggcctcccaaagtgctgggattacaggcatgagccaccgcgcctggcccattttcttcctcttttgaggtaatggatttgtttggagatggcatgttagtagacgactgaatatggaaaggatatcgagttatctattttggtaattntatttttggtttttatcatctagatttttatcatggattagtctgaaatttaaagttctggccagtcggttttcttttatcttggaagg

SEQ ID NO: 15581 - DNA, 166 bp, Homo sapiens
  misc_feature 10, 11, 14: n = A,T,C or G
aaaaggtctnnatnaattgcaaagatgtctgacacagtctggcattgctggaggatacaaaccttttaacctggagacttgccggcttatggtttcaatgctggatagagatatgtctggcacaagggtttcaatgaatttaaagaactctgggctgtactgaatg

SEQ ID NO: 15582 - DNA, 149 bp, Homo sapiens
atgacccaccaatcacatgcctatcatatagtaaaacccagcccatgacccctaacaggggccctctcagccctcctaatgacctccggcctagccatgtgatttcacttccactccataacgctcctcatactatgcctactaaccaa

SEQ ID NO: 15583 - DNA, 296 bp, Homo sapiens
gcttcggctgcaagaagacgacggaaggggggtgttttgcgggtagcgcggcgtgataagccatgagcaccaaaggctctggcgacaccctgtacgaggcggtgcgggaagtgctgcacgggaaccaacgcaagcgccgcaagatcctggagacggtgtagttgctgagcagcttgaataactatgatcccctgaaggacaagggcttttgggacacgcggaggcttaagtccactcggcgccgtaggttctttgagtttgggctgggggaccagcagctctgggtggaggctaag

SEQ ID NO: 15584 - DNA, 166 bp, Homo sapiens
ggccgacgtgttcttgcggtggcggagcggcggattatccttcgcggggcaaaatggagctcgaggccatgagcagatataccagcccagtgaacccagctgtcttcccccatctgaccgtggtgcttttggccattggcatgttcttcaccgactggttcttcgg

SEQ ID NO: 15585 - DNA, 178 bp, Homo sapiens
ctacgcttgctgtttgcgctctctgaaagggacaccaaggctgtgatttacaccaactgtcgagcactgcttctccatggagaaactagaaaaactgcttttggaattatctctacagtgaagaaacctcggccatcacaaggagatgaacattgtcttccagcttccatgaaagact

SEQ ID NO: 15586 - DNA, 151 bp, Homo sapiens
gacttgggctgaggagccgccgcgtcccctcgccgagtcccctcgccagattccctccgtcgccgccaagatgatgtgcggggcgccctccgccacgcagccggccaccgccgagacccagcacatcgtcgaccaggtgaggtcccagctt

SEQ ID NO: 15587 - DNA, 402 bp, Homo sapiens
ggcacgaggcgggttccttttttagaagctttgtgggttgatttttttttcttttcttttttggacatttttaattgcagtttaaaagtgaatcgtaagagaacctcagcattgtgcacgataagagaatgtgtcagtatttcagggttctacattttatctgtaaaatgtgacttttttttttttttatcacaccaaaagaaaaaggtggtttggccccgggggttttttataaaaaattaaccccccccttttttcacaaaaaaaaacagcggggagttttggccccattataaaaaaagggttcccacccaaatttttgtggggcctagggggccctcagaaatggcataaaaacttggaccggctaaaataaccccccaccctttttgaagtgggggg

SEQ ID NO: 15588 - DNA, 187 bp, Homo sapiens
gaccacgcttttcatctgtcccgctgcgtgttttcctcttgatcgggaactcctgcttctccttgcctcgaaatggaccccaactgctcctgctcgcctgttggctactgtgcctgtggcggctcctgcccatgctaagagtgcaaatgctcctcctgcaagaagaactgccgctcctgctggcctg

SEQ ID NO: 15589 - DNA, 155 bp, Homo sapiens
gaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgatttttatgacaaataa

SEQ ID NO: 15590 - DNA, 314 bp, Homo sapiens
cattggtatttcattgtatgacaatgatgttcacttttaccactttcatttaacacagtactggaagttctagccagagcaataagaaaagagatagaaataaagtccatccaaattggaaatgcagaggtcaaattgtccttgtcatagacaattgatcttatattatgaaaaacctaaataattcatcaaaaaactgttagaattgataaacaaattcagtaagtttacaggctataaaatcaatatggaaaaatttgaagcatttctacatgccaacagtggacaatgtgaaaaagaaatcaagaaagcaa

SEQ ID NO: 15591 - DNA, 352 bp, Homo sapiens
ggtggaaaaaggaatcattgacccaacaaaggctgtgagaactgctttattggatgctgctggtgtggcctctctgttaactacagcagaagttgtagttacagaaattcctaaagaagaaaaagaccctggaatgggtgcaatgggtggaatgggaggcgttcttttactttctgtacgaagctatttctattaaaaaaccaaaaatctaatctcttacattattttttgcctttatacaaatatatttcctacttctatctcacagtcattctatatagcgtctcatactcctaattttactatatccactttatcaactttatcctctatacgaccttgtataaatatc

SEQ ID NO: 15592 - DNA, 289 bp, Homo sapiens
gcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgcc

SEQ ID NO: 15593 - DNA, 171 bp, Homo sapiens
gcaagcgccaccctagcaatatcaaccattaacctttcctctacacttatcatcttcacaattctaattctactgactatcctagaaaccgctgtcgccttaatccaagcctacgttttcacacttctagtaagcctctacctgcacgacaacacataaaaaaaaaaattc

SEQ ID NO: 15594 - DNA, 405 bp, Homo sapiens
cgttgctgtcggacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccggccgcctccgcctccccagcgctgagatacaggggggagccac

SEQ ID NO: 15595 - DNA, 158 bp, Homo sapiens
gacttcaagggtacctgaagcgaattggcaccaaagcagcagctgtattgccgcagttctagcttcaccttcacgatgtttcccttggtcaaaagcgcactaaatcgtctccaagttcgaagcattcagcaaacagtggctaggcagagccaccagaa

SEQ ID NO: 15596 - DNA, 375 bp, Homo sapiens
cgttgctgtctttctatgagagaccgggctttaccatattacccacgaggctgttgaggtcctgagcttgagatacacccgcctccctcttccaaagctctgagattacagacttgagccaccttgtctggacggaaatctcagaattctttaagactgacctaattgctgcatcccaagtttacatgcactttcctttttattgtggtcgccacttgccctttgtgtcccacttcatgcctgtcatgttctacctgacttgcgacatggactgacggattatactgcccccagagaaggagcttgccatgcccggggaggacctgaaaatcaaactaatcttgcggcagacaatgatcttagagaaaggccagc

SEQ ID NO: 15597 - DNA, 427 bp, Homo sapiens
cctcgaatcgcccttttgcatgatcccatcgatcccaactccgcagatgtcgggggtgaagggagaagctgccggtcgcactcacaatgacgacgctcctgctattgctgctggagctccgggagctgggagaggcccaaggatcccttcacagatggaatacttcggcactatctccattggctgcccaccacagaacttcactggcatcttcgacactggctcctccaacctctgggtcccctctgtgtactgcactagcccagcctgcagtggaaggactaaccgtggttggccagcagtttggagaaagtgtcacagagccaggccagacctttgtggatgcagagtttgatggaattctgggcctgggatacccctccttggctgtgggaggagtgactccagcatttgacaacatgatggc

SEQ ID NO: 15598 - DNA, 314 bp, Homo sapiens
gggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaattccgcccgtgcttttggacctgcggtggtggccaaccactggaacttccactggatctactggctgggcccactcctgactggcctgcttgttgcactgctcattatgtgcttcaatgcacaccggaagattcggcctcatccctgaagg

SEQ ID NO: 15599 - DNA, 321 bp, Homo sapiens
agacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaagcctcggtgaagcagagctcgtgggattcctgctgctccaggtgtcctcagctcacctgtcccagactcaagacaggggagtg

SEQ ID NO: 15600 - DNA, 270 bp, Homo sapiens
gacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgat

SEQ ID NO: 15601 - DNA, 331 bp, Homo sapiens
tgggggcgactaacctaccgagcctggtgatagctgcttggacgagatagaatcttaggtcaactttatattcggccacagaaccctctacatccccttgtgaatttatctgttagtccaaagaggaacagctgtttggacactatgaaaaaaccttgcggagagagtaaaaaatttaacacccatagttaacctaccgagcctggtgatagctggctggccaagatagaatcttagttcaactttaaatttgcccacagaaccctctaaatccccttgtaaattgaactgttagtccaaagaggaacagctctttggacactaagaaaag

SEQ ID NO: 15602 - DNA, 321 bp, Homo sapiens
aattaggagatgctgatctctcacattatgaatttctaaatcctagaaagaaaggcttggagagcttctgaatatagagaagtttcatttaaggactaggtcccccttgttgatgtatcaaaatattacagactctaaactgagacttaattctcaaatgtgttttacttgatctaaaataatctgtccacaaaaataaaattctaagtaataaattgttattttcccaccgggggaatcactaacccatttatgcctgagggtgcaattttttgaacttgaaaatcagaccttggcgatgactttgaacaaaatattaat

SEQ ID NO: 15603 - DNA, 167 bp, Homo sapiens
taaaacactgaactgaccattaacagcccaatatctacaatcaaccgacaagtcattattaccctcactgtctacccaacacaggcatgctcataaggaaaggtttgaaaaagtacaaggaactcggcaaatcttaccccgcctgtttaccaaaaacatcacctctt

SEQ ID NO: 15604 - DNA, 402 bp, Homo sapiens
agatgcctgctatcctgactaatttaagtcattagctgactgcatagctctttttcttgagaggctctccattttgattcagaaagttagcatatttattaccaatgaatttgaaaccagggcttttttttttttgggggaaggaaaacccacctccttccccccaaaaaattaaaaaaggccccttggtttctttattaaggaacccccttctaattaatgggccaaaccccaaggaacaaaaatttcccaatattctgcgcccccgaaaaagaggtgcctttttaagaaaacacgttttttacctttaaccaaaaacccagggggaaaaataaaaccttcgggggggaaatccggggggtgaaaaaaaggggccttccattccccccccgtttttttttt

SEQ ID NO: 15605 - DNA, 367 bp, Homo sapiens
agttgtgatacgaatagaacaaaaaaaaaaaaacccttaaacttttgtggggaccccaaggagttgggaacttggggaaaaataaccccggccccagcggttcccacccacattccatttttttctttggaacggatttagtaaggcccaaagggggaaccccttctttggaaaaaagtcccaattggggtctaaaacgggggaaaaaaaacaacccggccgccacttggttaaacctaaaagcttttaaaaacccaatatattcggccaaaaatatccctggatggtaacccctcaccccataggggtttttggtttttaaacaaaataatatttgtcggggggggaaaaacccttggctttcaaa

SEQ ID NO: 15606 - DNA, 188 bp, Homo sapiens
ggctgcctctaggttctgggaagatggcgaaggtctcagagctttacgatgtcacttgggaagaaatgagggataaaatgagaaaatggagagaagaaaactcaagaaatagtgagcaaattgtggaagttggagaagaattaattaatgaatatgcttttaagctggggagatgatatttggtatat

SEQ ID NO: 15607 - DNA, 393 bp, Homo sapiens
cgttgctgtcggaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtg

SEQ ID NO: 15608 - DNA, 172 bp, Homo sapiens
  misc_feature 3: n = A,T,C or G
atnaacaaacttaagtatgccctgacaggagatgaaactaagaagatttgcgtgcagcggttcattaaaatcgatggcaaggtacgaactgatataacctaccctgctggattcatggatgtcatcagcattgacaagacgagagagaatttccgtctgatctatgacaccg

SEQ ID NO: 15609 - DNA, 396 bp, Homo sapiens
  misc_feature 396: n = A,T,C or G
cgttgctgtcggtgacctgcagagcctgttggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatn

SEQ ID NO: 15610 - DNA, 385 bp, Homo sapiens
cgttgctgtcgccaaaatcgcaccactgtactccagcctgggtggcagagtgagactccgtctcaaaaaaaaaaaagggccttaacctatcccttaggacaaagggacttaaaaaatttttacaaaactttttatccggggagggcaaaatatactttttattcttcaccccagggaacattctccaaaataaaccatatgatgggccccaaaacaagtctcaataattttaaaaaaatggaaattatatcaggtcctcttttaaaccacaggggaataaaatgggaaatcacctccaaagggacccctcaaagccttgcaaagacatggaaattaaataccctgctccgggattatggtggggtcaataacaaaatcgagaggg

SEQ ID NO: 15611 - DNA, 352 bp, Homo sapiens
  misc_feature 352: n = A,T,C or G
acataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttgtagcaatcactacagtgaaaactatattcagaattaaataaagaaccatcatttctaaaacttctctcataccactattttactaaataaaatttagtgttagaattcaaatcagacttaataan

SEQ ID NO: 15612 - DNA, 388 bp, Homo sapiens
aattaggagatgctgatctctcacattatgaatttctaaatcctagaaagaaaggcttggagagcttctgaatatagagaagtttcatttaaggactaggtcccccttgttgatgtatcaaaatattacagactctaaactgagacttaattctcaaatgtgttttacttgatctaaaataatctgtccacaaaaataaaattctaagtaataaattgttattttcccaccgtgggaatcactaacccatttatgcctgaggttgcaattttttgaactgcaaaatcagaccttggcgatgactttgaacaagatataaataacttccacatgcttagcgttccaataatggaacactgggcatataatgtgaaatgtattctatgaa

SEQ ID NO: 15613 - DNA, 183 bp, Homo sapiens
  misc_feature 8: n = A,T,C or G
acgttccnccgctatatgcggcggtctggcaggaatgggaggcatccataacgagaaggagaccatgcaaagcctgaacgaccgcctggcctcttacctggacagagtgaggagcctggaatacgaaaaccggaggctggagagcaaaatccgggagcacttggagaataagggaccccaggt

SEQ ID NO: 15614 - DNA, 405 bp, Homo sapiens
cgttgctgtcgggcatgtgcctgtggtcctagctactcatgaggctgaggtaggaggatcacttgagcctgggaggtcgaggctgcagtgagccatgaacatgctactgcattccagcctgggcaacagagtgagaccctggctcaaaaaacaaaaacaaaaactagtttgttttagtattcattaattacgtatatgagcactggtagtctagtgtttgttcttgtatacagagttttcttaaatgagatgatgctatttaattctgttacttgttttttcaactaatggatcttttaaagttttttatttaaattttttgtgggtacatattaggtacatatacttatggggtacatgagatgtttttataaaggctcagctaatgtatcttgaatatcatgt

SEQ ID NO: 15615 - DNA, 329 bp, Homo sapiens
  misc_feature 324: n = A,T,C or G
ggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattntattt

SEQ ID NO: 15616 - DNA, 394 bp, Homo sapiens
ggcacgaggccggccaatgccggaccgctttggcaccgtccgcccgatctctccacccgtgggccggcaatggcgggcgcagtttcgctcttgggtgtggtggggctgctgcttgtgtctgcgctgtccggggtcctaggagaccgagcctatcccgacctccggacacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaac

SEQ ID NO: 15617 - DNA, 162 bp, Homo sapiens
attatgacagaggttactctagcctgcttaaaagagattttggggcaaaaactcagaatggtgtttacagtgctgcgaattacaccaatgggagctttggaagtaattttgtgtctgctggtatacagaccagttttaagactggtaattcaacagggactt

SEQ ID NO: 15618 - DNA, 358 bp, Homo sapiens
  misc_feature 17, 358: n = A,T,C or G
cgttgctgtcgattcanaattgggatgggggttggggtgaagcacacttattatcttcagttgcagtgatttcaaatttaagattttttgttgttggtttgaactgtccccttagtttcttgttatttccaatttgttctgcttagtcattacttttaattcttttcttactaaaattttatggaggttgggggaagggagttagcatcactaacctgacagttgttgccaggaatttgctctgtttactgctagtatattagaaatcctagatctcagaatcacaatagtaataaacaacaggggtcattttttcctaacttactctgtgttcaagtgtggaatttctgtctcccan

SEQ ID NO: 15619 - DNA, 420 bp, Homo sapiens
tctactgtggcactatttaagcaagttaaaatttagttaaaccctctcattattaaagaggaaaggcgatggtgatgtctgtagtacaatataaaccataattgtgatttaccttaagtaggtataactcttatgggatatacagtatagtttttgtgaatctttacatgacagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaaccaattaagtctttaggaatgtgtaaccagaactatgttagtattgcttataaaactttaggtagggtcaatatatacctatag

SEQ ID NO: 15620 - DNA, 373 bp, Homo sapiens
cgttgctgtcgaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtatgagagagagagtgtgtgtttgtgtgtttcaaggtcacaacaggcttttttgtttttgttttttgctctttgctccttttcgagaaggaggcctgctcttgccgcccaggctggattccacacgcgccctctccatccactgtatcctctgccctccagggtcagccaggactactgcctcctcctccggacgaactgggacccccccaccc

SEQ ID NO: 15621 - DNA, 294 bp, Homo sapiens
  misc_feature 139: n = A,T,C or G
ggcggctggcctgcatcggggacgagatggacgtgagcctcagggccccgcgcctggcccagctctccgaggtggccatgcacagcctgggtctggctttcatctacgaccagactgaagacatcagggatgttcttanaagtttcttggtcgggttgaccacccttaaggataacatttttattttttggagacacccaaaccccggttcctgtttctccttctcacacgatctttcttctctttggttgttgccgtttgcgttgttttcctcacgtcttccccttgcctgtc

SEQ ID NO: 15622 - DNA, 322 bp, Homo sapiens
  misc_feature 322: n = A,T,C or G
aaatatagaaacaaaagattattgccagccaccacaaatacacacttaactatgtagaccattgaaactataaagcaactacacaatcaagtctacatgacaaccgcttaacaacacaatgacacgatcaatttttcacatatctacattaaccttggacacaaaagggctaaacagctcacttaaaaggtacagagtggcaagttagatacagaagcaagacctgactgcatgctgtcttcaagagatccatctcacatgcagtaacatctatgggctcaaagtaaagggattgagaaacatgtttgaagtaaatggaaan

SEQ ID NO: 15623 - DNA, 164 bp, Homo sapiens
aggttccccttcggctacaggaaggcaggaggggtgagtcccctactccctcttcactgtggccacagcccccttgccctccgcctgggatctgagtacatattgcggtgatggagatgcagtcacttattgtccaggtgaggcccaagagccctgtggccgcc

SEQ ID NO: 15624 - DNA, 284 bp, Homo sapiens
gacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctcccc

SEQ ID NO: 15625 - DNA, 388 bp, Homo sapiens
ggcacgagatgagcccagccttcagggtctttgatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccaaagctgggggccacctcagaagtgtcatctctctttgagcacgcattcccctggagag

SEQ ID NO: 15626 - DNA, 336 bp, Homo sapiens
ggaaaaccagctctgaggttgagccattgataaatgcttataaacatcttggccaagaggacacatcagcccaaggaggactagaggcacaaatatgccagctacctttggacatttggcagggggatacaatggccactattatggatatctttggagtgaagtattttccatggatatgttttacagctgttttataacagaagggatcatgaacacggaggttggaacgaatttccgaaggctcaccctgatacctgcgggatctctggacggggtggacatgctacacaatttcttggacgtgagtgaagcctcagagcgtttctacagact

SEQ ID NO: 15627 - DNA, 325 bp, Homo sapiens
ggatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgaccgtgaaattaccaaagaagatgatgctttgtggccttcccctgataagggtg

SEQ ID NO: 15628 - DNA, 405 bp, Homo sapiens
tgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgat

SEQ ID NO: 15629 - DNA, 387 bp, Homo sapiens
ggcacgagggcgagtgtagtgcttccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctat

SEQ ID NO: 15630 - DNA, 413 bp, Homo sapiens
gactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctcccta

SEQ ID NO: 15631 - DNA, 318 bp, Homo sapiens
gatgctcggggctgccttggccaaggcggtgagtcctgaggagaggttctggaatgcatctggggcggcctttgtgacagtccaggagcaggggcaggtggcaggggcgttggtggcagagatcatcctgacgacactgctggccctggctgtatgcatgggtgccatcaatgagaagacaaagggccctctggccccgttctccatcggctttgccgtcaccgcggatatcctggctgggggccctgtgtctggaggctgcatgaatcccgcccgtgcttttggacctgcgggggtggccaaccactggaactttcg

SEQ ID NO: 15632 - DNA, 321 bp, Homo sapiens
cagccatgtctggtcgaactgctgggctctgctctcttcatcttcatcgggtgcctgtcggtcatcagaatgggacggacactgggctgctgcagacggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggctctggaatgcatctgggg

SEQ ID NO: 15633 - DNA, 386 bp, Homo sapiens
  misc_feature 25: n = A,T,C or G
cgttgctgtcggctgcgcgtcgcangagtaacctacttggtctcctgctttcgcgacatggccttcaattttggggctccctcgggcacctccggtaccgctgcagccaccgcggcccccgcggatcatatctgaagatattagtgagctacaaaagaatcaaactacatctgtagccaaaattgcacaatacaagaggaaactcatggatctttcccatagaactttacaggtcctaatcaaacaggaaattcaaaggaagagtgggtatgccattcaggctgatgaagagcagttgcgagttcagctggatacgattcagggtgaactaaatgcacctactcagttcaagggccgactaaatgaattgatgtctcaaatcaggg

SEQ ID NO: 15634 - DNA, 381 bp, Homo sapiens
ggcacgagggtaagaagagctgtcgcattacccaggcatcgtggatggccccgcagccctggatagcttcccagagacagtgcccccagtaccagggccctatggaccgcaccggccttcccagaccctgcccccaggcttggacagcgacggtctgaagagggagaaggatgagatctatggacacccgctcttccccctcttggccctggtctttgagaaatgtgaacctggctacatgctctccccgtgacggggccggagctgggctggggacaccccctggaggagatgtctgctcctctgattacttcaacgaggacatcgctgcctttgccaagcaggtccgctctgagaggcccctcttcttcttcaacccag

SEQ ID NO: 15635 - DNA, 382 bp, Homo sapiens
cgttgctgtcggcagattctgcagccatcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctgggcccacccgggaccgcagcccagttcctgacgcccccctcgcagcacagctactgctcgcctgtggacaacacccccagccaccagctacaggtgcctgagcacccctttctcaccccgtcccctgagtcccctg

SEQ ID NO: 15636 - DNA, 319 bp, Homo sapiens
  misc_feature 319: n = A,T,C or G
ggggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccan

SEQ ID NO: 15637 - DNA, 397 bp, Homo sapiens
ggatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttatatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaaataagttctctt

SEQ ID NO: 15638 - DNA, 406 bp, Homo sapiens
attcgaattccgttgctgtcggcggcatcaaactctttttgactgctcccctatctccaccccggagctgctcactccgtgcggctcggcggagtacatggccccggaggtagaggaggccttcaacgaggaggctagcatctacgacaagcgctgcgacctgtggagcctgggcgtcatcttgtatatcctactcagcggctacccgcccttcgtgggccgctgtggcagcgactgcggatgggaccgcggcgaggcctgccctgcctgccaaacatgctgtttgagagcattcaagagggcaagtacgaagttccccgacaggactgggcccacatcttctgcgctgccaagacctcatattcaagctgttggtccggacccccaacagaggctgtatgccgcg

SEQ ID NO: 15639 - DNA, 404 bp, Homo sapiens
cgttgctgtcgggagacttgaggagttgctgaggtgccacgtgtacctgggcacgaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaaacttggacgtgattggactcccagg

SEQ ID NO: 15640 - DNA, 418 bp, Homo sapiens
cgttgctgtcgatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacact

SEQ ID NO: 15641 - DNA, 400 bp, Homo sapiens
  misc_feature 371: n = A,T,C or G
cgttgctgtcgagattttcaagtgtattgtgccttgctctaaaacttttattaagtaggtgcacttgacagtattgaggtcatttgttatggagctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttctgctgctagntttatgtgatatttattgaacattttgag

SEQ ID NO: 15642 - DNA, 385 bp, Homo sapiens
cgttgctgtcgaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttattttt

SEQ ID NO: 15643 - DNA, 375 bp, Homo sapiens
cgttgctgtcgatccccctggcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccag

SEQ ID NO: 15644 - DNA, 380 bp, Homo sapiens
cgttgctgtcggaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccaacaccgggagtcttggccagggatggggagcggggaggctccaactccggtccaaccccctgaggaggcg

SEQ ID NO: 15645 - DNA, 373 bp, Homo sapiens
cgttgctgtcggccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatg

SEQ ID NO: 15646 - DNA, 310 bp, Homo sapiens
attacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgtgattctcctggatctttgtcaacctgactgtgcgattctgtatcttgggaaaagagtccttttatgaca

SEQ ID NO: 15647 - DNA, 426 bp, Homo sapiens
cgttgctgtcgggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggtgaaggggttctgcacagcctgaaccccagcacttccagcccaaaaagcacaactcttatccccagccaccccat

SEQ ID NO: 15648 - DNA, 354 bp, Homo sapiens
ggacacatcagcccaaggagtactagaggcacaaatatgccagctacctttggacatttggcagggggatacgatggccaatattatggatatctttggagtgaagtattttccatggatatgttttacagctgttttaaaaaagaagggataatgaatccggaggttggaatgaaatacagaaacctaatcctgaaacctgggggatctctggacgggatggacatgctccacaatttcttgaaacgtgaggccaaccaaaaagcgttcctaatgagtagaggcctgcttgctcccggaactggggaactttgggagccgggcatgtctggaggaatagtcgaaatccccatg

SEQ ID NO: 15649 - DNA, 450 bp, Homo sapiens
  misc_feature 20, 22: n = A,T,C or G
ggatgcgtagacgcacgtgntntttgaggagaccccctcatacgcgcgcgtgcttttttggccgaagcggtctacgtgtgagataacacgacagagggggagcccatggagtactaaaggcacaaatatgccagctacctttggacatttggcagggggatacgatggccaatattatggatatctttggagtgaagtattttccatggatatgttttacagctgttttaaaaaagaagggataatgaatccggaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttt

SEQ ID NO: 15650 - DNA, 418 bp, Homo sapiens
catcgattcgaattccgttgctgtcgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgct

SEQ ID NO: 15651 - DNA, 408 bp, Homo sapiens
cgttgctgtcggaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgg

SEQ ID NO: 15652 - DNA, 382 bp, Homo sapiens
cgttgctgtcgccggagccgaaacaccggtaggagcggggaggtgggtactacacaaccgtctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaag

SEQ ID NO: 15653 - DNA, 326 bp, Homo sapiens
gagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattga

SEQ ID NO: 15654 - DNA, 404 bp, Homo sapiens
cgttgctgtcggaggtgaccaagcaattagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaaa

SEQ ID NO: 15655 - DNA, 388 bp, Homo sapiens
cgttgctgtcgctttgtgacaacagtttaggacttatctctgagaatctggaaacatggggaatgtgctcaaactatccgacttccagctcagtctatatggtgctgctgtgtgctcgacaatggtgacattgtggttgtgatggcattattagagtgcttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggag

SEQ ID NO: 15656 - DNA, 391 bp, Homo sapiens
cgttgctgtcgaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaacct

SEQ ID NO: 15657 - DNA, 340 bp, Homo sapiens
gagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcaaaatccttaccagtttgatgtgcttgtgatgcccagtctctatgggaacattattgacaatctggctggtg

SEQ ID NO: 15658 - DNA, 411 bp, Homo sapiens
cgttgctgtcggattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaag

SEQ ID NO: 15659 - DNA, 442 bp, Homo sapiens
  misc_feature 417, 439: n = A,T,C or G
tcgattcgaattccgttgctgtcgatgctatgcttgcaccaccagagggtcaaactgttttggatggtctggagttcaaggttgccttaagaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcataggaagcanaatccaaggcagaaccacccanagg

SEQ ID NO: 15660 - DNA, 408 bp, Homo sapiens
cgttgctgtcgggactttgggtctattttttctactcttttgcctggtgctaatgctatgcttgcaccaccagagggtcaaactgttttggatggtctggagttcaaggttgccttaggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagattt

SEQ ID NO: 15661 - DNA, 356 bp, Homo sapiens
ctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttt

SEQ ID NO: 15662 - DNA, 400 bp, Homo sapiens
cgttgctgtcggtccggagtataggaatatgcagaaataggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactgg

SEQ ID NO: 15663 - DNA, 364 bp, Homo sapiens
gcacttccagatcgagaagctcttgaacaaacctcgactgaaatataaaccagtgactaaccaggttgagtgtcacccatacctcacgcaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaa

SEQ ID NO: 15664 - DNA, 436 bp, Homo sapiens
atcccatcgattttcaaaaggacgtaatactccactgtgcgacagctttgttttccggaaagttcgaagcttgctagggggaaatattcgtctcctgttgcgtggaggcgctccactttctgcaaccacgcagcgattcatgaacatatgtttctgctgtcctgttggtcagggatacggcctcactgaatctgctggggctggaacaatttccgaagtgtgggactacaatactggcagagtgggagcaccattagtttgctgtgaaatcaaattataaaactgggaggaaggtggatactttaatactgataagccacaccccaggggtgaaattcttattgagggccaaagtgtgacaatggggtactacaaaaatgaagcaaaaacaaaagctgatttctttgaagatgaacatggacaaaggtggctctgg

SEQ ID NO: 15665 - DNA, 382 bp, Homo sapiens
  misc_feature 382: n = A,T,C or G
cgttgctgtcggcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggtn

SEQ ID NO: 15666 - DNA, 429 bp, Homo sapiens
tcccatcgattcgaattccgttgctgtcgatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacat

SEQ ID NO: 15667 - DNA, 214 bp, Homo sapiens
ttagtactgcatatgtaaatactaccttttcaatgagctatataaacaatgatagcacatccttccttttactatgtctcacctcctttaggagagaacttccttaagtaagtgctaaacatacatatacggaacttgaaagctttggttagccttgccttaggtaatcagactagtttacactgtttccagggagtagttgaattactataag

SEQ ID NO: 15668 - DNA, 353 bp, Homo sapiens
  misc_feature 83, 84, 85, 86, 87, 88, 89, 90, 91, 92, 93, 94, 95, 96, 97,98, 99, 100, 101, 102, 103, 104, 105, 106, 107, 108, 109,110, 111, 112, 113, 114, 115, 116, 117, 118, 119, 120, 121,122, 123, 124, 125, 126, 127, 128, 129, 130, 131, 132: n = A,T,C or G
  misc_feature 133, 134, 135, 136, 137, 138, 139, 140, 141, 142: n = A,T,C or G
ggcacgaggagagaactagaaaatatgtatattggatatactatgtgccaggcacgattccaagcccctgatacattctctannnnnnnnnnnnnnnnnnnnnnnnnnnnnnnnnnnnnnnnnnnnnnnnnnnnnnnnnnnnaaagtggaacactgggatttgaacaaggttttggttgggcatcttttcctatgggagctcagaaatatctgttgtctagccctttctcagcctcccaaccttctcggttccttacctatgtcacagctgactttgagctaaagtcatctcggggcagctaggtgcctatgtgagctggcgttcatttctcactgtttctccttccaaatac

SEQ ID NO: 15669 - DNA, 399 bp, Homo sapiens
ggcacgagcccaccaagagctgcatagagcacgtttagctagagtaggagtttgcagtgctcatatgggaaatgctgctgctatacttttaggaatttctgagtgcaatttagaaacatctagcacacttgaaacactgcgtatcattttcctcactcatgaatatagtcatcagaattcataaatagtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccatacattcttaccaggcactgagag

SEQ ID NO: 15670 - DNA, 389 bp, Homo sapiens
  misc_feature 50, 51, 52, 53, 54, 55, 56, 57, 58, 59, 60, 61, 62, 63, 64,65, 66, 67, 68, 69, 70, 71, 72, 73, 74, 75, 76, 77, 78,79, 80, 81, 82, 83, 84, 85, 86, 87, 88, 89, 90, 91, 92,93, 94, 95, 96, 97, 98, 99, 100, 101, 102, 103, 104, 105,106: n = A,T,C or G
  misc_feature 107, 108, 109, 110, 111, 112, 113, 114, 115, 116, 117, 118,119, 120, 121, 122, 123, 124, 125, 126, 127, 128, 129, 130,131, 132, 133, 134, 135, 136, 137, 138, 139, 140, 141, 142,143, 144, 145, 146, 147, 148, 149, 150, 151, 152, 153: n = A,T,C or G
  misc_feature 154, 155, 156, 157, 158, 159, 160, 161, 162, 163, 164, 165,166, 167, 168, 169, 170, 171, 172, 173, 174, 175, 176, 177,178, 179, 180, 181, 182, 183, 184, 185, 186, 187, 188, 189,190, 191, 192, 193, 194, 195, 196, 197, 198, 199, 200: n = A,T,C or G
  misc_feature 201, 202, 203, 204, 205, 206, 207, 208, 209, 210, 211, 212,213, 214, 215, 216, 217, 218, 219, 220, 221, 222, 223, 224,225, 226, 227, 228, 229, 230, 231, 232, 233, 234, 235, 236,237, 238, 239, 240, 241, 242, 243, 244, 245, 246, 247: n = A,T,C or G
  misc_feature 248, 249, 250, 251, 252, 253, 254, 255, 256, 257, 258, 259,260, 261, 262, 263, 264, 265, 266, 267, 268, 269, 270, 271,272, 389: n = A,T,C or G
ggcacgaggagagggtggtgggtccctgagttggtggaaagggatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtagaggatgcctggtatgaggcaatatttgggatagggaagggaagcttgggattttagctacgtagagacacttgaaaattggagggaggaaaggagtgggtggctttggagn

SEQ ID NO: 15671 - DNA, 279 bp, Homo sapiens
  misc_feature 71, 72, 73, 74, 75, 76, 77, 78, 79, 80, 81, 82: n = A,T,C or G
cctctccccttggaacccaaagaggaacggggccgaactttataaactttaggcaagggcaaagggcgtgnnnnnnnnnnnnggggccaaggggcatttcccaagcgattaaaatttgggaacctttggttacaaaaattgcggggaaaatttatttcgggagcaattttccctttaaaaatttgagaattcttacccggagagtgtgacataatttaaggcgcctctgcccaaagaggccatgtgcgtgaggggaataccgcgtttaattatcacaaa

SEQ ID NO: 15672 - DNA, 388 bp, Homo sapiens
ggcacgaggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattgcggaggaagt

SEQ ID NO: 15673 - DNA, 410 bp, Homo sapiens
  misc_feature 377, 378: n = A,T,C or G
ggcacgaggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctgnngatgtgaccaagcgccttctcattcagaaaaa

SEQ ID NO: 15674 - DNA, 229 bp, Homo sapiens
ctaacaaaaaacactaaaaaaaaataaaagaaattaattgaaactgacctaactcgtggcagggggaactcggctataagacccacaaaccctgctgactcataacaaactgagttgtaagacattcatcgccgcgatatccttgagtaaagaatgaactctggaagcccacccacggacaatgcaccttcacaaagattctgcactaatctgagtgaaggtctttggt

SEQ ID NO: 15675 - DNA, 380 bp, Homo sapiens
  misc_feature 150, 151, 152, 153, 154, 155, 156, 157, 158, 159, 160, 161,162, 163, 164, 165, 275, 276, 277, 278, 279, 280, 281, 282,283, 284, 285, 286, 287, 288, 289, 290, 291, 292, 293, 294,295, 296, 297, 298, 299, 300, 301, 302, 303, 304, 305: n = A,T,C or G
  misc_feature 306, 307, 308, 309, 310, 311, 312, 313, 314, 315, 316, 317,318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352: n = A,T,C or G
  misc_feature 353, 354, 355, 356, 357, 358, 359, 360, 361, 362, 363, 364,365, 366, 367, 368, 369, 370, 371, 372, 373, 374, 375, 376,377, 378, 379, 380: n = A,T,C or G
ggcacgagagtagttgggaaatcttttataaatccacctattactacctattggtaggggagattaaatttctacaggtatggagagtcggcttgactacactgtgtggagcaagttttaaagaagcaaaggtatagcagttccaagtannnnnnnnnnnnnnnnagaccaaactctagatcttgcccaaaatggacggccgcggcatttaaatgaagaaagatttatttttccttttttcttttaagaaaaatttttttaaaaaattttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15676 - DNA, 317 bp, Homo sapiens
  misc_feature 271, 272, 273, 274, 275, 276, 277, 278, 279, 280, 281: n = A,T,C or G
cacacacacacatccactctctctttttgctctcttctcacacacacatatctcccttactcacacactctctctcacacaccccctctttcttttcccccgcactttctttctctcacgcgcgcgcgcactcactctcttttttcttctctctctcactctctctctccgcgcgctctctcacacgctttatatctctctctctgagggacttctctctcctctcactcttatttttttgttgtgttttatagcgtctctctcttccctnnnnnnnnnnntctatatatacagagagagatctctctgctctctcc

SEQ ID NO: 15677 - DNA, 391 bp, Homo sapiens
ggcacgagagaattagctgaaacccaccaagagctgcatagagcacgtttagctagagtaggagtttgcagtgctcatatgggaaatgctgctgctatacttttaggaatttctgagtgcaatttagaaacatctagcacacttgaaacactgcgtatcattttcctcactcatgaatatagtcatcagaattcataaatagtttacctgagccctttaacaacctcaaataggccatatttctctctctggttgatggcatggaccctacaggaaaaaccacaccttaccgcttctgaccagcatcactacaaaaaggagtgctgaagccaatcaccatgtaagcaagataaaagcaaagggggtcttgcctgcccatctctgttccata

SEQ ID NO: 15678 - DNA, 280 bp, Homo sapiens
  misc_feature 113, 114, 115, 116, 117, 118, 119, 120, 121, 122, 123, 128,129, 130, 131, 132, 133, 134, 135, 136, 137, 138, 139, 140,141, 142, 143, 144, 145, 146, 147, 148, 149, 150, 153, 154,155, 156, 157, 158, 159, 160, 161, 162, 163, 164, 165: n = A,T,C or G
  misc_feature 166, 167, 200, 201, 202, 203, 204, 205, 206, 207, 208, 209,210, 211, 212, 259, 260, 261, 262, 263, 264, 265, 266, 267,268, 269, 270, 271: n = A,T,C or G
tgtgcgcgcccccccggggcgctctctctctacactcgtgcgctcccccctctgtctgtctctctctctagagtcacggtctcctacacggcgcgcacatgcgaggggcactnnnnnnnnnnngctcnnnnnnnnnnnnnnnnnnnnnnncgnnnnnnnnnnnnnnntcccttgtatactctctgtgtgcgcggggacannnnnnnnnnnnngtgcgcgcgcgagagcgcgcgcgccacacaagagagagcgcgccctnnnnnnnnnnnnnaccgcgaac

SEQ ID NO: 15679 - DNA, 311 bp, Homo sapiens
cgcttttttgggaacccaaaccttttttggctggccggaaaaaatttccacgggaagggtaaaggggtttattaatttttttggcaaaacaggggttaagaaaccttccctcccggcctaagggtgggctaggctttggaaaggctaaaagggggaaatttctggcccttgttccaagggaaacatgggctagggggaaaccccaccccttcagggccctttaaaagggcccccaaaaaaagaacccctttattaagggttaaaaaaggttaaaaaaggtgggaacctcatgggccaaggcaaatttttgt

SEQ ID NO: 15680 - DNA, 387 bp, Homo sapiens
  misc_feature 82, 83, 84, 85, 86, 87, 88, 89, 90, 91, 92, 93, 147, 148,149, 150, 151, 152, 153, 154, 155, 156: n = A,T,C or G
ggcacgaggtcttttctgcccacatctcacacaattgaggtgtctgaacaagcttggggagggtctataaggggtaggctcnnnnnnnnnnnncccatttggaaagggcgttttgccaacccaagggcttttttaagccgatttttnnnnnnnnnnccggacttggtaattggcttttggctttttaaagcccaaaaaataataattaaggggcccaaaataaggaagggcaaaaaaagcctttactccccctgcctttcaaaaagaaaaggaaaaaccggcccccccttaataattggcacccctaaaaaaaggggttttaaaaaaagccaaaaacaaaagggcctggaaaaaaattttgactttttttaacccggaacctgggaa

SEQ ID NO: 15681 - DNA, 273 bp, Homo sapiens
  misc_feature 273: n = A,T,C or G
ctgtctctctctctccccccctctccctcccgcgcgcgcacgctctttcatctctctctctacagacaggggggggtgttctctctccctctcgagagggaccgctttttttttctccccctctctcacactcggggtgtgcgcgctccctttgggggcttttctatagggcgcgctctaaagaaagcccgcctttctcctctgggtgcctcctcccacacccgggttttctcccccgctgtttttgaagaaactcctcctggtctccttatn

SEQ ID NO: 15682 - DNA, 283 bp, Homo sapiens
  misc_feature 255, 256, 257, 258, 259, 260, 261, 262, 263, 264, 265, 266,267, 268, 269, 270: n = A,T,C or G
ctctctctctggccccccccctctctttacacacactttctctcctctctctcgctctctctttttttttctctctcccctcgctctctctgtgtgtctctatctcgtgtctctctctgcgtgtccctcacacacactcgcgcgagagatctctctctatatctctcctttgtctgtgtctctctctcgcgcgcccacacatctatatatttttgcgcgcacacgcgagagtgtgtccctctctctctctgcacnnnnnnnnnnnnnnnncacaccctccccc

SEQ ID NO: 15683 - DNA, 392 bp, Homo sapiens
  misc_feature 246, 247, 248, 249, 250, 251, 252, 253, 254, 255, 256, 257,258, 351, 352, 353, 354, 355, 356, 357, 358, 359, 360: n = A,T,C or G
ggcacgagatgactccttccttaaaatccagctcaaatctccccccttttggtggctttctctgacactccatcataaagctaattgtttaagtatgatccagtggcacagtttattcctacttcataacttttatctcactatgttgtaagatattaggtatgtttcttctactaccagtaattttcaaagagttaaggaagaaggatagaagacagcagtataggtgaatgtgtgcatgtgttnnnnnnnnnnnnngccatattggccaaaatttttggactggctggtaaaacaaaggcttttcaaattttcaaatacctttaaaaaaaacctggaaattgttttgtnnnnnnnnnncgcccaaaaaaaaattttgggcctggggggga

SEQ ID NO: 15684 - DNA, 385 bp, Homo sapiens
ggcacgaggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggcgtgagtgtgtgagcaacagtaccccattccagtcgtttcctgctgtgactaagtcagcaacacagttcctctgacatgggccttggctgtgcttctttgggggtgaagagattgctgaggc

SEQ ID NO: 15685 - DNA, 383 bp, Homo sapiens
gaaggcttgcggagagaaaaccctggagccatcttcataggaagaggaaaggaaactgtatgacaggagaatgaatcaagtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgt

SEQ ID NO: 15686 - DNA, 313 bp, Homo sapiens
ctctcccccgcgctcttgagatatgcgcgccccttttttcttctacacgggggggggcgcgcctctttttctcgcgcgcccccctctctctcttttgtgcgcacgcgcgcgcgcgggggggttctttttttgtgcggagagagagtctgtctcaggggtttttttgttttctttcacgacacacactttctcccctgtgcatgtgttttgatgctctctcgagatatgtctctctctctctgtgtgtgtgtgttgtgcgccccccctggggagagcgctcttctctctctcctcatatagcgcgcgcgcgcga

SEQ ID NO: 15687 - DNA, 396 bp, Homo sapiens
ggcacgaggggacccccttcacctctgtctagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgcg

SEQ ID NO: 15688 - DNA, 310 bp, Homo sapiens
  misc_feature 257, 258, 259, 260, 261, 262, 263, 264, 265, 266, 267, 268,269, 270, 271: n = A,T,C or G
tgaatatcagggccctgaacatctctcacgcccgtcttctaaaagagaagaaaaaaacgcgcgcgggctttttctctctctcagaggggtgaaacacacaatatctcggggggccgggggagagcccgctctctctgcctgtaaaacacacagaagtgcgctcacgccctgcgcgggagcccacagacttttttttaaaacaaaaagtatattggggtgtgttttaatctccctctccgctcctagagggggggcgnnnnnnnnnnnnnnntttttaaataggggggcccgagtctcacccaatagaagg

SEQ ID NO: 15689 - DNA, 375 bp, Homo sapiens
ggcacgagccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaa

SEQ ID NO: 15690 - DNA, 477 bp, Homo sapiens
  misc_feature 14, 207, 208, 209, 210, 211, 212, 213, 214, 215, 216, 217,218, 219, 220, 221, 222, 223, 224, 225, 226, 227, 228, 229,230, 231, 232, 233, 234, 235, 236, 237, 238, 239, 240, 241,242, 243, 244, 245, 246, 247, 248, 249, 250, 251, 252: n = A,T,C or G
  misc_feature 253, 254, 255, 256, 257, 258, 259, 260, 261, 262, 263, 264,265, 266, 267, 268, 269, 270, 271, 272, 273, 274, 275, 276,277, 278, 279, 280, 281, 282, 283, 284, 285, 286, 287, 288,289, 290, 291, 292, 293, 294, 295, 296, 297, 298, 299: n = A,T,C or G
  misc_feature 300, 301, 302, 303, 304, 305, 306, 307, 308, 309, 310, 311,312, 313, 314, 315, 316, 317, 318, 319, 320, 321, 322, 323,324, 325, 326, 327, 328, 329, 330, 331, 332, 333, 334, 335,336, 337, 425, 426, 427, 428, 429, 430, 431, 432, 433: n = A,T,C or G
  misc_feature 434, 435, 436, 437, 438, 439, 440, 441, 442, 443, 444, 445,446, 447, 448: n = A,T,C or G
gctccttcttcttnttgttgatcccatcgatccgaattcggcacgagagcacctctgtgcctctctgagagcactcacagccaaaagtacacagctgcccccaggctgagagtgcttgatacacccttgaatcccctcttatatgatgccccagcccaggagagataaaagcatcagcaccatgagattcacctgcctctggtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcttagacagcaaaaatgctttctcccagtcttgttcccttgttctcagttcccaccctgcctggataactactgttcttggtttnnnnnnnnnnnnnnnnnnnnnnnnagtctcgtaccagattcataaatcagccg

SEQ ID NO: 15691 - DNA, 265 bp, Homo sapiens
cgcgcgggggggacccctctctctctctctgttgcgcgcgctctctcaccccgtgtgtcgcccccgatattgtcagagagaccccctatttttttctcccgccccacacacatctatgtgtaaaatgtgcgtgtctgtcgcgcacacccacacactctccccggggggtttataaaatactcgcgcgctatattttcgcccccctttttgtgtgtgggcgccacaaaaacaccacacgctctcccccctgtctctcgcgggtgtt

SEQ ID NO: 15692 - DNA, 388 bp, Homo sapiens
  misc_feature 388: n = A,T,C or G
ggcacgagggaggctctttgttatagatgcttttgcccccttaatacagcaatgagagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactn

SEQ ID NO: 15693 - DNA, 431 bp, Homo sapiens
  misc_feature 386, 387, 388, 389, 390, 391, 392, 393, 394, 395, 396, 397,398, 399, 400, 401, 402, 403, 404, 405, 406, 407, 408, 409,410, 411, 412: n = A,T,C or G
ggcacgagagaggggctactttagatgcaaaggggacaattagaaggctactgaggtaatccggacaaaaagttgtaaataaatcacggtggcagtatggtgaatagtggaaggggtgtatttgaagaaactggggaggccgtgggagaggctggctagtgagaaatgggccgaaggtgaaagcagcttaggggctggtttccagttttctggcactgcagactgggtagtgggaggtggctttctcaagaggagaggtgagtgggaaggagcagggctgcaggggaggtcatggtcttgggagtggtgctcagtctgacttgcacataggggagattattttagatttccgcaagaaaatgtccagcatgtagtcatatcaatgnnnnnnnnnnnnnnnnnnnnnnnnnnntgagatttacccaaaaaga

SEQ ID NO: 15694 - DNA, 389 bp, Homo sapiens
ggcacgagccacccccaagagtgtggccatctggggccgtgtggtatttgccactcaggagacatgtccctatgacatagcagtggtgagcctggaggaggacctggatgatgtccccatccctgtgcccgctgagcacttccatgaaggcgaggctgtgagtgtggtgggctttggcgtctttggccagtcttgcgggccctcggtgacctcaggcatcctttccgctgtggtgcaggtgaatggcacgcccgtaatgctgcagaccacgtgtgctgtgcacagcggctccagtgggggacccctcttctccaaccactcaggaaacctccttggcataatcaccagcaacacccgggacaataatacgggggccacctacccccacc

SEQ ID NO: 15695 - DNA, 431 bp, Homo sapiens
ggacgaggctccagcgcacttttccaacacatcactgcattatttgaatgcaccatggcagctattgtcaccttacttgggagtgatccagttggagctctttatattcggacatgtcgagtattgatgctttctgactgggacacgatgctttacaacccaaggccagattacggtaccacagtgcactgtactcatgaagccggctacccactatataccatcgtatttatctattacgcattctgcttggtattaatgatgctgctccgacctcttctggtgaagaagaatgcatgtgggttagggaaatctgatcgatataaaagtatttatgctgcactttacttcttcccaaatgtaaccgtgcttcaggcagctgtgggaggccttttatattacgccttcccatacattatattagtggtatc

SEQ ID NO: 15696 - DNA, 393 bp, Homo sapiens
ggcacgagactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcg

SEQ ID NO: 15697 - DNA, 459 bp, Homo sapiens
  misc_feature 26, 27, 28, 31: n = A,T,C or G
gcaatcgcattgtctttttgaggatnnnatnaatgtcaattcggcacgagctttgtggatgtttccagctgccatcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccacgcctgagggacattctgaacacctgggagaaagacctcagaacccgatttatgactcac

SEQ ID NO: 15698 - DNA, 445 bp, Homo sapiens
  misc_feature 174, 175, 176, 177, 178, 179, 180, 181, 182, 183, 184, 185,186, 187, 188, 189, 190, 191, 192, 193, 194, 195, 196, 197,198, 199, 200, 201, 202, 203, 204, 205, 206, 207, 208, 209,210, 211, 212, 213, 214, 215, 216, 217, 218, 219, 220: n = A,T,C or G
  misc_feature 221, 222, 223, 224, 225, 226, 227, 228, 229, 230, 231, 232,233, 234, 235, 236, 237, 238, 239, 240, 241, 242, 243, 244,245, 246, 247, 248, 249, 250, 251, 252, 253, 254, 255, 256,257, 258, 259, 260, 261, 262, 263, 264, 265, 266, 267: n = A,T,C or G
  misc_feature 268, 269, 270, 271, 272, 273, 274, 275, 276, 277, 278, 279,280, 281, 282, 283, 284, 285, 286, 287, 288, 289, 290, 291,292, 293, 294, 295, 296, 297, 298, 299, 300, 301, 302, 303,304, 327: n = A,T,C or G
ggcacgagatggagagcacctctgtgcctctctgagagcactcacagccaaaagtacacagctgcccccaggctgagagtgcttgatacacccttgaatcccctcttatatgatgccccagcccaggagagataaaagcatcagcaccatgagattcacctgcctctggtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcttagacagcaaaaatgctnttctccagtctttgttccttggtctcaaggtccacccttgctggataactactggtcttgggttcctggggtaaagatggaacttgagtaagctcgacccaaatccaaaatcaatccg

SEQ ID NO: 15699 - DNA, 429 bp, Homo sapiens
  misc_feature 318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352, 353,354, 355, 356, 357, 358, 359, 360, 361, 362, 363, 364: n = A,T,C or G
  misc_feature 365, 366, 367, 368, 369, 370, 371, 372, 373, 374, 375, 376,377, 378, 379, 380, 381, 382, 383, 384, 385, 386, 387, 388,389, 390, 391, 392, 393, 394, 395, 396, 397, 398, 399, 400,401, 402, 403, 404, 405, 406, 407, 408, 409, 410, 411: n = A,T,C or G
  misc_feature 412, 413, 414, 415, 416, 417, 418, 419: n = A,T,C or G
ggcacgagcgcctgccctgcatcagggagacatgtcagctgaggagtaattgaccagatttctgctttagaaatatggcagtggaggcaggagatggcatctgaggcccaggctggggagaagggtgctgggatgagaacctggagttcagaccagggaagggatgagagcctaagaagaggagctctcaccctgagacaggctggtgcaggagtctgctcgatccaggcctgggtccctggttccctctgagcttgggaggactatgtgagacagaacaggaccaggggcctgcattcccccttgtattattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatggccc

SEQ ID NO: 15700 - DNA, 439 bp, Homo sapiens
  misc_feature 228, 233, 234, 235, 236, 237, 238, 239, 240, 241, 242, 243,244, 245, 246, 247: n = A,T,C or G
gttctgtgggaatagagggtccctggtgacagggcagggctagatctggagcctgcacttggcctgtgacatactgtcttgtttctgagaatcctcccctacttctctagttaatctccagagacttctgtgactacttaatcacaaaggaaattttcaggaatattatcaaatactattttagaaaaaaaaagagaagggatttgaatgttttcagttcagtttagntatcnnnnnnnnnnnnnnnccccaaacttcaaaatggaggcccccccctcctttaacccccctaaaaaaaattctgatgtttgaggtttggttgccaattaaccaaacccccaaaaaaaaagggggttaaaccccattggaaagttttcctaattttggggggtgccctttgaggtggacccggttccctgccctgggaaaggccccaaag

SEQ ID NO: 15701 - DNA, 440 bp, Homo sapiens
  misc_feature 427: n = A,T,C or G
ggcacgaggtgaagtcctggttccagactcccctttttgccgggacatgatggatctgtcagctggtgcctatagtcctagagagctagagatggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaatttttcatgcatgattgctagtaatgacaatcatgttatgtttgtttctgtagctttggaaatcactccttccacttgagtttcaggtcccaactgtccacacctgcaggagtgaggttttgctgagactgataaggcactcacattntgtgggagttgaa

SEQ ID NO: 15702 - DNA, 423 bp, Homo sapiens
  misc_feature 9, 10, 11, 12, 315, 316, 317, 318, 319, 320, 321, 322, 323,324, 325, 326, 327, 328, 329, 330, 331, 332, 333, 334, 335,336, 337, 338, 339, 340, 341, 342, 343, 344, 345, 346, 347,348, 349, 350, 351, 352, 353, 354, 355, 356, 357, 358: n = A,T,C or G
  misc_feature 359, 360, 361, 362, 363, 364, 365, 366, 367, 368, 369, 370,371, 372, 373, 374, 375, 376, 377, 378, 379, 380, 381, 382,383, 384, 385, 386, 387, 388, 389, 390, 391, 392, 393, 394,395, 396, 397, 398, 399, 400, 401, 402, 403, 404, 405: n = A,T,C or G
  misc_feature 406, 407, 408, 409, 410, 411, 412, 413, 414, 415, 416: n = A,T,C or G
acgagcgcnnnncctgcatcagggagacatgtcagctgaggagtaattgaccagatttctgctttagaaatatggcagtggaggcaggagatggcatctgaggcccaggctggggagaagggtgctgggatgagaacctggagttcagaccagggaagggatgagagcctaagaagaggagctctcaccctgagacaggctggtgcaggagtctgctcgatccaggcctgggtccctggttccctctgagcttgggaggactatgtgagacagaacaggaccaggggcctgcattcccccttgtattattcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatgg

SEQ ID NO: 15703 - DNA, 424 bp, Homo sapiens
  misc_feature 11, 22, 59: n = A,T,C or G
ggcttgtaganctcggaggttngcaagaatcgcattcggcacgagctgggacacagtgngctctcttatatttgttgctggaataaatgaatgaactaaggcagtcttgtagggatttactgttaaccaccatgggaaaattaaataaatgcggggaaggaaaacgttctaaaattagaagactactttctactctcagcttctgattccctctgagctaagaaccagacagccttaggctggtaactcctataagctggtcctcctcccatgctgaccccatctttactgtacaattcacttttcatggactgaaggcaccaccaagatagatccaggagtgacaactccagtgtaggtgtccactgttcccttaatctctgtcctgctccaagtataaataaatcggggccatttccttaga

SEQ ID NO: 15704 - DNA, 434 bp, Homo sapiens
  misc_feature 129, 130, 131, 132, 133, 134, 135, 136, 137, 138, 139, 140,141, 142, 143, 144, 145, 146, 147, 148, 149, 150, 151, 152,153, 154, 155, 156, 157, 158, 159, 160, 161, 162, 163, 164,165, 166, 167, 168, 169, 170, 171, 172, 173, 174, 175: n = A,T,C or G
  misc_feature 176, 177, 178, 179, 180, 181, 182, 183, 184, 185, 186, 187,188, 189, 190, 191, 192, 193, 194, 195, 196, 197, 198, 199,200, 201, 202, 203, 204, 205, 206, 207, 208, 209, 210, 211,212, 213, 214, 215, 216, 217, 218, 219, 220, 221, 222: n = A,T,C or G
  misc_feature 223, 224, 225, 226, 227, 228, 229, 230, 231, 232, 233, 234,235, 236, 237, 238, 239, 240, 241, 242, 243, 244, 245, 246,247, 248, 249, 250, 251, 252, 253, 254, 255, 256, 257, 258,259, 347, 348, 349, 350, 351, 352, 353, 354, 355, 356: n = A,T,C or G
  misc_feature 357, 358, 359, 360, 361, 362, 363, 364, 365, 366, 367, 368,369, 370: n = A,T,C or G
ggcacgaggtacacagctgcccccaggctgagagtgcttgatacacccttgaatcccctcttatatgatgccccagcccaggagagataaaagcatcagcaccatgagattcacctgcctctggtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcttagacagcaaaaatgctttctcccagtcttgttcccttgttctcagttcccaccctgcctggataactactgttcttggtttnnnnnnnnnnnnnnnnnnnnnnnnagtctcgtaccagattcaaaaatcagtcaactacttcaaaaacaatgacatgctggctacttaa

SEQ ID NO: 15705 - DNA, 428 bp, Homo sapiens
ggcacgagctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgactttgc

SEQ ID NO: 15706 - DNA, 429 bp, Homo sapiens
  misc_feature 429: n = A,T,C or G
ggcacgagtggagagcacctctgtgcctctctgagagcactcacagccaaaagtacacagctgcccccaggctgagagtgcttgatacacccttgaatcccctcttatatgatgccccagcccaggagagataaaagcatcagcaccatgagattcacctgcctctggtcgttagggaacaatggaggcctgcgatttggagttaaactctcagtgatctctgtgttgacaacaccaaagctagaggaatccagtaggatgtgggcatggttttcccggaaggctgactgagcagttctgcaaatgtttgcaagtacagggcagaatttcatccagcctcagaaccttgagccaagactcagcatcagcaaagccaaaagtttcattttcttgactgtgggagtgctagtcccaacctttagatggccn

SEQ ID NO: 15707 - DNA, 430 bp, Homo sapiens
actctgcaaacagctacttgtgctgattgcaggagacccataaattcgaacgaggaacaaccgagacctgaaggggctgacgaacgcgatttctgataagtatggggtccctgaagagaacatttaccaagcctacaataaatgcacgcgaggaatcttatgcaacatggacaacaacatcattcagcattacagcaaccacgtcgccttcctgctggacatggcggagctggacggcaaaattcagatcatccttaaggagctggaaggcctctcgagcatacaaaccctcacgacctgcatggggccagcagggacgtggccccacgccacacacaacctctccacatgcctcaacgctgttacttgaatgccttccctgagggaagaggcccttgagtcacagacccacagacgtcaggaccatggg

SEQ ID NO: 15708 - DNA, 437 bp, Homo sapiens
  misc_feature 437: n = A,T,C or G
ggcacgaggcgccctctgcccccctcagagggtctctcctctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactgggcan

SEQ ID NO: 15709 - DNA, 432 bp, Homo sapiens
  misc_feature 3, 4: n = A,T,C or G
ggnncagtgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccaggtccggaagatcggggtgtttagctgtggcccccctggcatgaccaagaatgtggaaaaggcctgtcagctcatcaacaggcaggaccggactcacttctcccaccattatgagaacttctaggccccttcccgggggttctgcccactgtccagttgagcagaggtttgagcccacacctcacctctgttcttcctatttctggctgcctcagccc

SEQ ID NO: 15710 - DNA, 436 bp, Homo sapiens
  misc_feature 432: n = A,T,C or G
ggcacgagccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaacccccccttgaacagctgaacattgtgctcatagactntggg

SEQ ID NO: 15711 - DNA, 300 bp, Homo sapiens
tctctctctctctctctcacagacacttttaccccatatatacacataaaatgtgtgcgcgagagagagagagccctctcgctctatatatatccccgcgggggggagataaaaatatatatccccacactttatagggcgggctcccccctctatcctgtgtgtagagagaaatatatatatatctgtggggggagagagagatctctcacccccccgcacacgcgagctctttcttaagatgtgtgagcgccccccccctgtttttgtaaaaaagagaggggtatatatattgggggg

SEQ ID NO: 15712 - DNA, 191 bp, Homo sapiens
caaaacaaaaccatgttcccactggtgatgcctgtctgacacgttttggtatttagtaggaaatgaagggtcttcaagcttcgagagaaccttcaaaattgtcacaattgctgaaaacagaatgaatcgggaacattatctcaatattttgcataatagacaacaccacagtgttttggttccctgacctg

SEQ ID NO: 15713 - DNA, 302 bp, Homo sapiens
  misc_feature 57, 58, 59, 60, 61, 62, 63, 64, 65, 66, 67, 68, 69, 70, 71,72, 73, 74, 75, 76, 77, 78, 79, 80, 81, 82, 87, 88, 89,90, 91, 92, 93, 94, 95, 96: n = A,T,C or G
gcccgggcgtgtgtgtatgtgtgtacacgcccccgtgggctctctgtcgcatcttgnnnnnnnnnnnnnnnnnnnnnnnnnntgtannnnnnnnnncacatagcgcgcgcgctcgcgcgcacggagctatagagacaccactctctctctgagatacacgcgcgcgcacacactctgcgcgcgcgcgctcttctttgtctcgcgcgcgcgcccgctatgtggagggtatatgtgggggaaaatagcgaggtgtgcgcgcacccgcgcacgcgcgctctatatctctatatcttcagcgcgcg

SEQ ID NO: 15714 - DNA, 411 bp, Homo sapiens
ggcacgaggcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttg

SEQ ID NO: 15715 - DNA, 408 bp, Homo sapiens
ggcacgaggcacacaaagccaagggcataccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcatcacaccactgagtcctctaactaatcatatgtgctcagacacagctcaagcacaccccttagttaagagagaacctccatatacattaatttttttc

SEQ ID NO: 15716 - DNA, 407 bp, Homo sapiens
  misc_feature 236, 237, 238, 239, 240, 241, 242, 243, 244, 245, 246, 247,248, 249, 250, 251: n = A,T,C or G
agagaaacatccactcgaattcggcacgaggacagggcagggctagatcttttttctgcacttggcctgtgacatactgtctggtgtctgagaatcctcccctacttctctagttaatctccagagacttctgtgactacttaatcacaaaggaaattttcaggaatattatcaaatactattttagaaaaaaaaagagaagggatttgaatgttttcagttcagtttagttatcnnnnnnnnnnnnnnnncccaaactcaagtatggaggcccccccctctttaaacccaccaaaaaaattttttggggttcagggtgggttggccaactacccaaacccccaaagaaaatgggggttaacccccttgaaaaagttttcttactttggggggctgcccttgagccg

SEQ ID NO: 15717 - DNA, 312 bp, Homo sapiens
ccccgggggcgctctctttttttttccccccaagtgagagagccccgcgcgcgtctctctctcgcattttttcgacaccccccttgtgtggggcggggcgcgcgtctgtgtgtgatacacagaatgtgcgtggtgtgtctgagagacactcttcgcgcttgtgtgtgagacacgagactttctctttttagggggcggggggggagttttatgtgtgccacatgttttctgtgtataaaaagagcgcacagagtgttttttatatctgtgagagagacctctctgtatatatacacgctcagaggggagagg

SEQ ID NO: 15718 - DNA, 420 bp, Homo sapiens
  misc_feature 8, 9, 10, 11, 12: n = A,T,C or G
acgagggnnnnnaagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagc

SEQ ID NO: 15719 - DNA, 394 bp, Homo sapiens
  misc_feature 40, 41, 42, 43, 44, 45, 46, 47, 48, 49, 50, 51, 52, 53, 54,55, 56, 57, 58, 59, 67, 68, 69, 70, 71, 72, 73, 74, 75,76, 77, 193, 194, 195, 196, 197, 198, 199, 200, 201, 202,325, 326, 327, 328, 329, 330, 331, 332, 333, 334, 335, 336: n = A,T,C or G
  misc_feature 337, 338, 339, 340, 341, 342, 343, 344: n = A,T,C or G
ggcacgaggtgtggatgacagagcgagaccctgcctcatnnnnnnnnnnnnnnnnnnnncccccccnnnnnnnnnnnaaaaacccggttgggccccggctgttctttagggccctaaaaattgccccaaaaaaaattggccgggccctaaaaaaaccccggttttttggggagaattcaaaaaagggtcggtnnnnnnnnnntttttaaacttccaaccggcctcagggggaaaaaacctggaaaactcaatgggggttggaacaaaatcaatatttggtcctaccggaaagcgttaagattttaaaccagtaaaaatggccaannnnnnnnnnnnnnnnnnnnaacagggcccccggggtaagggctaaaaattttcagatttgaaccttttt

SEQ ID NO: 15720 - DNA, 390 bp, Homo sapiens
ggcacgagattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgagggggggcagggggtggtcaattcaaacccaacccccgctcg

SEQ ID NO: 15721 - DNA, 280 bp, Homo sapiens
  misc_feature 34, 35, 36, 37, 38, 39, 40, 41, 42, 43, 58, 59, 60, 61, 62,63, 64, 65, 66, 67, 68, 69, 70, 190, 191, 192, 193, 194,195, 196, 197, 198, 199, 215, 216, 217, 218, 219, 220, 221,222, 223, 224, 225, 226: n = A,T,C or G
tctctctctctctctgcgcccacacctctctcannnnnnnnnngcacgtgtatatctnnnnnnnnnnnnnttttttttagagagacatctcgcgcgtgtctctctttttcccgcccgccgctcttttctcgcgcgcgcgcgcaccccccctgtgtggggcgcgcgctctctttttttttgtgcgcgcgannnnnnnnnntctctctctgtggcgnnnnnnnnnnnntctcttattttatattttggggggcggggggcctcccctcccccctgtgtgcct

SEQ ID NO: 15722 - DNA, 398 bp, Homo sapiens
  misc_feature 125, 126, 127, 128, 129, 130, 131, 132, 133, 134, 135, 136,137, 138, 161, 162, 163, 164, 165, 166, 167, 168, 169, 170,171, 172, 173, 247, 248, 249, 250, 251, 252, 253, 254, 255,256, 257, 258, 362, 363, 364, 365, 366, 367, 368, 369: n = A,T,C or G
  misc_feature 370, 371, 372, 373, 374, 375, 376: n = A,T,C or G
ggcacgaggtccacctcagctcagcaatctcatgccggttggcaattagtcagcataagccgatgcctgcccatcagttctttactctgaggtgttagagtggaataaaaatataaatacttacnnnnnnnnnnnnnncaatacccaaccccctcccattnnnnnnnnnnnnngcccgcccccctaaaattcatggagaggcctatttcgtagccagccactatataaaccctgctggttgggcggnnnnnnnnnnnngtgaaggggggaaaaaaaagcctttttttgaaaaaattagtcattttttgctttttttggacacattttgcgggacaaagaaccctgtaaaacccccctattcnnnnnnnnnnnnnnnaacctcaacgaggggggggcgg

SEQ ID NO: 15723 - DNA, 386 bp, Homo sapiens
ggcacgagattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgagggggggcaggggggggtcaagtccaggcccacccccg

SEQ ID NO: 15724 - DNA, 202 bp, Homo sapiens
cactttttctatatgaatatcttggccgtatcatagactcaaaaaagaaattatgcaagttctttctgcccccacctgcgccaggggagaagtttaccttcgggaactccagagttaaagcagttgtggtgataattttttatgctgaacacaccacgatataaaaaacaacattcacgtgctttatttttgttatgtgttt

SEQ ID NO: 15725 - DNA, 394 bp, Homo sapiens
ggcacgagtctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaa

SEQ ID NO: 15726 - DNA, 246 bp, Homo sapiens
  misc_feature 78, 246: n = A,T,C or G
cccctccttttttaggcctgaatacaaagtagaagatcactttccttcactgtgctgagaatttctagatactacagntcttactcctctcttccctttgttattcagggtgaccaggatggcgggaggggatctgtgtcactgtaggtactgtgcccaggaaggctgggtgaagtgaccatctaaattgcaggatggtgaaattatccccatctgtcctaatgggcttacctcctctttgccttn

SEQ ID NO: 15727 - DNA, 395 bp, Homo sapiens
  misc_feature 39, 40, 41, 42, 43, 44, 45, 46, 47, 48, 49, 50, 51, 52, 53,54, 55, 56, 57, 58, 59, 60, 61, 62, 63, 64, 65, 66, 67,68, 69, 70, 71, 72, 73, 74, 75, 76, 77, 78, 79, 80, 81,82, 83, 84, 85, 86, 87, 88, 89, 90, 91, 92, 93, 94, 95,96: n = A,T,C or G
  misc_feature 97, 98, 99, 100, 101, 102, 103, 104, 105, 106, 107, 108,109, 110, 111, 112, 113, 114, 115, 116, 117, 118, 119, 120,121, 122, 123, 124, 125, 126, 127, 128, 129, 130, 131, 132,133, 134, 135, 136: n = A,T,C or G
ggcacgagcttgcttccctctcaccctctgcagtttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccatatcgtaaactgccttggaaccaattaccactaccagggagacaaactattgcttagaggatgctgacaggagcagcatgccaaaattggaagaaggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaaaggct

SEQ ID NO: 15728 - DNA, 387 bp, Homo sapiens
ggcacgaggcttgcggggcattatgactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatg

SEQ ID NO: 15729 - DNA, 401 bp, Homo sapiens
ggcacgagggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataaccaagtaatagatagtcatagaatcaa

SEQ ID NO: 15730 - DNA, 274 bp, Homo sapiens
  misc_feature 129, 130, 131, 132, 133, 134, 135, 136, 137, 138, 139, 140,141, 142, 143, 144, 145: n = A,T,C or G
cacgcacccgcctgtgtgtgtgcgcacacacgctccctctctctatagacagacacacactgcgcgctcgctctctcttttgtgtgcgctctccgtgctccccccctctctctcttttttctctatatnnnnnnnnnnnnnnnnntctgagagctcgcgcgctcagcgttctattcacacgcgcgttttttttatatatatattttgtgcgcgccggggggggcgcacacactctctcttttttgtgggttcgctgtccgcgtccctccttttg

SEQ ID NO: 15731 - DNA, 279 bp, Homo sapiens
  misc_feature 210, 211, 212, 213, 214, 215, 216, 217, 218, 219, 220, 221,222, 223, 224, 225, 226, 227, 228, 229, 230, 231, 232, 233,261, 262, 263, 264, 265, 266, 267, 268, 269, 270: n = A,T,C or G
cccttttttttatacacccccccttgtctgtctgttttgtgtgtctgccccccttctctcgttgtgatctccctctctcttttttctccccccgcgctctctctctcttgcggggaggctcacataccccctctctctctcttttttgaaccacacattccgtttctcttttttttatctctacccctctctcgtctgtaccccccacannnnnnnnnnnnnnnnnnnnnnnnagagtagagttgcgttccccactctccnnnnnnnnnngtggggtgc

SEQ ID NO: 15732 - DNA, 311 bp, Homo sapiens
caaaacaaaaattaaaaatgacccccctttaaaattttagggggtccatttttaaaaaccttaacagtttaaaggttcttggtcagtttggggaaccccaccttgagatgggagcaaaaaaggggatttttttccaacatagcgagcggtttagattttttttgtcccgttagagttgccctgtgcaccacgccaaaacctccagaggtcttctttttttacacaccctgtctgggggtgtttctcagaagattaacacagcgcctgggggtttaagggaggggtgacctccgcaggacattatggggctt

SEQ ID NO: 15733 - DNA, 386 bp, Homo sapiens
ggcacgagggaatctcaggcgtatcttatgagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgca

SEQ ID NO: 15734 - DNA, 396 bp, Homo sapiens
  misc_feature 396: n = A,T,C or G
ggcacgaggaggcagctgcctttgtttgccatggatgggtaggggctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctgggtgcagagtgagcccatgggacagccctctgaaattatactgcttacaaccatgctgagtctgcaaggan

SEQ ID NO: 15735 - DNA, 397 bp, Homo sapiens
ggcacgagtcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccaccta

SEQ ID NO: 15736 - DNA, 394 bp, Homo sapiens
ggcacgagccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatc

SEQ ID NO: 15737 - DNA, 389 bp, Homo sapiens
ggcacgaggaaagttaagcatctacaggttatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgtctaaaattgaaatcgccttacaatgtctgttctggagaaagacgaccactgtgaagcctttgtgaagaattttcatcaaggcatctgtagagatcagtgag

SEQ ID NO: 15738 - DNA, 396 bp, Homo sapiens
  misc_feature 396: n = A,T,C or G
ggcacgaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggan

SEQ ID NO: 15739 - DNA, 386 bp, Homo sapiens
ggcacgaggccacctgttgccctaacaccctgtctgactctctcccgctgcagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttca

SEQ ID NO: 15740 - DNA, 390 bp, Homo sapiens
ggcacgagctcagatccggggactgcggataaatggccttaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgg

SEQ ID NO: 15741 - DNA, 399 bp, Homo sapiens
ggcacgagaaatggccttaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaag

SEQ ID NO: 15742 - DNA, 386 bp, Homo sapiens
ggcacgagcaaaggctcgcagcggccagaaacccggctccgagcggcggcggcccggcttccgctgcccgtgagctaaggacggtccgctccctctatccagctccgaatcctgatccaggcgggggccaggggcccctcgcctcccctctgaggaccgaagatgagcttcctcttcagcagccgctcttctaaaacattcataccaaagaagaatatccctgatggatctcatcagtatgaactcttaaaacatgcagaagcaactctaggaagagggaatctgagacaagctgctatgttgcctgagggagaggatctcaatgaatggagtgctgcgaacacctggggattcttttaccagcaacaacatggtttttgggaact

SEQ ID NO: 15743 - DNA, 395 bp, Homo sapiens
ggcacgaggccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatga

SEQ ID NO: 15744 - DNA, 389 bp, Homo sapiens
ggcacgaggcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcgga

SEQ ID NO: 15745 - DNA, 365 bp, Homo sapiens
  misc_feature 224, 225, 226, 227, 228, 229, 230, 231, 232, 233, 234, 235,236, 237, 238, 239, 240, 241, 242, 243, 244, 245, 246, 247,248, 249, 250, 251, 252, 253, 254, 255, 256, 257, 258, 259,260, 261, 262, 263, 264, 265: n = A,T,C or G
ggcacgagaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaannnnnnnnnnnnnnnnnnnnnnnnnnnnnnnnnnnnnnnnnnaaaacaaagccccgttttgtccccaggctggataacaggggcggaatctgggttaattgaaccctttgcttttggggttaaggcaattttcctgcctcac

SEQ ID NO: 15746 - DNA, 376 bp, Homo sapiens
ggcacgagctggaaaccagcccctaagctgctttcaccttcggcccatttctcactagccagcctctcccacggcctccccagtttcttcaaatacaccccctccactattcaccatactgccaccgtgatttatttacaactttttgtccggattacctcagtagccttctaattgtcccctttgcatctaaagtagcccctctcatcccccaaatcttaccatgtcactcttctacataattctggctttccatgacccataaaccacatttctcaagtgtgctctatgctggcttgaatatgttaatgatcttaattctacttttagtgcaattttcttagagctggcatcactttcatcatgacgtgagaac

SEQ ID NO: 15747 - DNA, 384 bp, Homo sapiens
ggcacgagaggattgtgtgaaattgtgcaaatgcatgaatgtgggctgggatagtaaaagggagggccccggagcagcccacctggggtcctatctagtagacgcgcccggtgcccacccattgctgtgatgccagcagcccactgcaagcatcctcttcctttccaaggttctgtctggtacatgaataggtgtggcaggggtgggggctcctgaagaccaactaggggtactagggaccttagactcttgcgagagcctgcaccccatatcaggtggggtcaatagataaatacccctgcctccttgccccttagttctggtgtggtgggcaagtcagaggaactgttcttctcacactttcacgtgctctcggtggagatc

SEQ ID NO: 15748 - DNA, 383 bp, Homo sapiens
ggcacgagcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacaactggggatttctttaccaggatcacaatggtaatatggg

SEQ ID NO: 15749 - DNA, 358 bp, Homo sapiens
ggcacgagcagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaaactccccagggtctctccaacttagccaagacaattgggcaggttttggctcgaatgcacgatgaagacctcattcatggtgatctcaccacctccaacatgc

SEQ ID NO: 15750 - DNA, 338 bp, Homo sapiens
aagatggctgagagggacagaatgctttattttggagagaaacaatgttctaggtcaaactgagtctaccaaatgcacactttcacaatgggtctagaagaaatctggacaagtcttttcatgtggtttttctacgcattgattacatgtttgctcacagatgaagtggccattctgcctgcccctcagaacctctctgtactctcaaccaacatgaagcatctcttgatgtggagcccagtgatcgcgcctggagagacagtgtactattctgtcgaataccagggggagtacgagagcctgtacacgagccacatctggattcccagcagctggtg

SEQ ID NO: 15751 - DNA, 475 bp, Homo sapiens
  misc_feature 45, 46, 47, 48, 49, 50, 51, 52, 53, 54, 55, 56, 57, 58, 59,60, 61, 62, 63, 64, 65, 66, 67, 68, 69, 70, 71, 72, 73,74, 75, 76, 77, 78, 79, 80, 81, 82, 83, 84, 85, 86, 87,88, 89, 90, 91, 92, 93, 94, 95, 96, 97, 98, 99, 100, 101,102: n = A,T,C or G
  misc_feature 103, 104, 105, 106, 107, 108, 109, 110, 111, 112, 113, 114,115, 116, 117, 118, 119, 120, 121, 122, 123, 124, 125, 126,127, 128, 129, 283, 284, 285, 286, 287, 288, 289, 290, 291,292, 293, 424, 425, 426, 427, 428, 429, 430, 431, 432: n = A,T,C or G
  misc_feature 433, 434: n = A,T,C or G
gtcgctcaataggcaggagtccatcgattcgaattcggcacgagnnnnnnnnnnnnnnnnnnnnnnnnnnnnnnnnnnnnnnnnnnnnnnnnnnnnnnnnnnnnnnnnnnnnnnnnnnnnnnnnnnnnncgctccactgtgcactcctgacacatactttccccgctacactctctattctccccctcttgtgttctctctctatagcggtagatagagaggcctgtgtgtagataataaacgtgtgtgtgtgtgtaagaaaggagacacaaacacgcccacnnnnnnnnnnnttggggcctttttttcttttgagccctttggggaaaaaacccggggaaaacagcccatacccactatttggggcgcgccaaaaaaccttctttaaaaaaaatgtgttaaatgttaaattttttaggaacannnnnnnnnnngcaaaaaatagcaccccaaaagcaggggttttacatttttg

SEQ ID NO: 15752 - DNA, 467 bp, Homo sapiens
gagcgattttctgcaggattctatcgattcgaattcggcacgagccatggtctcagtgagggctggaatttacagagaagtttggccagggggtccaccatgctgccagtcagtttgggaaggaaacagagaagctcggccatggggtccaccatggggttaatgaggcctggaaggaagcagagaagtttggccagggtgtccaccatgctgcctcgcaggtggggaaggaggaagacagagtggtccaaggcctccatcatggcgttagtcaggctggaagggaggcggggcagtttggccacgacattcaccacacagcagggcaggctgggaaagagggagacatagcagttcatggtgtccaacctggggtccacgaggccgggaaggaggcagggcaatttggccagggagttcaccatacccttgaacaggccgggaaggaagcaaacaaagcggtccag

SEQ ID NO: 15753 - DNA, 449 bp, Homo sapiens
  misc_feature 15, 18, 19, 22, 24, 25, 28, 99: n = A,T,C or G
cggggtgggaaaccngannttnannaancggacggattctcccgttccgaatagccttttacagaagattcttcacagctatgtgcctgaagagatcanggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctgggcaatcaatacagcatccaggtacaggtggaagatctgactg

SEQ ID NO: 15754 - DNA, 439 bp, Homo sapiens
  misc_feature 120, 121, 122, 123, 124, 125, 126, 127, 128, 129, 130, 131,132, 133, 134, 135, 136, 137, 138, 139, 140, 141, 142, 143,144, 145, 146, 147, 148, 149, 150, 151, 152, 153, 154, 155,156, 157, 158, 159, 160, 161, 162, 163, 164, 165, 166: n = A,T,C or G
  misc_feature 167, 168, 169, 170, 171, 172, 173, 174, 175, 176, 177, 178,179, 180, 181, 182, 183, 184, 185, 186, 187, 188, 189, 190,191, 192, 193, 194, 195, 196, 197, 198, 199, 200, 201, 202,203, 204, 205, 206, 207, 208, 209, 210, 211, 212, 213: n = A,T,C or G
  misc_feature 214, 215, 216, 217, 218, 219, 220, 221, 222, 223, 224, 225,226, 227, 228, 229, 230, 231, 232, 233, 234, 235, 236, 237,238, 239, 240, 241, 242, 243, 244, 245, 246, 247, 248, 249,250, 338, 339, 340, 341, 342, 343, 344, 345, 346, 347: n = A,T,C or G
  misc_feature 348, 349, 350, 351, 352, 353, 354, 355, 356, 357, 358, 359,360, 361: n = A,T,C or G
gtagtgtatgtgcagcctcccatcgattcgaattcggcacgagatcccctcttatatgatgccccagcccaggagagataaaagcatcagcaccatgagattcacctgcctctggtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcttagacagcaaaaatgctttctcccagtcttgttcccttgttctcagttcccaccctgcctggataactactgttcttggtttnnnnnnnnnnnnnnnnnnnnnnnnagtctcgtaccagattcaaaaatcagtcaactacttcaaaaacaatgacatgctggctacttagatagaagaggaggc

SEQ ID NO: 15755 - DNA, 436 bp, Homo sapiens
  misc_feature 436: n = A,T,C or G
ggcacgagcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatgatcttttcaatctgcctcacgacagaccctatttcaaaaggtctaatgcttatcactttccagatgn

SEQ ID NO: 15756 - DNA, 437 bp, Homo sapiens
  misc_feature 437: n = A,T,C or G
ggcacgagagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcan

SEQ ID NO: 15757 - DNA, 437 bp, Homo sapiens
ggcacgagcttcagtcttatgtcatttactctttaggacaacctcttgaaaaactaaatcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaaaccttgtgaaagaagaaaagataactgaat

SEQ ID NO: 15758 - DNA, 427 bp, Homo sapiens
  misc_feature 13: n = A,T,C or G
aacggctcttctncttttgaggagcccatcgagtcgaattcggcacgaggcgagtctctgggtcgcgacgggaaggagtgaaacacctctctgcgcctgcgcgctccgtgcctgcgaagcaaacccggcctcaccttttcctgcccgaagcagaagattctcgcaggcctggtttctccctccagaagaccccccacccaaatcctctgtagctcctgggagtgccctgacccctgctgccaccgtccttcagagagcaacggaagagcttcccggagggcgaggaaaagagggaaagtagccagcaatgtcgaacgcagtgtataataagatgtggcatcagacccaagaagccctcggtgctttactcgatgaagagcctcagacgatgattgaaccacacagaaatcaggttttcatctttcaa

SEQ ID NO: 15759 - DNA, 429 bp, Homo sapiens
  misc_feature 427: n = A,T,C or G
gtgacgatcccatcattcaattcggcacgagctcacagccaaagttccttctgcccccaggctgagagtgcttgatacacccttgaatcccctcttatatgatgccccagcccaggagagataaaagcatcagcaccatgagattcacctgcctctggtcgttagggaacaatggaggcctgcgatttggagttaaactctcagtgatctctgtgttgacaacaccaaagctagaggaatccagtaggatgtgggcatggttttcccggaaggctgactgagcagttctgcaaatgtttgcaagtacagggcagaatttcatccagcctcagaaccttgagccaagactcagcatcagcaaagccaaaagtttcatttcttcgactgtgggagtgctagtcccaacctttagatggccattcagttnta

SEQ ID NO: 15760 - DNA, 421 bp, Homo sapiens
  misc_feature 218, 219, 220, 221, 222, 223, 224, 225, 226, 227, 228, 229,230, 231, 232, 233, 234, 235, 236, 237, 238, 239, 240, 241,242, 243, 244, 245, 246, 247, 248, 249, 250, 251, 252, 253,254, 255, 256, 257, 258, 259, 260, 261, 262, 263, 264: n = A,T,C or G
  misc_feature 265, 266, 267, 268, 269, 270, 271, 272, 273, 274, 275, 276,277, 278, 279, 280, 281, 282, 283, 284, 285, 286, 287, 288,289, 290, 291, 292, 293, 294, 295, 296, 297, 298, 299, 300,301, 302, 303, 304, 305, 306, 307, 308, 309, 310: n = A,T,C or G
ggcacgagattatttacttggtgtgtggtcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctctgtctccaaagcctgtacttcattcaggacactttcccccacatttagaaaagctgtaattatcttccagtgagacagcatagcacatgtgatcactgtcccttc

SEQ ID NO: 15761 - DNA, 421 bp, Homo sapiens
ggcacgagatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtctaaaattgaaatcgccttacaatgtctgttctgga

SEQ ID NO: 15762 - DNA, 418 bp, Homo sapiens
  misc_feature 268, 269, 270, 271, 272, 273, 274, 275, 276, 277, 278, 279,280, 281, 282, 283, 284, 285, 286, 287, 288, 289, 290, 291,292, 293, 294, 295, 296, 297, 298, 299, 300, 301, 302, 303,304, 305, 306, 307, 308, 309, 310, 311, 312, 313, 314: n = A,T,C or G
  misc_feature 315, 316, 317, 318, 319, 320, 321, 322, 323, 324, 325, 326,327, 328, 329, 330, 331, 332, 333, 334, 335, 336, 337, 338,339, 340, 341, 342, 343, 344, 345, 346, 347, 348, 349, 350,351, 352, 353, 354, 355, 356, 357, 358, 359, 360, 361: n = A,T,C or G
  misc_feature 362, 363, 364, 365, 366, 367, 368, 369, 370, 371, 372, 373,374, 375, 376, 377, 378, 379, 380, 381, 382, 383, 384, 385,386, 387, 388, 389, 390, 391, 392, 393, 394, 395, 396, 397,398, 399, 400, 401, 402, 403, 404, 405, 406, 407, 408: n = A,T,C or G
  misc_feature 409, 410, 411, 412, 413, 414, 415, 416, 417: n = A,T,C or G
tggatccatcgattcaattcggcacgaggttatttttaagaacttttgcttactatattggatttacctgcggtgtgagtagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15763 - DNA, 418 bp, Homo sapiens
atgctacattgctactttgttgcattgatcgccagacgaccactagattcgaaactgagcgcgagatgatgaatctgtgtgttatgaaaatgcatgctaccagtataaaatgacattctctattaataacatctgcggtgcgacacacataattgtcccaatttttaatattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggg

SEQ ID NO: 15764 - DNA, 417 bp, Homo sapiens
  misc_feature 202, 203, 204, 205, 206, 207, 208, 209, 210, 211, 212, 213,214, 215, 216, 217, 218, 219, 220, 221, 222, 223, 224, 225,226, 227, 228, 229, 230, 231, 232, 233, 234, 235, 236, 237,238, 239, 240, 241, 242, 243, 244, 245, 246, 247, 248: n = A,T,C or G
  misc_feature 249, 250, 251, 252, 253, 254, 255, 256, 257, 258, 259, 260,261, 262, 263, 264, 265, 266, 267, 268, 269, 270, 271, 272,273, 274, 275, 276, 277, 278, 279, 280, 281, 282, 283, 284,285, 286, 287, 288, 289, 290, 291, 292, 293, 294, 295: n = A,T,C or G
  misc_feature 296, 297, 298, 299, 300, 301, 302, 303, 304, 305, 306, 307,308, 309, 310, 311, 312, 313, 314, 315, 316, 317, 318, 319,320, 321, 322, 323, 324, 325, 326, 327, 328, 329, 330, 331,332, 333, 334, 335, 336, 337, 338, 339, 340, 341, 342: n = A,T,C or G
  misc_feature 343, 344, 345, 346, 347, 348, 349, 350, 351, 352, 353, 354,355, 356, 357, 358, 359, 360, 361, 362, 363, 364, 365, 366,367, 368, 369, 370, 371, 372, 373, 374, 375, 376, 377, 378,379, 380, 381, 382, 383, 384, 385, 386, 387, 388, 389: n = A,T,C or G
  misc_feature 390, 391, 392, 393, 394, 395, 396, 397, 398, 399, 400, 401,402, 403, 404, 405, 406, 407, 408, 409, 410, 411, 412, 413,414, 415, 416, 417: n = A,T,C or G
catcgattcgaattcggcacgaggccaagtggacaggccatagcccccacagactggagggacgcggctagggaatgtcccacagagtggccagttatccctgagagaaagagcaggttttagcggagactctgaggctgctttagaatatggtgggtgtgtggggcaaaagggacacccaggggtgtatcaagaggtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15765 - DNA, 416 bp, Homo sapiens
ggcacgagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatt

SEQ ID NO: 15766 - DNA, 417 bp, Homo sapiens
ggcacgagggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcaaggaggacaggttgactgtggtgagttccaggacaccaaggtctactgcactcgggaatctaacccacactgtggctctgat

SEQ ID NO: 15767 - DNA, 412 bp, Homo sapiens
  misc_feature 271, 272, 273, 274, 275, 276, 277, 278, 279, 280, 281, 282,283, 284, 285, 286, 287, 288, 289, 290, 291, 292, 293, 294,295, 296, 297, 298, 299, 300, 301, 302, 303, 304, 305, 306,307, 308, 309, 310, 311, 312, 313, 314, 315, 316, 317: n = A,T,C or G
  misc_feature 318, 319, 320, 321, 322, 323, 324, 325, 326, 327, 328, 329,330, 331, 332, 333, 334, 335, 336, 337, 338, 339, 340, 341,342, 343, 344, 345, 346, 347, 348, 349, 350, 351, 352, 353,354, 355, 356, 357, 358, 359, 360, 361, 362, 363, 364: n = A,T,C or G
  misc_feature 365, 366, 367, 368, 369, 370, 371, 372, 373, 374, 375, 376,377, 378, 379, 380, 381, 382, 383, 384, 385, 386, 387, 388,389, 390, 391, 392, 393, 394, 395, 396, 397, 398, 399, 400,401, 402, 403, 404, 405, 406, 407, 408, 409, 410, 411: n = A,T,C or G
  misc_feature 412: n = A,T,C or G
ggcacgaggaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15768 - DNA, 414 bp, Homo sapiens
ggcacgaggtcttgctcacatgttgtactactctctcctggatgtcacttgtcacctctaccagccctcctttctccagatggcttcttcataaccaccaggtcagaagaggatccgttccaatgattttcctaaaacaatggaagtgttttccaaagagcttataaggcattgtaggatctggcctgccctgactccactttaccagaaccatctgctgctcttctctcttgtgttactcaaggtattagctgctgtggcaaatcaactctgaaatctccgtgacttaatacaagagaggtttatttcttactcacgctgggtgcactgccacttggtaacagaggagctatggaaacttgagacctaagcagaaatgagttcaataatattgctacactctaggactttctc

SEQ ID NO: 15769 - DNA, 410 bp, Homo sapiens
  misc_feature 410: n = A,T,C or G
ggcacgaggaagagccgggaggatgtattggttgttaggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcaaggaggacaggttgactgtggtgagttccaagacacccaaggctan

SEQ ID NO: 15770 - DNA, 411 bp, Homo sapiens
ggcacgagatacgaatggggtgtatttttcgactgctcgcaggcacccccaggttatgtggacagagctaagcccaaagttgtgattttccactctgttctgtccatgtcgagggaagataagtagaaagtgacacagtaagagccagaatacaccaggtgaaggagagaattgcattgtgttttgagaagtttcactgacaagttatcctgggctgtgggacatcactagctttgaaagtgtagctggcacctcgtccatctaatttgatgggtgtgtgtggggtgttgtgcacgcgtcggtctaacatatctgaacccaggtgatttctgttctcaggacgcttttaggtgacaaggatcaggcatgtgaacaaataaccatactgtaaagctggctgtgctgggtctc

SEQ ID NO: 15771 - DNA, 413 bp, Homo sapiens
  misc_feature 397: n = A,T,C or G
ggcacgaggaagattctcgcagtcctggtttctccctccagaagaccccccacccaaatgctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggngtgatgggccgcatcc

SEQ ID NO: 15772 - DNA, 412 bp, Homo sapiens
aggatcccatcgattctaattcggcacgagctccataaggcagaggtctatgcgaggacgcccggctggaccacgagaccgcccattgattgcgctgggacaagaattccttatctttggaggcagtgaaacgactaatagctaaaggtaatacagaagaactacgaaaatgttttggggtccgaatggagtttgtgacagctggcctccgagctgctatgggacctggaatttctcgtatgaatgacttgaccatcatccagactacacagggattttgcagatacctggaaaaacaattcagtgacttatagcagaaaggcatccggatcagttatgacgcccgagctcatccatccagagggggtagcatcaaaaggtttgcccgacttgctgcaaccacatttatcag

SEQ ID NO: 15773 - DNA, 408 bp, Homo sapiens
  misc_feature 147, 148, 149, 150, 151, 152, 153, 154, 155, 156, 157, 159,160, 161, 162, 163, 164, 165, 166, 167, 168, 169, 170, 171,172, 173, 174, 175, 176, 177, 178, 179, 180, 181, 182, 183,184, 185, 186, 187, 188, 189, 190, 191, 192, 193, 194: n = A,T,C or G
  misc_feature 195, 196, 197, 198, 199, 200, 201, 202, 203, 204, 205, 206,207, 208, 209, 210, 211, 212, 213, 214, 215, 216, 217, 218,219, 220, 221, 222, 223, 224, 225, 226, 227, 228, 229, 230,231, 232, 233, 234, 235, 236, 239, 240, 241, 242, 243: n = A,T,C or G
  misc_feature 244, 245, 246, 247, 248, 249, 250, 251, 252, 253, 254, 255,256, 257, 258, 259, 260, 261, 262, 263, 264, 265, 266, 267,268, 269, 270, 271, 272, 273, 274, 275, 276, 277, 278, 279,280, 281, 282, 283, 284, 285, 286, 287, 288, 289, 290: n = A,T,C or G
  misc_feature 291, 292, 293, 294, 295, 296, 297, 298, 299, 300, 301, 302,303, 304, 305, 306, 307, 308, 309, 310, 311, 312, 313, 314,315, 316, 317, 318, 319, 320, 321, 322, 323, 324, 325, 326,327, 328, 329, 330, 331, 332, 333, 334, 335, 336, 337: n = A,T,C or G
  misc_feature 338, 339, 340, 341, 342, 343, 344, 345, 346, 347, 348, 349,350, 351: n = A,T,C or G
ggcacgaggaaaaaccagtttctcttttattgtctgttactaatctctattctaaagattcagctcaattctcaaccatactccaaactctctcttttccagctacctttactccctctccttcaattccactttcctctgcttacnnnnnnnnnnncnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttttttttcattaaagagagaaatcacctattcaggaccggcccccacctttg

SEQ ID NO: 15774 - DNA, 405 bp, Homo sapiens
ggcacgaggcttacaggggtgaccagggcccttcctaactcgaccgcatgtggattggtggctggcttgggagggaggctgtccgatgctgacattccccttaacatggccctgaccgtggctgtcaggggccaccttgcctcaccaggccagccccactgggaatggggtcagtcacagcagaaccgtccaaaggtggacctgatgtgggccctgccgggggcgcttggcctcagcgggccatgggagacccagtgaaacgactctagtgtgaggcagtggtcctgccactgactgacaaaccctctttgtaagcaaacttgacaaataatgaatctactgaactctgttatagaacaagctcattctgcatgaacttctcttattgaagcagaagccacgtca

SEQ ID NO: 15775 - DNA, 403 bp, Homo sapiens
  misc_feature 12, 17: n = A,T,C or G
ggatcccatcgnttcgnattcggcacgaggcaaccagctcgtccagcgcgtggccctgctgctcaaggagcagactgcgtaccccccgacacactacatccggagggtgccccagaggaagatccactacttcacgggcctgcaggcgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtactcccaagctggctctggaactgtgaggggaaggggaagatgtgtgg

SEQ ID NO: 15776 - DNA, 397 bp, Homo sapiens
ggcacgagtctgcttctgtcactgtcacatagacagccctgcatgccccctgtctcacacaggttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaatc

SEQ ID NO: 15777 - DNA, 401 bp, Homo sapiens
  misc_feature 358, 359, 360, 361, 362, 363, 364, 365, 366, 367, 368, 369,370, 371, 372, 373, 374, 375, 376, 377, 378, 379, 380, 381,382, 383, 384, 385, 386, 387, 388, 389, 390, 391, 392, 393,394, 395, 396, 397, 398, 399, 400: n = A,T,C or G
ggcacgagagccgttgccttcaccgccctttctccttttatccttttttaaacgctcttgggggttatgtccgctgcttcttgggtgccgagacatatagatggtggtctcgggccagcccctcctctccccgccttctgggaggaggaggtcacacgctgatgggcactggagaggccagaagagactcacaggagcgggctgccttccgcctggggctccctgtgacctctcagtcccctggcccggccagccaccgtccccagcacccaagcatgcaattgcctgtcccccccggccagcctccccaacttgatgtttgcgttttgtttggggggatatttttcataattatttnnnnnnnnnnnnnnnnnnnnnnnnnnnnnnnnnnnnnnnnnnnc

SEQ ID NO: 15778 - DNA, 401 bp, Homo sapiens
ggcacgagggcagtccagcaacaagcctttcatttacattaaattataacttttcattcattcctaaaccaaacttaaaattctgctttcctttgagtagaaggtatttaacttgttttgtttttccttcagaaggaatttaatgcaaacggattgcagtcagcactttctgaatgttttcacacagtatgcaaagcttacatcataccaaggagtggagagttgaagtttcctcccagtgactccagtgacagaccacacctagaaagcgtttctcttcctgagtatttcaaaaagatgtaaaagagctggggagagtatgggaagaaacaatacaggattgcctttaattaattaagaattgcctcctgataaaaggaaaaagaaattaatgctggagg

SEQ ID NO: 15779 - DNA, 401 bp, Homo sapiens
  misc_feature 342: n = A,T,C or G
ggcacgaggccccacgggccccatctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaanagagccattttaattttcaccttcaatggtaaaagcaagggtaatttggttgacatttt

SEQ ID NO: 15780 - DNA, 399 bp, Homo sapiens
ggcacgagagcagaagattctctcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatggctacgaccaggtcgtccacccccagaaacgaatactgatcaggaaagtcctggacg

SEQ ID NO: 15781 - DNA, 399 bp, Homo sapiens
  misc_feature 399: n = A,T,C or G
ggcacgaggctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttataagaaataaaagggcaggttgttgaaaacaactcn

SEQ ID NO: 15782 - DNA, 400 bp, Homo sapiens
ggcacgagcggaccgggccgagccgggccgcccgggcgcagtctttaaccatggcgtccctcttcaagaagaaaactgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggg

SEQ ID NO: 15783 - DNA, 402 bp, Homo sapiens
ggcacgaggggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctctaggagggcaggcctcctt

SEQ ID NO: 15784 - DNA, 395 bp, Homo sapiens
ggcacgaggtagagatacgaatggggtgtagtagccgactgctcgcaggcacccccaggttatgtggacagagctaagcccaaagttgtgattttccactctgttctgtccatgtcgagggaagataagtagaaagtgacacagtaagagccagaatacaccaggtgaaggagagaattgcattgtgttttgagaagtttcactgacaagttatcctgggctgtgggacatcactagctttgaaagtgtagctggcacctcgtccatctaatttgatgggtgtgtgtggggtgttgggcacgcgtcggcctagcagatctgaacccaggtgatttctgttctcaggaagcttttaggtgacaaggatcaggcatgtgaacaaataaccatactgg

SEQ ID NO: 15785 - DNA, 144 bp, Homo sapiens
  misc_feature 144: n = A,T,C or G
ccggtaaggaatatacttcttctgatactaaatatgccaatatttaaaatgtaatattcagggattacaactgtgagggctaaacacacggaattacccaccaattcctctgtagttctctactaattcaattttgcatcctcn

SEQ ID NO: 15786 - DNA, 392 bp, Homo sapiens
ggcacgagaccaggtcataagaggatccgttccaatgattttcctaaaacaatggaagtgttttccaaagagcttataaggcattgtaggatctggcctgccctgactccactttaccagaaccatctgctgctcttctctcttgtgttactcaaggtattagctgctgtggcaaatcaactctgaaatctccgtgacttaatacaagagaggtttatttcttactcacgctgggtgcactgccacttggtaacagaggagctatggaaacttgagacctaagcagaaatgagttcaataatattgctacactctaggactttctccaaaattaacaacagaacaaaagtgcaaggcagtgataacccatctgacagcatttggggagtgtt

SEQ ID NO: 15787 - DNA, 395 bp, Homo sapiens
ggcacgagatcaatcacaaaagtttatccttaagacttcccttcagctgctggaaggcagtcatcacatctgtgaaaagagtgctagttataacaaatgagatcacaaatttgaccattttattagacaccctctattagtgttaacagacaaagatgaaggttaagttgaaatcaaattgaaatcatcttccctctgtacagattgcaatatctgataataccctcaactttcttggtgcaaattaattgcctggtactcacagtccagtgttaacaggcaataatggtgtgattccagaggagaggactaggtggcaggaaaataaatgagattagcagtatttgattggagccataagcataatttggttccggcggcggccaggtttaaaa

SEQ ID NO: 15788 - DNA, 288 bp, Homo sapiens
  misc_feature 215, 216, 217, 218, 219, 220, 221, 222, 223, 224, 225: n = A,T,C or G
cgcccgcgcctctctgttctctctcgcgcgcggtgtctctctcgatagagtgcgcgacctgcacaccctctgtgtggggttctcgctccccgtgtgcgcgcgcgcgcgctctctgtgggactcgcacacaccgcgcgcgcgcgcgctctctgtgggggggccctccccgcaccttgtgtgtgtgtgtctgtgttatctctgtgagatgtgcgtgnnnnnnnnnnntctgtgtgtgtgtctgccctccgcgccgtgtctgttatatatgcgctcgctcgctggggcgcg

SEQ ID NO: 15789 - DNA, 393 bp, Homo sapiens
ggcacgaggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctaaggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagcc

SEQ ID NO: 15790 - DNA, 394 bp, Homo sapiens
ccgcgacgagatgatgatctgcttcttccattatgcccagatgataaaaaggattgatacaaaagagggatctgaattctcattttcagatggagaagtggccgaaaaagcagaggtttacaggtcagaaaatgaaagtgaacggaactgcctagaagaatcagagggctgctattgcagatcatctggagaccctgaacaaataaaggacgacagtttatcagaagagagtgctgatgcacggagttttgaaatgactgaactcaatcaagctttagaagaaataaaagggcaggctgttgaaaacacctctgtaactgaattttctgaggagaaacaccgaacttgaaattcacaccggcctaatgtccaagaattcaagggggggtccctc

SEQ ID NO: 15791 - DNA, 390 bp, Homo sapiens
  misc_feature 151, 152, 153, 154, 155, 156, 157, 158, 159, 160, 161, 162,163, 164, 165, 166, 167, 168, 169, 170, 171, 172, 173, 174,175, 176, 177, 178, 179, 180, 181, 182, 183, 184, 185, 186,187, 188, 189, 190, 191, 192, 193, 194, 195: n = A,T,C or G
ggcacgagcccttatacaaacatatatgaacatatatactttttttgttgtataaaaacaggatcacattatagatattattctgtaactttctgttttcacccaaaatacagcagagcactattttccagaagcacgtagttctaacttnnnnnnnnnnnnnnnnnnnnnnnnnnnnnnnnnnnnnnnnnnnnnaactttattcaagtacttcacattttaagtggacattccatttgtctgctataatttacaattatagcaatactttgagaaaggtctttgcaagtatatccatatgaactaatgtctatgtagaagatatgctggctcaaatattatgtacatttaatgtcttaataaacaccgctagattactttccaggaagc

SEQ ID NO: 15792 - DNA, 388 bp, Homo sapiens
ggcacgaggtcagcacacattactttaacactttggacttgaaattctgaaagatcagaaattccttactgtttgagatgattaggttttagggactagccattttatctcacatgactcaggccttaatgctccattgctaatagctaaatgtggaaaagtttagaattacatttaatttagtcaactgttaggctgcaatcatttttttttaaaaatctgcttatggcattattcgagataacttgaccaactctaaaatatatatgtaattacttctagatgtaagtagtttttcatattaacaacacaatcaggctctgtttcagttagttcttagagtggtgaaaaaaaatctttacagtaagtgcaaaattataatccaagg

SEQ ID NO: 15793 - DNA, 388 bp, Homo sapiens
ggcacgagagttaatccaaaagacttcccttcagctgctggaaatcagtcatcacatctgtgaaaagagtgctagttataacaaatgagatcacaaatttgaccattttattagacaccctctattagtgttaacagacaaagatgaaggttaagttgaaatcaaattgaaatcatcttccctctgtacagattgcaatatctgataataccctcaactttcttggtgcaaattaattgcctggtactcacagtccagtgttaacaggcaataatggtgtgattccagaggagaggactaggtggcaggaaaataaatgagattagcagtatttgacttggagccataggcatcaattctgctccagctgtcgaccaggttctaaaaa

SEQ ID NO: 15794 - DNA, 267 bp, Homo sapiens
  misc_feature 162, 163, 164, 165, 166, 167, 168, 169, 170, 171, 172, 173,174, 175, 176, 200, 201, 202, 203, 204, 205, 206, 207, 208,209, 210, 211, 212: n = A,T,C or G
actgtgtgtgtgtctgttttctctctctctcttctcagtcacactttttttttgggacacaccctccatccgcgggggggtttttttcccggcgcgcgccctttttttttgtgtgtttctctgcgcgcctctcttttttctctctcttccccccccgcttannnnnnnnnnnnnnngcggggggggttttcgcgcgttcnnnnnnnnnnnnnctcttccgcccccccacaggggggtgctgtttattatctttctttctccctgagc

SEQ ID NO: 15795 - DNA, 389 bp, Homo sapiens
ggcacgagcttgactgcaaacttgctgaaggtagggactgtttgtcttggacttcgctgccagtccttagaacagtgtctgggacacagtgtgttctcaaatatttgttgctggaataaatgaatgaactaaatcagtcttttagggatttactgttaaccaccatgggaaaattaaataaatgcggggaaggaaaacgttctaaaattagaagactactttctactctcagcttctgattccctctgagctaagaaccagacagccttaggctggtaactcctataagctggtcctcctcccatgctgaccccatctttactgtacaattcacttttcatggactgaaggcaccaccaagatagatccaggagtgacaactccagtgg

SEQ ID NO: 15796 - DNA, 319 bp, Homo sapiens
tgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttcct

SEQ ID NO: 15797 - DNA, 385 bp, Homo sapiens
ggcacgagaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagcttt

SEQ ID NO: 15798 - DNA, 383 bp, Homo sapiens
  misc_feature 235, 236, 237, 238, 239, 240, 241, 242, 243, 244, 245, 246,247, 248, 249: n = A,T,C or G
ggcacgaggggaatagagggtccctggtgacagggcaaggctagatctggagcctgcacttggcctgtgacatactgtcttgtttctgagaatcctcccctacttctctagataatctccaaacacttctgtgactacttaatcacaaaggaaattttcaggagatataatcgaattctattttacaaaaaaaaagagaagggatctgaatgttttcagttcacgctagggatcnnnnnnnnnnnnnnncccaaacctgacgtttgaggacccgcctttttttcagccaatttaaaagattttttaaggtttagggttggttggccattaaaccatccccggaaagaaaatgggggtaaaagaccaagaaggaggtcgccaag

SEQ ID NO: 15799 - DNA, 382 bp, Homo sapiens
ggcacgagataagatctgaggtgttacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactggggccttgaatggcca

SEQ ID NO: 15800 - DNA, 375 bp, Homo sapiens
ggcacgagcaagcctttcatttacattaaattataacttttcattcattcctaaaccaaacttaaaattctgctttcctttgagtagaaggtatttaacttgttttgtttttccttcagaaggaatttaatgcaaacggattgcagtcagcactttctgaatgttttcacacagtatgcaaagcttacatcataccaaggagtggagagttgaagtttcctcccagtgactccagtgacagaccacacctagaaagcgtttctcttcctgagtatttcaaaaagatgtaaaagagctggggagagtatgggaagaaacaatacaggattgcctttaattaattaagaattgcctcctgataaaaggaaaaagaaa

SEQ ID NO: 15801 - DNA, 376 bp, Homo sapiens
ggcacgagacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctgttcccctgcaggatctgagtggcatagagctgggcctggcaggccagagcctgcggctagagtgggcagctggggcgggccgctgtgtgctgctg

SEQ ID NO: 15802 - DNA, 371 bp, Homo sapiens
ggcacgaggtcacctctaccagccctcctttctccagatggcttcttcataaccaccaggtcagaagaggatccgttccaatgattttcctaaaacaatggaagtgttttccaaagagcttataaggcattgtaggatctggcctgccctgactccactttaccagaaccatctgctgctcttctctcttgtgttactcaaggtattagctgctgtggcaaatcaactctgaaatctccgtgacttaatacaagagaggtttatttcttactcacgctgggtgcactgccacttggtaacagaggagctatggaaacttgagacctaagcagaaatgagttcaataatattgctacactctaggactttct

SEQ ID NO: 15803 - DNA, 258 bp, Homo sapiens
  misc_feature 63, 64, 65, 66, 67, 68, 69, 70, 71, 72, 123, 124, 125, 126,127, 128, 129, 130, 131, 132: n = A,T,C or G
cagtttctttgtgcgcgcgcccccccttttttctctctctctccgcgcgggcgtgtccctccnnnnnnnnnnctgtgtgtgcgctctctccgccccatatatattgtgtttttctctgtggannnnnnnnnntctctctagagtcttttctctcccctcgcgcgcacattgttatacactcctcccctctctttctttttacacacacatatatattgcgcccctctccccccacacatttatatctctctcacatct

SEQ ID NO: 15804 - DNA, 368 bp, Homo sapiens
ggcacgagacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattg

SEQ ID NO: 15805 - DNA, 372 bp, Homo sapiens
acggcacgagctggctcctcgttttctttgtggacagtctcattaccaacatcctcgttcgggtctaggatgcctttctgctcgaggggaccaacgcggcgattcgctatgccttggccattatcttgtacaacgagaaggacatcttgaggctacagaatggcctggaaatctaccaggacctgcgcttcttcaccaataccaactccatcagccggaagctgatgaacattgccttcaatgacatgaaccccttccgcatgaaactattgcggcagctgtgcatggcccaccgtgagcggctggaggctgatctgccggagctggagcaacttaaggcaaagtacctggctaggcaggcatcccggcgca

SEQ ID NO: 15806 - DNA, 365 bp, Homo sapiens
ggcacgaggctgagagtgcttgatacacccttgaatcccctcttatatgatgccccagcccaggagagataaaagcatcagcaccatgagattcacctgcctctggtcgttagggaacaatggaggcctgcgatttggagttaaactctcagtgatctctgtgttgacaacaccaaagctagaggaatccagtaggatgtgggcatggttttcccggaaggctgactgagcagttctgcaaatgtttgcaagtacagggcagaatttcatccagcctcagaaccttgagccaagactcagcatcagcaaagccaaaagtttcatttctttgactgtgggagtgctagtcccaacctttagatggc

SEQ ID NO: 15807 - DNA, 353 bp, Homo sapiens
ggcacgagaaacaaaagagagcaagagagaagacagtgggtgaagtcctggttccagactcccctttttgccgggatatgatggatctgtcagctggtgaggcccctctaagaggggtggtatcttcgggccaggtgcctagagtcctagagagctagagatggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaattttt

SEQ ID NO: 15808 - DNA, 352 bp, Homo sapiens
ggcacgaggccactcgggggcccaggaacccctcagttagggcttctcagtcactgagcggaaggtgcccccagagggggcagccgcctgtgaggagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgg

SEQ ID NO: 15809 - DNA, 470 bp, Homo sapiens
gacttctgtctttttaggatcccatcgacttcaattcggcacgaggtcatgagaaaggaaccaatggagtatgagaagtttccagtgaaaaacagaaagaatccagtagaatttatttagggaagaggaaaagatgtgttcggggtggccttggaagtgaacgttgaaggactactgagattggttcaagaaactgtgaagggaaagaaagggttatactgagaaatggaagagataattttagaaacttgcgaaaaatggcttaatctaaatgagtgttaggggagatacagctgtgatgataggttgagctcacatggtggagagccacagttgcgggtgcttgcactgataatgtgagggcatggagacagacaataagttgaatgctctttttttaacaaaggaagctaaaagggagggggatgctaatttgatcaatacgtttgggaaaacttatattttcttgg

SEQ ID NO: 15810 - DNA, 456 bp, Homo sapiens
  misc_feature 456: n = A,T,C or G
tagcacttttgtttaggaggaccccatcgattcgaattcggcacgagctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttcgtccaagcctttccgtccaggacctcaaacagatccaatcacaagaagagagatn

SEQ ID NO: 15811 - DNA, 464 bp, Homo sapiens
atcgcccatacggcgagcccaccgacgcgaattcggcacgaggggaaacacaggcctcttctgcttttaggaccctccccctgccttgcagggggctcggggagagcaatatcaggagctagggcttgctgctgcccacactcctgctttttgggatatctaactgctaaggagggagttgacatcccccttctggctcatgtgtctgacaccaacaacatgggctctgtccctctctctttgactctccctttgtcctccccatacagctggggtggggtggatccctatacctggggcaggcagccccaaagtggtggagggggatggcaaagactgtataggcgccactggactctggcaaggcctttattacctttactccccttcctctcccatcaccagcctcaaggcctgaggtgtgcaggggctcctggcagctactgagtgagggttcctggtcg

SEQ ID NO: 15812 - DNA, 448 bp, Homo sapiens
  misc_feature 431, 448: n = A,T,C or G
ggcacgagctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttcgtccaagcctttccgtccaggacctcaaacagatccaatcacaagaagagagatttcaggaaagagaanattattcctatcatcgn

SEQ ID NO: 15813 - DNA, 439 bp, Homo sapiens
ggcacgaggaaagttaagcaactacaggaaatggctttgggagttccaatatcagtctatcttttattcaacgcaatgacagcactgaccgaagaggcagccgtgactgtaacacctccaatcacagcccagcaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatg

SEQ ID NO: 15814 - DNA, 334 bp, Homo sapiens
  misc_feature 182, 183, 184, 185, 186, 187, 188, 189, 190, 191, 192, 193,194, 195, 196, 197, 198, 199, 200, 201, 202, 203, 204, 205,206, 207, 208, 209, 210, 211, 212, 213, 214, 215, 216, 217,218, 219, 220, 221, 222, 223, 224, 225, 226, 227, 228: n = A,T,C or G
  misc_feature 229, 230, 231, 232, 233, 234, 235, 236, 237, 238, 239, 240,241, 242, 243, 244, 245, 246, 247, 248, 249, 250, 251, 252,253, 254, 255, 256, 257, 258, 259, 260, 261, 262, 263, 264,265, 266, 267, 268, 269, 270, 271, 272, 273, 274, 275: n = A,T,C or G
  misc_feature 276, 277, 278: n = A,T,C or G
ccccgcgcgcgctccctctctatcttttatacaaaatatagagagcgcacatctctgtgtgtgagagagtctgtgcgcgcgcgcatatatatatgggaggggtgtctccccccatctgtgtgtctctcctcttgcggggcatatgcgtgcgcacacccgcgcgctgtgtctcttttgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgcacacacccacacaccgtgtgttctacagcgcgataaagagagacacaca

SEQ ID NO: 15815 - DNA, 428 bp, Homo sapiens
ggcacgaggtcctgagcagcctcatgggaggtgaattagagaaaacaaaagagagcaagagagaagacagtgggtgaagtcctggttccagactcccctttttgccgggatatgatggatctgtcagctggtgcctagagtcctagagagctagagatggagggaaattcagatcatctaaacccttcagcccttcactggacagaagaggaaactgaggctccatctgcatgacgttcccagagtcacggcacaaattcatggaagaagcagcaggaaactcagttctccagtctgggtccaatgtgtgttttagaaatatctccacagggttaatgactcaatttttcatgcatgattgctagtaatgacaatcatgttatgtttggttctgtagctttggaaatcactccttccacttgagtttc

SEQ ID NO: 15816 - DNA, 427 bp, Homo sapiens
  misc_feature 10, 11, 12, 13: n = A,T,C or G
cgccccaaannnnaatctctaaaggggtaagggagatacctaccttgtctggtaggggagatgtttcgttttcatgctttaccagaaaatccacttccctgccgaccttagtttcaaagcttattcttaattagagacaagaaacctgtttcaacttgaagacaccgtatgaggtgaatggacagccagccaccacaatgaaagaaatcaaaccaggaataacctatgctgaacccacgcctcaatcgtccccaagtgtttcctgacacgcatctttgcttacagtgcatcacaactgaagaatggggttcaacttgacgcttgcaaaattaccaaataacgagctgcacggccaagagagtcacaattcaggcaacaggagcgacgggccaggaaagaacaccacccttcacaatgaatttgacac

SEQ ID NO: 15817 - DNA, 437 bp, Homo sapiens
  misc_feature 13, 18, 19, 20, 27, 32: n = A,T,C or G
ccgagccggatgnccttnnngagtatngcaangattccaattcggcacgagagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttacgttctacaggcaaggacaggttgtgatgagggttctgaaggatagagaccaagcatggagggtgttgaggaggcttctgcgagacctgaatgatgggaagccacgaagtgggaggggtgggggtccaggctggaggggcccaatgtatgtgtagagggactacagccct

SEQ ID NO: 15818 - DNA, 425 bp, Homo sapiens
  misc_feature 425: n = A,T,C or G
ggcacgagctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttcgtccaagcctttccgtccagggacctcaacagatccaatcacaagaagagagatttcaggaan

SEQ ID NO: 15819 - DNA, 421 bp, Homo sapiens
ggcacgagccgtggctgcctcgtgagcctcccagagcccaggcctccgtggcctcctcctgtgtgagtcccaccaggagccacgtgcccggccttgccctcaaggatttttgcttttctcctgtgcacctggcgaggctgaaggcgaggggtggaggaggccccagcacagcctcatctccatgtgtacacgtgtgtacgtgtgtatgcgtgtgtgtacgtgtgtatgcgtgtgtgtacgcgtgtgtacgtgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctct

SEQ ID NO: 15820 - DNA, 423 bp, Homo sapiens
ggcatgagtggaagggaggcagctgcctttgtttgccatggatgggtaggggctgcactgagcagcagcggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttccgccaagcctttccgtc

SEQ ID NO: 15821 - DNA, 312 bp, Homo sapiens
tctgtcactcacaaaacacagtgcgcgcacatagcggggggggagcacacacacaagatgtgtgtgtatacaacccgcgcgcgagagagcgctctcttttgtgggggggaaaaaaactcttatacacacacgtgtgtgtgtgtcgctctccgaaaatacacactataacaaacgcactgtgtgtgtgagacacacactcctctctccgagtggggagagagagatcgcgctccactcttaaacacatatgcgctcacagagagcatatatatgttttttttgagagaagagagagatctctttgtggtttct

SEQ ID NO: 15822 - DNA, 428 bp, Homo sapiens
tgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtca

SEQ ID NO: 15823 - DNA, 430 bp, Homo sapiens
ggcacgagaggactttgagcccagagagatgaagtcatttgctcaaggcagcagtcagtggaagggcttggagaaggagaaggggtctgaaggtggtgtgggacacatgagagtgatctcgcagcttggtttgctgcagcagactcggacaagcattgtttcagtgcctggtttctccctccacttgatgggggccaactccaacccaatgtcccattcctatcctgaaatgcttctaaaggcagtgccctgagaaccaccaacctcacagcctgtctccattttattgtcttctgggaacttctcccttctgtctagcacctgtttgcactgggattgtcctgtctgtccttcagttggatcctggtttgcacccgatgaggatttagcaattttaggctgtgcttcggcaaaggccaactcacaatgg

SEQ ID NO: 15824 - DNA, 405 bp, Homo sapiens
ggcacgagggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgttgtagctttaactcgtgtgca

SEQ ID NO: 15825 - DNA, 403 bp, Homo sapiens
ggcacgagcctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagggtcaggttgggtaggagagaggagagtcttggaggggctgctccatgggggtcacacctctctcctgtgggttttcgctggtgattgagttctgaggcatttgctgcattgactgtg

SEQ ID NO: 15826 - DNA, 417 bp, Homo sapiens
  misc_feature 233, 234, 235, 236, 237, 238, 239, 240, 241, 242, 243, 244,245, 246, 247, 405: n = A,T,C or G
gttctgtgggaatagagggtccctggtgacagggcagggctagatctggagcctgcacttggcctgtgacatactgtcttgtttctgagaatcctcccctacttctctagttaatctccagagacttctgtgactacttaatcacaaaggaaattttcaggaatattatcaaatactattttagaaaaaaaaagagaagggatttgaatgttttcagttcagtttagttatcnnnnnnnnnnnnnnnccccaaactccagaatgggggcccccccttctttaaccccacctaaaaatttttcggaggttcagggttggttggcaaattacaaaaaccccaaaagaaaatgggggttaacccccttggaaaagttttcttactttggggggtggccctttgacgtnggcccgggttac

SEQ ID NO: 15827 - DNA, 300 bp, Homo sapiens
  misc_feature 288, 289, 290, 291, 292, 293, 294, 295, 296, 297, 298, 299,300: n = A,T,C or G
ctatatctctctgcgccctctccccctcttgtgttttcccccgcccctctagagatatctctctcactcgcgggcgcacacccccctttacaaaatagggggctctctgtgtgtggtgtttttcttgggcgccccctctttttttttctttttgcgggcccccccctgtgtgtctctctctagacacacccccccgcgcgtgttttttataaatatctgtctctcacacaccccctactgcccctctgtgtgtgggcgcgttcccccccacacacacagagtgtgtgnnnnnnnnnnnnn

SEQ ID NO: 15828 - DNA, 411 bp, Homo sapiens
ggcacgagggcaccgagcctcctgtgggaggtcccgaggcagcttcgcctgctcggcctggctgcagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagcagacaccagcatttgccacaatgctgtcatccactgactttacatttgcttcctgggagcttgtggtccgcgttgaccatcccaatgaagagcaggcagaaagacgtccgcactgagaggattctggagacccttcacgttggaaggagtgatgctcaaggttagtagaacagatcaa

SEQ ID NO: 15829 - DNA, 412 bp, Homo sapiens
gcacgatccatcattcaattcggacagccactccaactgacctgttccgtggctgcctcgagagcctcccatagcccaggcctccgtaggcctcctcctgtgtgagtcccaccaggagccacgtgcccggccttgccctcaagggtttttgcttttctcctgtgcacctggctaggctgaaggcgaggggtggaggaggccccagcacagcctcatctccatgtgtacacgtgtgtacgtgtgtatgcgtgtgtgtacgcgtgtacgcgtgtgtgtacgcgtgagtacgtgctgtgtgtacacatgcgtggccgcctgtggtgtgcacgtgtgctctgggctccgaggcttctccagagctgggagctggctggcgtggcaagggcatgctctggggcagtgtgtccctcag

SEQ ID NO: 15830 - DNA, 411 bp, Homo sapiens
  misc_feature 285, 286, 287, 288, 289, 290, 291, 292, 293, 294, 295, 296,297, 298, 299, 300, 301, 302, 303, 304, 305, 306, 307, 308,309, 310, 311, 312, 313, 314, 315, 316, 317, 318, 319, 320,321, 322, 323, 324, 325, 326, 327, 328, 329, 330, 331: n = A,T,C or G
  misc_feature 332, 333, 334, 335, 336, 337, 338, 339, 340, 341, 342, 343,344, 345, 346, 347, 348, 349, 350, 351, 352, 353, 354, 355,356, 357, 358, 359, 360, 361, 362, 363, 364, 365, 366, 367,368, 369, 370, 371, 372, 373, 374, 375, 376, 377, 378: n = A,T,C or G
  misc_feature 379, 380, 381, 382, 383, 384, 385, 386, 387, 388, 389, 390,391, 392, 393, 394, 395, 396, 397, 398, 399, 400, 401, 402,403, 404, 405, 406, 407, 408, 409, 410, 411: n = A,T,C or G
ggcacgagaggatatggtgcaaaaaaatatgattttgttaaccacaacaaaaagaaaggtaagaaatgctaggagaaagctaaaagctccatactaaaataatggtcctaatattaagcaaagtaaaatgtggtatgattttgagtggtcagcagagtgtaagaataatctatttgcacttgatactttcagctgtcacagaggtcatagaattgggcttattgagaaggaaaggtaaatgctagtacactacttggctcagaagtgaacaaaattgcagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15831 - DNA, 415 bp, Homo sapiens
  misc_feature 285, 286, 287, 288, 289, 290, 291, 292, 293, 294, 295, 296,297, 298, 299, 300, 301, 302, 303, 304, 305, 306, 307, 308,309, 310, 311, 312, 313, 314, 315, 316, 317, 318, 319, 320,321, 322, 323, 324, 325, 326, 327, 328, 329, 330, 331: n = A,T,C or G
  misc_feature 332, 333, 334, 335, 336, 337, 338, 339, 340, 341, 342, 343,344, 345, 346, 347, 348, 349, 350, 351, 352, 353, 354, 355,356, 357, 358, 359, 360, 361, 362, 363, 364, 365, 366, 367,368, 369, 370, 371, 372, 373, 374, 375, 376, 377, 378: n = A,T,C or G
  misc_feature 379, 380, 381, 382, 383, 384, 385, 386, 387, 388, 389, 390,391, 392, 393, 394, 395, 396, 397, 398, 399, 400, 401, 402,403, 404, 405, 406, 407, 408, 409, 410, 411, 412, 415: n = A,T,C or G
ggcacgagaggatatggtgcaaaaaaatatgattttgttaaccacaacaaaaagaaaggtaagaaatgctaggagaaagctaaaagctccatactaaaataatggtcctaatattaagcaaagtaaaatgtggtatgattttgagtggtcagcagagtgtaagaataatctatttgcacttgatactttcagctgtcacagaggtcatagaattgggcttattgagaaggaaaggtaaatgctagtacactacttggctcagaagtgaacaaaattgcagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtn

SEQ ID NO: 15832 - DNA, 403 bp, Homo sapiens
ggcacgaggaaggtgtcaggagcatcccatttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgccaagcattttgcaaatcagcg

SEQ ID NO: 15833 - DNA, 407 bp, Homo sapiens
ggcacgaggggcgacaagctgttggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaat

SEQ ID NO: 15834 - DNA, 416 bp, Homo sapiens
ggcacgagacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctc

SEQ ID NO: 15835 - DNA, 386 bp, Homo sapiens
  misc_feature 386: n = A,T,C or G
ggcacgaggaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagcn

SEQ ID NO: 15836 - DNA, 391 bp, Homo sapiens
  misc_feature 231, 232, 233, 234, 235, 236, 237, 238, 239, 240, 241, 242,243, 244, 245: n = A,T,C or G
ggcacgagaatagagggtccctggtgacagggcagggctagatctggagcctgcacttggcctgtgacatactgtcttgtttctgagaatcctcccctacttctctagttaatctccagagacttctgtgactacttaatcacaaaggaaattttcaggaatattatcaaatactattttagaaaaaaaaagagaagggatttgaatgttttcagttcagtttagttatcnnnnnnnnnnnnnnncccaaaactcaagattggggcccccccctcctttaaccccgctaaaaagttttttgggggtttagggtgggttggcaaataacaaaacccccaaaagaaaaggggggtaaacccccttggaaaagtttcctaactttggggggcgc

SEQ ID NO: 15837 - DNA, 391 bp, Homo sapiens
  misc_feature 51, 52, 53, 54, 55, 56, 57, 58, 59, 60, 61, 62, 63, 64, 65,66, 67, 68, 69, 70, 71, 72, 73, 74, 75, 76, 77, 78, 79,80, 81, 82, 83, 84, 85, 86, 87, 88, 89, 90, 91, 92, 93,94, 95, 96, 97, 98, 99, 100, 101, 102, 103, 104, 105, 106: n = A,T,C or G
  misc_feature 107, 391: n = A,T,C or G
ggcacgagcctgcatcgacccatttttcctcatgacaaactattggtgcannnnnnnnnnnnnnnnnnnnnnnnnnnnnnnnnnnnnnnnnnnnnnnnnnnnnnnnnacttagggccactcatctgtcatggaaccagaatctaaatccaaataggctgttgccagtacagatggtaagtacatgtacttctggcaggaaagcagaataaaagttgactgaacctgaaagtctcggaaatggtcttctcatttctattctgtaaagtgtcacgtcttctaggcctacctctgtcaatattgaaatacaaaattaactttttctgctttttatttcacaaatcaacgggaacagtcttagtcatttgtgttttatgagttttaattaggccn

SEQ ID NO: 15838 - DNA, 385 bp, Homo sapiens
  misc_feature 349, 372: n = A,T,C or G
ggcacgaggacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtncaggctggaggggcccaatgtangtgtaaagggact

SEQ ID NO: 15839 - DNA, 392 bp, Homo sapiens
ggcacgagaaaggctggaagggaggcagctgcctttgtttgccatggatgggtaggggctgcactgagcagcaccggtgttcttcatccggctgcacccccgacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccat

SEQ ID NO: 15840 - DNA, 394 bp, Homo sapiens
ggcacgagatggaatgacagctttttttagtagcatatccttgcgctgtgttagatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctgggtcctgcagccattggaaaaacttttttctttggaaataataaggtttttgatagat

SEQ ID NO: 15841 - DNA, 387 bp, Homo sapiens
ggcacgagggcagttagggctgccatgtgctgggagctgtgtgtctgctctccttcgtccgctcccccagggcagtgtggtagcacatcccattgtagagatgagggcaccgaggcttcctggagcataccacctggtcccgttcatgagtggtggcaaagctagcactctcacttgtccattctgccttcctggagaccagtgggatgggtcagtacagcccaccacaccattagccccaggaacataaggctgtggctagacagcaggggtctcaggttcatacatgaggactggcttgtccttgagcacccactcacctgtctatgtggggaggaatcctacaataggtcaccatggcaggctggggcttgctgaccctgcccc

SEQ ID NO: 15842 - DNA, 395 bp, Homo sapiens
ggcacgagcagacctccattacctccatccctgttggattatttaaagaaagcctcagacagtaagggctttttttaaaagaataaaatgacttggtttgcgcttggaagcaggggaagcattcagatgagcggtttctgcattaaccctgcctatcacgcatctcgtgtcctgtgtggctggcgagccccccttggaaggttctggtgcttcagctggctcctgcagagtccaccccgcctcgtggtgggaatgcagagccctttgctttccttcttgccgcctgcttcctgttcctggggacccgctgggcctttggtctgcatcccctggccaggtccctcagggctgatgcgcgtagaaggactttgagcagtggtggcagcacttgccct

SEQ ID NO: 15843 - DNA, 388 bp, Homo sapiens
ggcacgagggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacaga

SEQ ID NO: 15844 - DNA, 397 bp, Homo sapiens
ggcacgagcaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccg

SEQ ID NO: 15845 - DNA, 397 bp, Homo sapiens
ggcacgaggcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtat

SEQ ID NO: 15846 - DNA, 399 bp, Homo sapiens
  misc_feature 399: n = A,T,C or G
ggcacgaggtcaccccttttgcctccatcctcaaagacctggtcttcaagtcatccgtcagctgccaagtgttctgtaagaagatctacttcatctgggtgacgcggacccagcgtcagtttgagtggctggctgacatcatccgagaggtggaggagaatgaccaccaggacctggtgtctgtgcacatctacatcacccagctggctgagaagttcgacctcaggaccactatgctgtacatctgtgagcggcacttccagaaggttctgaaccggagtctattcacaggcctgcgctccatcacccactttggccgtcccccctttgagcccttcttcaactccctgcaggaggtccacccccacgtccggaagatcggagtgtttagctgtggcn

SEQ ID NO: 15847 - DNA, 402 bp, Homo sapiens
ggcacgaggctacttcgctcgcaaggattagtactgcaaggagtatgtggcagctgtcctggagcatatcgagaacaagaacctcatgccacctcttctagtggtgcagaccctggcccacatctccacagccacactctgcgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagatgccctcagtccacttcctgtgtggccactccttccaccaacactgctttgagagttactcggaaagcgaagctga

SEQ ID NO: 15848 - DNA, 384 bp, Homo sapiens
  misc_feature 320, 321, 322, 323, 324, 325, 326, 327, 328, 329, 330, 331,332, 333, 334, 335, 336, 352, 353, 354, 355, 356, 357, 358,359, 360, 361, 362, 363, 364, 365, 366, 367, 368, 369, 370,371, 372, 373, 374, 375: n = A,T,C or G
ggcacgagagcaactcaggcctgctgggttaactgcttacaccattttccttcccctcctcttccttgccttcgacactcttaacctggaaaaagcactaatttgtcctccatatctgtggttttgtcatttggaaaggttgtagaaatcctagagtatgtgaccttttaagatgcactttttagaaaactcaacatgttgctcttgtgttaatagtttgttctttttagtgttcggtattctcttgtgtggtcatgccccagtttatttaaccatcccatagatgtttattttcccttgtaaagttggttagcatgtannnnnnnnnnnnnnnnngggaaactcattctcnnnnnnnnnnnnnnnnnnnnnnnntgccccttg

SEQ ID NO: 15849 - DNA, 384 bp, Homo sapiens
ggcacgagggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaggtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtca

SEQ ID NO: 15850 - DNA, 379 bp, Homo sapiens
ggcacgagcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtacgtcgtaaaccaatatt

SEQ ID NO: 15851 - DNA, 368 bp, Homo sapiens
ggcacgagacccggtccaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccacccgctgacagcccaaggtgcggctgacacctgcgagggctgggggccgggactcggaagctgcgatgacccggtgcccac

SEQ ID NO: 15852 - DNA, 375 bp, Homo sapiens
ggcacgaggtctcacagagcgagaaggtgtcaggagcagcccatttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctgtaatgaatt

SEQ ID NO: 15853 - DNA, 368 bp, Homo sapiens
ggcacgaggccgtgcagagcctgtatggtaagcccctagggggctcaaaggccggccagctcccaggaaagatgtgcactgactttgaaacctgggactcctacagcccccaaggaaggcgccctgaaacgcagggccctaaatactgccactcttccttcgatgccatcactgtagacaggcaacagcaactgtacatttttaaagggagccatttctgggaggcggcagctgatggcaacgactcagagccccgtccactgcaggaaagatgggtcgggctgccccccaacattgaggctgcggcagcgtcattgaatgatggagatttctacttcttcaaaggggggcgatgctggaggatccgg

SEQ ID NO: 15854 - DNA, 436 bp, Homo sapiens
ggcacgagaaggggctggggtgggctcaggcaaggcctggggccctggccttcttcctggcagggggaggcaggggactgtgcaggggctcagggaggcctcccccacctgccccctgaccacacccactctgatgaggctcatggcctcctggcaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaatgccagcttcctcgccagccccacggagctgccctcggccacacactcaggccaggcgaccgccgtgctcagcctcctcatcat

SEQ ID NO: 15855 - DNA, 435 bp, Homo sapiens
  misc_feature 387: n = A,T,C or G
ggcacgagacagaccctttcttcctaaaggctttgtggcatcagacacataaagggtatatgtagtgtggagcactaaccatggcagggtaatttattccaggcacagagtcataattctggaaacatctagactcactgcattaacagagcattttgtttctaaagtagacctcttatgtcatccagatttcactcattctgaccacagccaggaagctgagggtgaagccagaattagctgaaacccaccaagagctgcatagagcacgtttagctagagtaggagtttgcagtgctcatatgggaaatgctgctgctatacttttaggaatttctgagtgcaatttagaaacatctagcacacttgaaacactgcgtatcattntcctcactcatgaatatagtcatcagaattcataaatagtttacctga

SEQ ID NO: 15856 - DNA, 437 bp, Homo sapiens
  misc_feature 287, 424, 436: n = A,T,C or G
ggcacgagattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggngctggcccctgggaagaactgggtctctgggctccctatgcactgcccaaactggctgagccaggagtggggcaggaagtgagagtcaaggcccagcaaaaggagggggaggagctgccaattataaccttgtgganggaccggtttgng

SEQ ID NO: 15857 - DNA, 434 bp, Homo sapiens
ggcacgagaagaaactgtgaagggaaagaaaggtttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtg

SEQ ID NO: 15858 - DNA, 323 bp, Homo sapiens
  misc_feature 57, 58, 59, 60, 61, 62, 63, 64, 65, 66, 67, 68, 69: n = A,T,C or G
gggtctctcgcccccctctctctcttttgtgtgtctctctctctgtcccgtgtgtgnnnnnnnnnnnnntctctctatatctcgcgcgcgcgcactcccgtgtgtgtgtgtgaccccgccccctcatgcgctctctcatttgtggagagagagaccgctatctatctctctctcccccgccctatacacatctccctctctgtgaaagagacgtgtgtgtgtctccacaccccttgggcgcgcgcgcgccaccccctctcctggggggggtgtcctctctgtatatatatatgtgcacacacgcgcgcgcgctctgtgttgtt

SEQ ID NO: 15859 - DNA, 412 bp, Homo sapiens
ggcacgagaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgactttta

SEQ ID NO: 15860 - DNA, 405 bp, Homo sapiens
  misc_feature 46, 47, 48, 49, 50, 51, 52, 53, 54, 55, 56, 57, 58, 59, 60,61, 62, 241, 242, 243, 244, 245, 246, 247, 248, 249, 250,262, 263, 264, 265, 266, 267, 268, 269, 270, 271, 272, 273,274, 275, 276, 277, 278, 279, 290: n = A,T,C or G
cgttgctgtcggtcagcaatgaaataaatatcttgtagaatgttcnnnnnnnnnnnnnnnnngaaccctcgggggcccttttttcccgaaacccccactggaaaaaaacccttggggggttggcaaaaccccccaataaaagggggggaaaaaaaggctttttttggaaaaatgggggggtctttgctttttttggacccctttaaagcggggaaaaccaggttaaccccccccaggggcnnnnnnnnnngtttcagggccnnnnnnnnnnnnnnnnnnttttttccctntctcccttctgtctcgccctgctgcgctgccgttttctcgttccactccccccgtttttgtactccccccgtgccgttgagcgtccaccctattctttcgcgccggtgcaccccc

SEQ ID NO: 15861 - DNA, 400 bp, Homo sapiens
  misc_feature 241, 287: n = A,T,C or G
ggcacgagattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggccttgaaagaagatgacgaggaggaggagagagggaagtggggtggatgaggagcangctgacacctgggctgccctcaatccccaaggccagggagggcggngctggcccctgggaagaactgggtctctgggctccctaggcactgcccaaactggctgagccaggagtggggcaagaaatgagagttcaggcccaacacaaggagggggaggg

SEQ ID NO: 15862 - DNA, 402 bp, Homo sapiens
ggcacgagattaggacccttccttggctcaggggtgagaaagagcttggggaacgcttggcattatggagggctggaaggggctcaaccccgatttggagagaagtttgggatggagtgggcgagagattgatagagcgagcaggaaaagaggtcttggagcctgggactgatggtggataaggcctggaaagaagatactaggaggaggagagagggaagtggggtggatgaggagcaggctgacacctgggctgccctcaatccccaaggccagggagggcggggctggcccctgggaagaactgggtctctgggctccctaggcactgcccaaactggctgaaccaggagtggggcaagaagtgagagtcaaggcccaacaaaaggagggggaggagct

SEQ ID NO: 15863 - DNA, 401 bp, Homo sapiens
ggcacgagctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgact

SEQ ID NO: 15864 - DNA, 397 bp, Homo sapiens
  misc_feature 98, 99, 100, 101, 102, 103, 104, 105, 106, 107, 108, 109,110, 111, 112, 113, 114, 115, 116, 117, 118, 119, 120, 121,122, 123, 124, 125, 126, 127, 128, 129, 130, 131, 132, 133,134, 135, 136, 137, 138, 139, 140, 141, 142, 143, 144: n = A,T,C or G
  misc_feature 145, 146, 147, 148, 149, 150, 151, 152, 153, 154, 155, 156,157, 158, 159, 160, 161, 162, 163, 164, 165, 166, 167, 168,169, 170, 171, 172, 173, 174, 175, 176, 177, 178, 179, 180,181, 182, 183, 184, 185, 186, 187, 188, 189, 190, 191: n = A,T,C or G
  misc_feature 192, 193, 194, 195, 196, 197, 198, 199, 200, 201, 202, 203,204, 205, 206, 207, 208, 209, 210, 211, 212, 213, 214, 215,216, 217, 218, 219, 220, 221, 222, 223, 224, 225, 226, 227,228, 229, 230: n = A,T,C or G
tgcatattagacattcttaacagggcggcagtctagtgttgaaagttttatttttccatttttcttttaagcaaattttttttaaaaaattctgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgatttaattcttttatttatcataaggggtttaattcctgaagtaaaggtttgcacctattaaacttaaaactgccaaatgatttttgttcttttatgtgcgcgatagaaatacaaagaatggagtggccacctcctccctttcaagctagggcagcagggacg

SEQ ID NO: 15865 - DNA, 398 bp, Homo sapiens
ggcacgagaagaaaggtttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagggagcaacttagggaaaaaaacttcccaaggaggaggggagcagggaaa

SEQ ID NO: 15866 - DNA, 394 bp, Homo sapiens
ggcacgagcagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcagggg

SEQ ID NO: 15867 - DNA, 391 bp, Homo sapiens
ggcacgagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaaaacgggagcttactggctcacggctgatgccccagacagcctcgaggatctgcaggtccccagacaccaagcctgggtgctctccagcagacggc

SEQ ID NO: 15868 - DNA, 392 bp, Homo sapiens
ggcacgagattctcagtacactaaacacttgttaagagtgttgttaagagccagagtgagtatcatgtgggacacagaccctttcttcctaaaggctttgtggcatcagacacataaagggtatatgtagtgtggagcactaaccatggcagggtaatttattccaggcacagagtcataattctggaaacatctagactcactgcattaacagagcattttgtttctaaagtagacctcttatgtcatccagatttcactcattctgaccacagccaggaagctgagggtgaagccagaattagctgaaacccaccaagagctgcatagagcacgtttagctagagtaggagtttgcagtgctcatatgggaaatgctgctgctatacttt

SEQ ID NO: 15869 - DNA, 392 bp, Homo sapiens
  misc_feature 392: n = A,T,C or G
ggcacgaggaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctcn

SEQ ID NO: 15870 - DNA, 386 bp, Homo sapiens
ggcacgagaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacag

SEQ ID NO: 15871 - DNA, 295 bp, Homo sapiens
gcgctctcttcacacacaaaagatatatatatagaaagggagtgtggatatcccccctaaatatgtgagcgtgtctctctcgaccgtctcccccagagaaaatatctctagagagagcacaagtgtgttctctgtgtcttgtgtgtgagaaaaaataagtgcccgcgcacacatagatttttatatcgctcccccccgcgcctttatatatgtttttggtgtgtatatatattttatacaaaaacatgtttctttttgaggccccttacaacaaaaattttgttctttttgaacc

SEQ ID NO: 15872 - DNA, 383 bp, Homo sapiens
ggcacgaggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggca

SEQ ID NO: 15873 - DNA, 385 bp, Homo sapiens
  misc_feature 352: n = A,T,C or G
ggcacgagcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacggnggatcccaccctcctagaactcggaagagatgg

SEQ ID NO: 15874 - DNA, 374 bp, Homo sapiens
ggcacgagcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgagg

SEQ ID NO: 15875 - DNA, 425 bp, Homo sapiens
ggcacgagcccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctct

SEQ ID NO: 15876 - DNA, 396 bp, Homo sapiens
ggcacgaggagcaaggaagtaatattgtcatatttgcagttgagaatgatccctgagtctcggttttcttatctatgaaatgaggctaagaataataaaatagagaattaaatgagataatgcctgtaaacagtgcctggcatatagcttattattcatccagctaagaggcccttccatatgtgaagctttgctctgtgaggtctgtattacaatcacattcagttatagctaattatttacttatgtagctatctctgaaacttagaaatgaaatcatcgaggaaaaaggccatttcttgatcctgtctgtgttccctgttcccagcataaagcctaacacgtattaggctaatgtcaccgagcaaagaaagcatcaaagtggcgggtcgggcc

SEQ ID NO: 15877 - DNA, 267 bp, Homo sapiens
tctctagagacacacagagagggtgagcggctctctcacacgcaccccagagtcaggcgcgcacgctctctctctctctctctatccctcagaaagatcttcctttttccctctccctgtgatgtagtgagagtttgatgcatatttgtccgtgtccgcccccacagaccctctacctctctgtgctggccctatcttgtgtgtatgtttccctctctctctcgcgcgcccacacgatgtactttctttatatgtagtgccagttcc

SEQ ID NO: 15878 - DNA, 396 bp, Homo sapiens
ggcacgagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcc

SEQ ID NO: 15879 - DNA, 284 bp, Homo sapiens
  misc_feature 184, 185, 186, 187, 188, 189, 190, 191, 192, 193, 194, 284: n = A,T,C or G
tgggctgtctcgcccctcctccctctctctttgtactcacagtgaaaaattatagtgttcgcgtgcggggcgcgctctttacttttttttctctctcacacatatttatatatatagagagagcctccgagcgctctgcccccctcctctctctctctcttcacgtgtgtgcatcacccactcnnnnnnnnnnnctcttccagagatacgggggcttgtttcctccgctctctctcacacgtctgtgcagcagaggactatttttttctttcccccgcgtctcn

SEQ ID NO: 15880 - DNA, 440 bp, Homo sapiens
  misc_feature 440: n = A,T,C or G
ggcacgagggattgcagtcagcactttctgaatgttttcacacagtatgcaaagcttacatcataccaaggagtggagagttgaagtttcctcccagtgactccagtgacagaccacacctagaaagcgtttctcttcctgagtatttcaaaaagatgtaaaagagctggggagagtatgggaagaaacaatacaggattgcctttaattaattaagaattgcctcctgataaaaggaaaaagaaattaatgctggagtatggaggggtgataaccttaaagattataaatatttgttgtctataaatacttataaattataaacacaatataattaaaattagaacatcaggaaaagaattaaaatcctcaggttgcaaaaccaaaatgttaaccaaaacaaatactcatgagattcaactttgttcacctatagaaan

SEQ ID NO: 15881 - DNA, 439 bp, Homo sapiens
ggcacgagtgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactg

SEQ ID NO: 15882 - DNA, 392 bp, Homo sapiens
ggcacgaggagacagagaagtttggccagggggtccaccatactgctggtcaggttgggaaggaggcagagaagtttggccaggtggggaaggaggaagacagagtggtccaaggcctccatcatggcgttagtcaggctggaagggaggcggggcagtttggccacgacattcaccacacagcagggcaggctgggaaagagggagacatagcagttcatggtgtccaacctggggtccacgaggccgggaaggaggcagggcagtttggccagggagttcaccatacccttgaacaggccgggaaggaagcagacaaagcggtccaagggttccacactggggtccaccaggctgggaaggaagcagagaaacttggcccaggggtcaac

SEQ ID NO: 15883 - DNA, 394 bp, Homo sapiens
ggcacgagcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctg

SEQ ID NO: 15884 - DNA, 432 bp, Homo sapiens
acacccacttgtttgaggacaccatcgattcgaattcggcacgagcctagccagcccctgacgtgccttacaggagttcttccagacacgccaaaagtgacttggactcaaagttaaaggcaaacctgcagaaaatgatgttaagcttgtagctctcaaactgaaaccacatactaatatcatgaggatggcatctcgagaggagagcttggaagatgtcttaggtccaccccctgacaatgatgatgttgttaatgactttgatattgaagatgaagtagttgaagtagaaaatagggaagaaaacctactgaaaatttctcgcagagcgaaagagtacaaagtggaaattttgaatcctcccagggaagggaaaaagcttttggtgctagatgttgattatacattatttgaccacaggtcttgtgcaag

SEQ ID NO: 15885 - DNA, 395 bp, Homo sapiens
ggcacgagccctttactcctctacccaagatcttgcttgtttctttctaagttgcctctctatctagcttgcaggatttgagttgaggaaaacacagacttccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgc

SEQ ID NO: 15886 - DNA, 487 bp, Homo sapiens
  misc_feature 442: n = A,T,C or G
tgctcttttgatgatgccatcgattcgaattcggcacgagcagctagctcagttcaaggtggaaatggcttaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctggtttttgcagntcctcctcagatcttagcctcctggtgggcccctcttttcagagc

SEQ ID NO: 15887 - DNA, 365 bp, Homo sapiens
  misc_feature 365: n = A,T,C or G
ggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaan

SEQ ID NO: 15888 - DNA, 376 bp, Homo sapiens
  misc_feature 81, 82, 83, 84, 85, 86, 87, 88, 89, 90, 91, 92, 93, 94, 95,96, 97, 98, 99, 100, 101, 102, 103, 104, 105, 106, 107,108, 109, 110, 111, 112, 113, 114, 115, 116, 117, 118, 119,120, 121, 122, 123, 124, 125, 126, 127, 128, 129, 130: n = A,T,C or G
  misc_feature 131, 132, 133, 134, 135, 136, 137, 138, 139, 140, 141, 142,143, 144, 145, 146, 147, 148, 149, 150, 151, 152, 153, 154,155, 156, 157, 158, 159, 160, 161, 162, 163, 164, 165, 166,167, 168, 169, 170, 171, 172, 173, 174, 175, 176, 177: n = A,T,C or G
  misc_feature 178, 179, 180, 181, 182, 183, 184, 185, 186, 187, 188, 189,190, 191, 192, 193, 248, 249, 250, 251, 252, 253, 254, 255,256, 257, 258, 259, 260, 261, 262, 263, 264, 265, 266, 267,268: n = A,T,C or G
ggcacgaggagatttcccggcgggtcccggcctctgcgtgcacgcgcctgcgtgctcgcgctcgcggttctggcgctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggcagcagtggcctgcctgaagcagccactgccaagaatctagctgcagtnnnnnnnnnnnnnnnnnnnnncatgctccacacagccaccggaagccaagaacgcaccctcctgggtacagctgcaagccgccagccgaggctgcggacccgggcctccctggtgctctgggggttggg

SEQ ID NO: 15889 - DNA, 399 bp, Homo sapiens
  misc_feature 399: n = A,T,C or G
ggcacgaggggtgacagagcggctggcgcatgctcagtagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactcttccgccgcccaaaccttcagcttcttctgcttgaccctccagccccgn

SEQ ID NO: 15890 - DNA, 402 bp, Homo sapiens
ggcacgagggcagttcagtatcgatggacagatcttcctactctttgactcagagaagagaatgtgggcaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagaatcctttagagtgacaggttaaagatgataccaaaaagcccctgtgagcacggtcttgatcag

SEQ ID NO: 15891 - DNA, 270 bp, Homo sapiens
  misc_feature 190, 191, 192, 193, 194, 195, 196, 197, 198, 199, 200, 201,202, 203, 204, 205: n = A,T,C or G
ctctctttctttctccctccccccccgggcgcgctcatttatctcgtctcttatgtctctctctctgtgtctgtgacagacacactctttttcatatagcgcgctcccttttctttgctctcggggggggtctctctgtacgcgtgtgttctctctccagtgagtgtgcacgcctaggtgagagagagtnnnnnnnnnnnnnnnntgtgtgtgaattttatatatttctatatctctcactctctgggtgtcacactctccgtgtgtggg

SEQ ID NO: 15892 - DNA, 404 bp, Homo sapiens
  misc_feature 353, 354, 355, 356, 357, 358, 359, 360, 361, 362, 363, 364,365, 366, 367, 368, 369, 370, 371, 372, 373, 374, 375, 376,377, 378, 379, 380, 381, 382, 383, 384, 385, 386, 387, 388,389, 390, 391, 392, 393, 394, 395, 396, 397, 398, 399: n = A,T,C or G
  misc_feature 400, 401, 402, 403, 404: n = A,T,C or G
ggcacgagaaccctcccaggctaagccccaatttggggctcgcctgccctgcatcagggagacatgtcagctgaggagtaattgaccagatttctgctttagaaatatggcagtggaggcaggagatggcatctgaggcccaggctggggagaagggtgctgggatgagaacctggagttcagaccagggaagggatgagagcctaagaagaggagctctcaccctgagacaggctggtgcaggagtctgctcgatccaggcctgggtccctggttccctctgagcttgggaggactatgtgagacagaacaggaccaggggcctgcattcccccttgtattattcatcttcnnnnnnnnnnnnnnnnnnnnnnnnnnnnnnnnnnnnnnnnnnnnnnnnnnnn

SEQ ID NO: 15893 - DNA, 389 bp, Homo sapiens
  misc_feature 389: n = A,T,C or G
ggcacgagaagtcactcaacctctctgagccttttcttcacctataaagtggggatagtaactacctaccttatggaagcatatgaggattgtgtgaaatcatccatgtagcccttccaccgccacgtggagtttggcatggagcagtttctaaatggaagtcatcttgatcaggtgggctgccaacctctctgagcctcagtttgctcttctagggaatggggacaatgcaatgggaatctgaggattgtgtgaaattgtgcaaatgcatgaatgtgggctgggatagtaaaagggagggccccggagcagcccacctggggtcctatctagtggacgcgcccggtgcccacccattgctgtgatgccagcagcccactgcaagcatn

SEQ ID NO: 15894 - DNA, 384 bp, Homo sapiens
  misc_feature 384: n = A,T,C or G
ggcacgagctgccacctctagaaagctgctttcttctatcaccgcttgcccttgaattattccctgaatgaagccaagaaccctcccaggctaagccccaatttggggctcgcctgccctgcatcagggagacatgtcagctgaggagtaattgaccagatttctgctttagaaatatggcagtggaggcaggagatggcatctgaggcccaggctggggagaagggtgctgggatgagaacctggagttcagaccagggaagggatgagagcctaagaagaggagctctcaccctgagacaggctggtgcaggagtctgctcgatccaggcctgggtccctggttccctctgagcttgggaggactatgtgagacagaacagn

SEQ ID NO: 15895 - DNA, 292 bp, Homo sapiens
  misc_feature 115, 116, 117, 118, 119, 120, 121, 122, 123, 124, 125: n = A,T,C or G
ggtgtctctctctcgggggggccccccctctctctatttttttttgcgcgcacactcactctctctctcttttttcccccgcgcgcgcgcacgcgctttttttttcttttttctnnnnnnnnnnnactctctctcttttctcttttgtgtgggggtctccggcgcgcttctctctctctctctcacccacagacactctctctgtgtgcgcacctctctctctcggggggccggatctctctcccccctctctatctctgttattttgggggtcccctccgcgctctcctca

SEQ ID NO: 15896 - DNA, 400 bp, Homo sapiens
ggcacgaggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctgtgagtttcaaccaggtgatgtgatgtttgtgacaggatttggagcactgaaaaatgatggttac

SEQ ID NO: 15897 - DNA, 332 bp, Homo sapiens
  misc_feature 171, 172, 173, 174, 175, 176, 177, 178, 179, 180, 181, 182,332: n = A,T,C or G
tatatagacaccccgccttttttctctctctctctatacacacaccgtctctctcccccgtgtgtctctcccctctcttttgctcatacttatatacatctacacacttgtgtgggggactctctctagcgctccctctcttttgtgtgggcgctctcacacacacacacnnnnnnnnnnnnggagactcctttctctgtggagaatatgtgtgcgcaccatctctctctctcttatttttccctcgcgcgcgcgctctgtgagagagactctctgttctcacacatatgatatatatatccctcccctctctcacactcgtgccccgcgcn

SEQ ID NO: 15898 - DNA, 407 bp, Homo sapiens
  misc_feature 342, 374: n = A,T,C or G
ggcacgagaactccggctacgtttgctgtcccaacaaatagaccagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcanaatggagtcgctctggttcgaacgcctctgancagtgtgtacctacgtgtcaggcccatccttcc

SEQ ID NO: 15899 - DNA, 406 bp, Homo sapiens
ggcacgaggaaagacccacgtgctgcctcatgtggccgacatcctcagcaagtcttgcccggcacccaggtgagcctctggtgggggtgggtagtcaccactcggctctggaggatgaggcctgggccataatccagttgcagggacggatgatctccatctcgaaggtcccagaggtaactgcgttgtcccatcctccaggcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaaaatgtggagggcgtaaagggggggcccagaaagaaagtgtcccacacaacctctgtttgcacatgg

SEQ ID NO: 15900 - DNA, 380 bp, Homo sapiens
ggcacgaggagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggt

SEQ ID NO: 15901 - DNA, 410 bp, Homo sapiens
  misc_feature 344, 360: n = A,T,C or G
ggcacgagctgagcaggacttagaggaactccggctacgtttgctgtcccaacaaatagaccagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttntccagccctcactcanaatggagtcgctctggttcgaacgcctctgacaagtgtgtacctacgtgt

SEQ ID NO: 15902 - DNA, 394 bp, Homo sapiens
ggcacgagactccggctacgtttgctgtcccaacaaatagaccagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcag

SEQ ID NO: 15903 - DNA, 428 bp, Homo sapiens
  misc_feature 11, 12, 13: n = A,T,C or G
ttcggcacgannnaagaagaggccctcagagatctgacagcctatgagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcc

SEQ ID NO: 15904 - DNA, 432 bp, Homo sapiens
tctcatggaggaacccatccattcgaattcggcacgaggatcaactggctatcatatctgtttaatacatttactggagccagaaacctaggccatcatcgaacgccagcccttggtctgagcctgcggctgtagatgtggaactcacagcatatgcattgttggcccagcttaccaagcccagcctgactcacaaggagatagcgaaggccactagcatataggcttggttggccaagcaacgcaatgcatatgggggcttctcttctactcacgatactgtagttgctgtacaagctcttgccaaatatgccactaccgcctacgtgccatctgaggagatcaacctggttgtaaaatccactgagaatttccagcgcacattcaacatacagccagctaacagattggtatttcagcaggataccctgc

SEQ ID NO: 15905 - DNA, 373 bp, Homo sapiens
ggcacgaggcaggacctcctctcccagatcgcccagctgcaggaggagaacaagcagctcatgaccaacctctcccacaaggatgtcaacttctcagaggaggagttccagaagcatgaaggcatgtcagagcgggagcgacaggtgatgaacaagctgaaggaggtggtggacaaacaacgcgacgagatccgcgccaaggacagggagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagc

SEQ ID NO: 15906 - DNA, 392 bp, Homo sapiens
ggcacgagagctgaccgagatggacgttttctacatcgcgtcgcttgtgggccacgagttcgagcgggtcattgaccagcacgggtgttaggccatcgcgcgcctcatgcccaaggtcgtgcgcgtgctggagatcttggaggtgctggtcagtcgcctccacgtcgcgcccgagctggacgatctgcgcctggagcaggacctcctctcccagatcgcccagctgctggaggagaacaagcagctcatgaccaacctctcccacaaggatgtcaacttctcagaggaggagttccagaagcatgaaggcatgtcagagcgggagcgacaggtgatgaagaagctgaaggaggtggtggacaaacaacgcgacgagatccgcgccaaggacg

SEQ ID NO: 15907 - DNA, 434 bp, Homo sapiens
gatcccatccattcgaattcggcacgaggattgattcaccttcacctgtgctgcactccagctgacccaagtaggaagccggacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaagg

SEQ ID NO: 15908 - DNA, 385 bp, Homo sapiens
ggcacgaggagagcgcggacacctcctcaacccactgaacaggagtcacagcacgatgaccattcgcaaagcgacccctgccctccatcctgactgctcctcctaagagagatggcaccggccaaaacaggattatgcccccttctgctgcttctgctgctgccgctgagtgtggcagagatcccactcagtgccaaacccaagggcatgacctcatcacagtggtttagaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaaga

SEQ ID NO: 15909 - DNA, 388 bp, Homo sapiens
ggcacgagagaaggcctgcggcaaagagatgagcttattgacaaacatggcttagttataatccccgatggcactcccaatggtgatgtcagtcatgaaccagtggctggagccatcactggtgcgtctcaggaagctgctcaggtcttggagtcaccaggagaagggccattacatgtttggctacgaaaacttgctggagagaaggaagaactactgtcacagattacaaaactgaagcttcagttagaggaggaacgacagaaatgctccatgactgatggcacagtgggtgacctggcaggactgcagaatggctcagacttgcaggtcatcgaaatgcagagagatgccaatagacaaattagcgaatacaaatttaagcttg

SEQ ID NO: 15910 - DNA, 388 bp, Homo sapiens
  misc_feature 363: n = A,T,C or G
ggcacgaggtcactgttgaagagttcaatcttaccagagggccctcagggctgggcttcaacatcgccggtgggacagattaccagtatgtctccaacgacagtggcatctacgtcagccgcatcaaagaaaatggggctgcggccctggatgggcggctccaggagggggataagatcctttcggtaaatggccaagacctaaagaacctgctgcaccaggatgctgaacacctctttcgtaatgcaggctatgctgtgtctctgagagtgcagcacaggttacaggcgcagaatgtacctataggacatcgaggtgaaggggacccaagcggattcccatatttattgtgctggtgcccgnggctggcctctccctggtattcgcg

SEQ ID NO: 15911 - DNA, 390 bp, Homo sapiens
ggcacgaggctgtgtgtctcttttctcaccccagggcctggccatgtcccctttgggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagaggactcgggctctgaactcaacagacgctcctccacgctctcctccagctccatgtccttgtcgcccag

SEQ ID NO: 15912 - DNA, 397 bp, Homo sapiens
ggcacgagaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctggtggttcaggaaccaaactggggaaccccccgacacactacatcccggaggggg

SEQ ID NO: 15913 - DNA, 471 bp, Homo sapiens
  misc_feature 315, 316, 317, 318, 319, 320, 321, 322, 323, 324, 325, 326,327, 328, 329, 330, 331, 332, 333, 334, 335, 336, 337, 338,339, 340, 341, 342, 343, 344, 345, 346, 347, 348, 349, 350,351, 352, 353, 354, 355, 356, 357, 358, 359, 360, 361: n = A,T,C or G
  misc_feature 362, 363, 364, 365, 366, 367, 368, 369, 370, 371, 372, 373,374, 375, 376, 377, 378, 379, 380, 381, 382, 383, 384, 385,386, 387, 388, 389, 390, 391, 392, 393, 394, 395, 396, 397,398, 399, 400, 401, 402, 403, 404, 405, 406, 407, 408: n = A,T,C or G
  misc_feature 409, 410, 411, 412, 413, 414, 415, 416, 417, 418, 419, 420,421, 422, 423, 424, 425, 426, 427, 428, 429, 430, 431, 432,433, 434, 435, 436, 437, 438, 439, 440, 441, 442, 443, 444,445, 446, 447, 448, 449, 450, 451, 452, 453, 454, 455: n = A,T,C or G
  misc_feature 456, 457, 458, 459, 460, 461, 462, 463, 464, 465, 466: n = A,T,C or G
ttacggcgcgtttgttaggggaccccaccgattcgaattcggcacgagctctttttattttcgctgatatctttcttttactaaatgccaccatccttacctgttcgggtgtctgcgtgcctaatttttcctggctgttacacaagaacccggattttagttgaactctggagcaaaaatcctgcatcatttgtaggtgggtgtcattgtgactggctgctacctccccatgagtcttctaaaataaaacctgcaaattcacatcttccccatgcttccagagaatgcatattcttcctttgaaaaaagaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatg

SEQ ID NO: 15914 - DNA, 403 bp, Homo sapiens
  misc_feature 59, 60, 61, 62, 63, 64, 65, 66, 67, 68, 69, 70, 71, 72, 73,74, 75, 76, 77, 78, 79, 80, 81, 82, 83, 84, 85, 86, 87,88, 89, 90, 91, 92, 93, 94, 95, 96, 97, 98, 99, 100, 101,102, 103, 104, 105, 106, 107, 108, 109, 110, 111, 112, 113: n = A,T,C or G
  misc_feature 114, 115, 116, 117, 118, 119, 120, 121, 122, 123, 124, 125,126, 127, 128, 281, 286, 287, 288, 295, 305, 326: n = A,T,C or G
ggcacgaggtacagacatctagttggcaggagccaaagatgttgccaaacatgtagtannnnnnnnnnnnnnnnnnnnnnnnnnnnnnnnnnnnnnnnnnnnnnnnnnnnnnnnnnnnnnnnnnnnnngagtagaggatgcctggtatgaggcaatatttgggatagggaagggaagcttgggattttagctacgtagagacacttgaaaattggagggaggaaaggagtgggtggctttggagatgttctggaatatgtgaatgaggggagtggaggggncctgnnngctctgnggaaggccangcccggtttcctgtctttcancctcttccaggaaaattacgggcagaaagaggctgagaaagtggtcccggggaaggcgctttatgaagagcttggtg

SEQ ID NO: 15915 - DNA, 316 bp, Homo sapiens
  misc_feature 267: n = A,T,C or G
ccgcttaaaggcgccttcttttaatgcaatcattttgaacatgtgcgacagtcgagaatactaattggatcaatcttgatatactctacctaaagacagtctagaaacctgggggagaaagaactcacggcacaaaacattgggccgagaacggaattctctgtaagcctagttgctgaaacttcctgctgtaaccagaagccagttttatctatcggctactgaaacacccactgtgtgttgctcactccctcactcaccgaacanaacctgctacctccgcatgaatctactagtgccgataaactatatcaga

SEQ ID NO: 15916 - DNA, 419 bp, Homo sapiens
ggcacgagatatcagtcaagggctcttcaagacacagcagaaacctcaccgggcctcgggctgcctcccactgggtcccatggccaccaccttgaccttggaaagctctgttatatggaaggtagggaggacactatttccctcaactacttctagtaaaaagctcagttctctccccagcagcaagagggcacctgtgaacacctgagtcacagcgcattcctcctctgcttagaacattcgatggctcccaccttacttgcagtaaatgctgaggtccttcctgtggcccccggggccctgcatgatctgatccatcccttacctaccctcatctctccactggcctccccacacttgctcccctccggacactctggactacttgctgctatctgaacataccaggcccctgcccc

SEQ ID NO: 15917 - DNA, 434 bp, Homo sapiens
  misc_feature 370: n = A,T,C or G
ggcacgagggggcctccaccggtgactcgggcctggattccacggccatggcctctgccgctgcggcgcagggactgtccggggcgtccgcggacaccctgcccttccacctccagcagcacgtcctggcctctcagggcctggccatgtcccctttcggaagcctgttcccttacccctacacgtacatggacgcagcggcggccgcctcctctgcggcagcctccagctcggtgcaccgccaccccttcctcaatctgaacaccatgcgcccgcggctgcgctacagcccctactccatcccggtgccggtcccggacggcagcagactgctcaccaccgccctgccctccatggcggcggccgcggngcccctggacggcaaagacgccgccctggccgccagcccggcctcggaggcagtggactcggcg

SEQ ID NO: 15918 - DNA, 425 bp, Homo sapiens
ggcacgagaaagcactcagcctggggaatgaactctgccacaatgatgatggctgtgaccactccccgcagagagttcttgaagaggagctcggcagggactggcaggccaaggtggcctccttggaggaggtgccctttgccgctgcctcaattgggcaggtgcaccagggcctgctgagggacgggacggaggtggccgtgaagatccaggtgagaggggaggctgggcagggtaggggcgggcaccctgctagcccagagaagtgactcccaccttctctccctcccttctccctttacagtaccccggcatagcccagagcattcagagcgatgtccagaacctgctggcggtactcaagatgagcgcggccctgcccgcgggcctgtttgccgagcagagcctgcaggccttgcagcagg

SEQ ID NO: 15919 - DNA, 395 bp, Homo sapiens
  misc_feature 56, 57, 58, 59, 60, 61, 62, 63, 64, 65, 66, 67, 68, 69, 70,71, 72, 73, 74, 75, 76, 77, 78, 79, 80, 81, 82, 83, 84,85, 86, 87, 88, 89, 90, 91, 92, 93, 94, 95, 96, 97, 98,99, 100, 101, 102, 103, 104, 105, 106, 107, 108, 109, 110: n = A,T,C or G
  misc_feature 111, 112, 113, 114, 115, 116, 117, 118, 119, 120, 121, 122,123, 124, 125: n = A,T,C or G
ggcacgagcagacatctagttggcaggagccaaagatgttgccaaacatgtagtannnnnnnnnnnnnnnnnnnnnnnnnnnnnnnnnnnnnnnnnnnnnnnnnnnnnnnnnnnnnnnnnnnnnngagtagaggatgcctggtatgaggcaatatttgggatagggaagggaagcttgggattttagctacgtagagacacttgaaaattggagggaggaaaggagtgggtggctttggagatgttctggaatatgtgaatgaggggagtggaggggtcctggaggctctggggaaggccaagcccgttttcctgtctttcaacctcttccaggaaaattacgggcagaaggaggctgagaaagtggcccgggtgaatgcgctatatgacgagct

SEQ ID NO: 15920 - DNA, 307 bp, Homo sapiens
  misc_feature 307: n = A,T,C or G
agtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcan

SEQ ID NO: 15921 - DNA, 312 bp, Homo sapiens
agtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagc

SEQ ID NO: 15922 - DNA, 415 bp, Homo sapiens
  misc_feature 415: n = A,T,C or G
ggcacgagcaggagcagctggcaagggagaaggacacggtgaagatgctgcaggaacagctggaaaaggcagcgcgtgcctggcgccaaagcagggcgggaggagtcgagctgccgggagccccggggaggcaggaccgggagaggcagagctgggcggagtcgtcaagctgctgggagcgctgggctgggagccccaggggaggcagagctgggcggaggtagtggggacagagacttcctaacgagggcttcagcccacccggcccaccacccacccttctggggttcccttgctgggaagcgagtgtctgatccccctgctggcccaggtcctcactttgcacctgtgtgggccccttagccagtgctccagcccctgccctgcaggatgatggtttcccctcagctcccan

SEQ ID NO: 15923 - DNA, 396 bp, Homo sapiens
agaaagggtgagtgaggtgctgtcctggggttctccaagtttgagagcatggatgcatgtggtttgaagctgaagtgggcctgggggaatgggttgaaggcagaagcaaccagtttggagggaaggcatttggatatccagccctttctctgtggccttggccctgggtctgtcctgttacccccacccatacctgtctgctgcgcactctgtgcttctgtagcattctcgcttctggcctttaaagttggcaaggggaggttaataagcacctaggtggctgagtgtctctgtcttctggcttgttcacaggacttcgagtaagaaggtgatttacagccagcctagtgcccgaagtgaaggagaattcaaacagacctcgtcattcctggtgtg

SEQ ID NO: 15924 - DNA, 431 bp, Homo sapiens
  misc_feature 2, 3: n = A,T,C or G
gnnggagggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggc

SEQ ID NO: 15925 - DNA, 404 bp, Homo sapiens
  misc_feature 404: n = A,T,C or G
ggcacgagcaggagcagctggcaagggagaaggacacggtgaagaagctgcaggaacagctggaaaaggcagcgcgtgcctggcgccaaagcagggcgggaggagtcgagctgccgggagccccggggaggcaggaccgggagaggcagagctgggcggagtcgtcaagctgctgggagcgctgggctgggagccccaggggaggcagagctgggcggaggtagtggggacagagacttcctaacgagggcttcagcccacccggcccaccacccacccttctggggttcccttgctgggaagcgagtgtctgatccccctgctggcccaggtcctcactttgcacctgtgtgggccccttagccagtgctccagcccctgccctgcaggatgatggtttcccn

SEQ ID NO: 15926 - DNA, 402 bp, Homo sapiens
ggcacgagatctccctgccttgtgagcagctggccggcggctctgggacaggcggggatgggagggagtctaccgggccactgtagagctggtagctgggagctggagctgtagagttccaggctgggagctggagagccctgggtgagagggaggcctataggggccccgggggacacaccaggcttgagggtagtaggtgctggaggcagagcctggcctgtccagggtgggacctcacgacccaccctgtccggcccccagctcggaggagcttctacgtgtatgcgggcatcctggcactgctcaacctactgcaggggctggggagtgagctgctgtgcttcgacatcatcgaggggctctggtgcgtgggggccgcagggagtctgcctcgtgggg

SEQ ID NO: 15927 - DNA, 402 bp, Homo sapiens
ggcacgagatctccctgccttgtgagcagctggccggcggctctgggacaggcggggatgggagggagtctaccgggccactgtagagctggtagctgggagctggagctgtagagttccaggctgggagctggagagccctgggtgagagggaggcctagaggggccccgggggacacaccaggcttgagggtagtaggtgctggaggcagagcctggcctgtccagggtgggacctcacgacccaccctgtccggcccccagctcggaggagcttctacgtgtatgcgggcatcctggcactgctcaacctactgcaggggctggggagtgtgctgctgtgcttcgacatcatcgaggggctctggtgcgtgggggccgcagggtgtctgcctcgtgggg

SEQ ID NO: 15928 - DNA, 151 bp, Homo sapiens
gccgaatatgaagctacgtccgggtatccgggttccctgtaattgctttctgatccctggtacttagatttgattacctatggaccacattggtagaactactatatgggggaacctcctgattttgggcggtctcaaaaacaaaaaaaac

SEQ ID NO: 15929 - DNA, 404 bp, Homo sapiens
  misc_feature 45, 46, 47, 48, 49, 50, 51, 52, 53, 54, 55, 56, 57, 58, 59,60, 61, 62, 63, 64, 65, 66, 67, 68, 69, 70, 71, 72, 73,74, 75, 76, 77, 78, 79, 80, 81, 82, 83, 84, 85, 86, 87,88, 89, 90, 91, 92, 93, 94, 95, 96, 97, 98, 99, 100, 101,102: n = A,T,C or G
  misc_feature 103, 104, 105, 106, 107, 108, 109, 110, 111, 112, 113, 114,115, 116, 117, 118, 404: n = A,T,C or G
ggcacgagggaacgtggaaggactagactgcctgagtcttctgannnnnnnnnnnnnnnnnnnnnnnnnnnnnnnnnnnnnnnnnnnnnnnnnnnnnnnnnnnnnnnnnnnnnnnnnnttggacctaccccccgagtggtttgccaggggctctcaggccttcggctacagactgagggctgcattatcagctttcctacttttgaggttttgggactttactggctttcttgctcctcaacttgcagatggcctgttgtgggacctcaccttgtgatcatgtacatgagggaaatacacacccctcccagggatgatggaaggttaaggtcctaacacctcctgcacatctgagcagctgcacattgaaccagatagtcctggaatgtgggaaaacagaggcn

SEQ ID NO: 15930 - DNA, 380 bp, Homo sapiens
ggcacgaggggaacgggaagccgggacccagaactcttgtctttcaggataaagtggccagggtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagctcgaggccaggaggagaccccaagctgggagcacatcttgttcacctgctgccacaatcgg

SEQ ID NO: 15931 - DNA, 440 bp, Homo sapiens
  misc_feature 440: n = A,T,C or G
ggcagaggcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccaaagccacgggcccgtgttcctgaccatgtgaagctccn

SEQ ID NO: 15932 - DNA, 396 bp, Homo sapiens
  misc_feature 46, 47, 48, 49, 50, 51, 52, 53, 54, 55, 56, 57, 58, 59, 60,61, 62, 63, 64, 65, 66, 67, 68, 69, 70, 71, 72, 73, 74,75, 76, 77, 78, 79, 80, 81, 82, 83, 84, 85, 86, 87, 88,89, 90, 91, 92, 93, 94, 95, 96, 97, 98, 99, 100, 101, 102: n = A,T,C or G
  misc_feature 103, 104, 105, 106, 107, 108, 109, 110, 111, 112, 113, 114,115, 116, 117, 118, 119: n = A,T,C or G
gcacgaggaggaacgtggaaggactagactgcctgagtcttctgannnnnnnnnnnnnnnnnnnnnnnnnnnnnnnnnnnnnnnnnnnnnnnnnnnnnnnnnnnnnnnnnnnnnnnnnnttggacctaccccccgagtggtttgccaggggctctcaggccttcggctacagactgagggctgcattatcagctttcctacttttgaggttttgggactttactggctttcttgctcctcaacttgcagatggcctgttgtgggacctcaccttgtgatcatgtacatgagggaaatacacacccctcccagggatgatggaagggtaaggtcctaacacctcctgcacatctgagcagctgcacattgaaccagatagtcctggaatgtgggaac

SEQ ID NO: 15933 - DNA, 429 bp, Homo sapiens
ggcacgaggatctgacagcctaggagtgcgtggacaccacctcagcccactgagcaggagtcacagcacgaagaccaagcgcaaagcgacccctgccctccatcctgactgctcctcctaagagagatggcaccggccagagcaggattctgcccccttctgctgcttctgctgctggggctgtgggtggcagagatcccagtcagtgccaagcccaagggcatgacctcatcacagtggtttaaaattcagcacatgcagcccagccctcaagcatgcaactcagccatgaaaaacattaacaagcacacaaaacggtgcaaagacctcaacaccttcctgcacgagcctttctccagtgtggccgccacctgccagacccccaaaatagcctgcaagaatggcgataaaaactgccaccagagccac

SEQ ID NO: 15934 - DNA, 405 bp, Homo sapiens
ggcacgaggcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggcctgccc

SEQ ID NO: 15935 - DNA, 372 bp, Homo sapiens
ggcacgagaaccctgaggcctggctatggtaccaccgggtggtaggtgcccagcgctgccccatcgtggacaccttctggcaaacagagacaggtggccacatgttgactccccttcctggtgccacacccatgaaacccggttctgctactttcccattctttggtgtagctcctgcaatcctgaatgagtccggggaagagttggaaggcgaagctgaaggttatctggctgccagcgggaccaggatggctattactggatcactggcaggattgatgacatgctcaatgtatctggacacctgctgagtacagcagaggtggagtcagcacttgtggaacatgaggctgttgcataggcacctgtggg

SEQ ID NO: 15936 - DNA, 411 bp, Homo sapiens
  misc_feature 123, 124, 125, 126, 127, 128, 129, 130, 131, 132, 133, 134,135, 136, 137, 138, 139, 140, 141, 142, 143, 144, 145, 146,147, 148, 149, 150, 151, 152, 153, 154, 155, 156, 157, 158,159, 160, 161, 162, 163, 164, 165, 166, 167, 168, 169: n = A,T,C or G
  misc_feature 170, 171, 172, 173, 174, 175, 176, 177, 178, 179, 180, 181,182, 183, 184, 185, 186, 187, 188, 189, 190, 191, 192, 193,194, 195, 196, 197, 198, 199, 200, 201, 202, 203, 204, 205,206, 207, 208, 209, 210, 211, 212, 213, 214, 215, 216: n = A,T,C or G
  misc_feature 217, 218, 219, 220, 221, 222, 223, 224, 225, 226, 227, 228,229, 230, 231, 232, 233, 234, 235, 236, 237, 238, 239, 240,241, 242, 243, 244, 245, 246, 247, 248, 249, 250, 251, 252,253, 254, 255, 256, 257, 258, 259, 260, 261, 262, 263: n = A,T,C or G
  misc_feature 264, 265, 266, 267, 268, 269, 270, 271, 272, 273, 274, 275,276, 277, 278, 279, 280, 281, 282, 283, 284, 285, 286, 287,288, 289, 290, 291, 292, 293, 294, 295, 296, 297, 298, 299,300, 301, 302, 303, 304, 305, 306, 307, 308, 309, 310: n = A,T,C or G
  misc_feature 311, 312, 313, 314, 315, 316, 317, 318, 319, 320, 321, 322,323, 324, 325, 326, 327, 328, 329, 330, 331, 332, 333, 334,335, 336, 337, 338, 339, 340, 341, 342, 343, 344, 345, 346,347, 348, 349, 350, 351, 352, 353, 354, 355, 356, 357: n = A,T,C or G
  misc_feature 358, 359, 360, 361, 362, 363, 364, 365, 366, 367, 368, 369,370, 371, 372, 373, 374, 375, 376, 377, 378, 379, 380, 381,382, 383, 384, 385, 386, 387, 388, 389, 390, 391, 392, 393,394, 395, 396, 397, 398, 399, 400, 401, 402, 403, 404: n = A,T,C or G
ggcacgagagctctcggcgcacggcccagcttccttcaaaatgtctactgttcacgaaatcctgtgcaagctcagcttggagggtgattgtccaggaagttattccagatgaagacttatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15937 - DNA, 302 bp, Homo sapiens
  misc_feature 129, 130, 131, 132, 133, 134, 135, 136, 137, 138: n = A,T,C or G
ctgagtgtgacactcagagagtgtgttatatagacagagagagagcgcgcgcctctgtccccccccttgtgtgtgccccactccagtgcgcccagatccgtgcccccccccggagcgccgtgctccctnnnnnnnnnnagtgtgcacacccccctccccctctcatgagtgcccacatatatattcctgtgtgacccctccccccccctgccagtcagtgtccccgccggagcgcgagtcactgttttattttttctcgcccccaagaagggatagcgatgtgtctctcccctcctcccaca

SEQ ID NO: 15938 - DNA, 429 bp, Homo sapiens
  misc_feature 64, 65, 66, 67, 68, 69, 70, 71, 72, 73, 74, 75, 76, 77, 78,79, 80, 81, 82, 83, 84, 85, 86, 87, 88, 89, 90, 91, 92,93, 94, 95, 96, 97, 98, 99, 100, 101, 102, 103, 104, 105,106, 107, 108, 109, 110, 111, 112, 113, 114, 115, 116, 117: n = A,T,C or G
  misc_feature 118, 119, 120, 121, 122, 123, 124, 125, 126, 127, 128, 129,130, 131, 132, 133: n = A,T,C or G
ggcacgagatgtggtacagacatctagttggcaggagccaaagatgttgccaaacatgtagtannnnnnnnnnnnnnnnnnnnnnnnnnnnnnnnnnnnnnnnnnnnnnnnnnnnnnnnnnnnnnnnnnnnnngagtagaggatgcctggtatgaggcaatatttgggatagggaagggaagcttgggattttagctacgtagagacacttgaaaattggagggaggaaaggagtgggtggctttggagatgttctggaatatgtgaatgaggggaagtggaggggcctggaggctctggggaaggccaagcccgttttcctgtctttcaacctcttccaggaaaattacgggcagaaggaggctgagaaagtggcccgggtgaaggcgctatatgaggagctggaactgtcaacagtggtcttgcaaa

SEQ ID NO: 15939 - DNA, 471 bp, Homo sapiens
  misc_feature 471: n = A,T,C or G
tgttgtgcatttgggcatcccaccgattcgaattcggcacgagaaagcattgaagagacctcaaggctttaagaaatgagtaggccaaaatctaagtcaaaggagaatctgtactggggccccccgtgccctgaggtcattggccaagccaagccgaacctgagctttgatcctgatggtttggggagtgaggaagacagaagtggaagcccagttctcaccccaagaggggacacaaatggatgaccctcccatgatgctgagaccccaaaaggctacacactcaagctaaaagccagaggaaatcccatcctgccacccacaagacttcaaggaaagttgttttggtgctgagcagagcaggggaagaaggaaaacagcccttaaggagctccagccactggccagccttcatgtgactctagcccaaattcattcccatcacctggggtggaagggccagaaatctcn

SEQ ID NO: 15940 - DNA, 391 bp, Homo sapiens
  misc_feature 56, 57, 58, 59, 60, 61, 62, 63, 64, 65, 66, 67, 68, 69, 70,71, 72, 73, 74, 75, 76, 77, 78, 79, 80, 81, 82, 83, 84,85, 86, 87, 119, 120, 121, 122, 123, 124, 125, 126, 127,128, 302, 303, 304, 305, 306, 307, 308, 309, 310, 311, 312: n = A,T,C or G
  misc_feature 361, 362, 363, 364, 365, 366, 367, 368, 369, 370, 371: n = A,T,C or G
ggcacgaggtaaactctctataagtgttcagtgttgacatagcctttgtgcatagnnnnnnnnnnnnnnnnnnnnnnnnnnnnnnnnttttttgccccacctggaaaaaaggggatgcnnnnnnnnnnggggggaaaaacaattcttaagggccctttggccataaacttttttccgggccacctttgttacttttggtcctggaaggggtttttttggggggcccacggggaggggccccataggtaaactcggaaaactttttctaacccgggttagtgttttaaattaaaaccaaaaannnnnnnnnnnttggaatccttttctttaaaaaaattaatctctcaaaggaaaacaaagnnnnnnnnnnnggggggcccctttcgtttag

SEQ ID NO: 15941 - DNA, 339 bp, Homo sapiens
cactccgggggctctatttgtgtgctctgcacccagttttttatacactccacgctttggatataacatctagcgccacggtgcctatgtgtacacaccctctctctatatatagatacctctgtgcgcacatatagaggggaaaagagagatatatctattatatatacatttctacacaactgtctctggggggtcagagaacgcgcgcacccctctcttttgagagaaggagactctgtcccccctctctggggcgcagggaggccccatggcatgaagaaaaatactcacttatatctctctctctcactctctgtttgcgaaaaaacacacagg

SEQ ID NO: 15942 - DNA, 434 bp, Homo sapiens
  misc_feature 434: n = A,T,C or G
ccctagctacttgctctttgtgcaggatgccatagattcgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctggggaggcttttctcttcacctttgggctgctgccgtggattgacaacttn

SEQ ID NO: 15943 - DNA, 378 bp, Homo sapiens
  misc_feature 362: n = A,T,C or G
ggcacgagaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatgggccacacgggggtcattttctttctgggcctgctgctgngccatgcgcttctgcc

SEQ ID NO: 15944 - DNA, 302 bp, Homo sapiens
  misc_feature 6, 15, 16, 17, 18, 19, 20, 21, 22, 23, 24, 25: n = A,T,C or G
cccccnctctcgccnnnnnnnnnnncgttttcactcccgggagtccccttgtttttggcccggatccgggttctttctttcccgtggtgccgcgggttggagtgttttatcttttcttcacatggggggctggggagttccccagaacccccagggggaaacccccctcctatgaaaatgacacatgagcccctccttccggtggcggggacctgtctctctaagacccttttctgggaaaggggtctttgtttgtatgaccccaccgacgcggggggctttctatgggccgcccccccccg

SEQ ID NO: 15945 - DNA, 405 bp, Homo sapiens
ggcacgaggcctcattggagacattgacaatgccatgaggaccttcctcaactactacactgtatggaagcagtttggggggctcccggaattctacaacattcctcagggatacacagcggagaagcgagagggctacccacttcggccagaacttattgaaagcgcaatgtacctctaccgtgccacgggggatcccaccctcctagaactcggaagagatgctgtggaatccattgaaaaaatcaccaaggtggagtgcggatttgcaacaatcaaagatctgcgagaccacacgctggacaaccgcatggagtcgttcttcctggccgagactgtgaaatacctctacctcctgtttgacccaaccaacttcatccacaacaatgggtgcaccttcgacgc

SEQ ID NO: 15946 - DNA, 415 bp, Homo sapiens
  misc_feature 144, 146, 344, 345, 346, 347, 348, 349, 350, 351, 352, 353,354, 355, 356, 357, 358, 359, 360, 361, 362, 363: n = A,T,C or G
ggcacgagggtcacctgtgctgcccctccttaatctcgtatgatggtcacagtccggtggccgtgggggtgctctgccttccctggtccccactgcccatatctgtggactgccccttccaaagacccctggggggggttggananattcaatcttaccaaactcaacgatccatccatttcatgttactgatattacatgcggacacccctggatcatattattcaaatccagtcatctattctgcattcatgaccttttgataactccatcatgacctacttgacggtcactgaccatgcttactggattccgccttgtaacaataaaatctatttaaactnnnnnnnnnnnnnnnnnnnnaccagcccacataaaatatgattgaatcaatttcttataccttcactagaat

SEQ ID NO: 15947 - DNA, 389 bp, Homo sapiens
ggcacgaggtagactgggggctcactgattgcattgacacttttcatcatgggtccccgggggctcacgtggagtctgacacatgaatacatggctatcatgtctgtcaccttcaatggggaaaacaaactttgtaatggtaggaaacacaacaggtacaataatttacaaaaatatgtttgccacatttcagggcaaggcaaaatgcagaggagacatatgttaaaatcttatcattcacatttgttctttttatctttaagatgaagctcttacaccaagtgtcacgagtctggagaacagatgggttgaagagctgttcttataaaataagatctggggaacacaatcctttatatatcaacatcacagtggatttttggattggg

SEQ ID NO: 15948 - DNA, 371 bp, Homo sapiens
ggcacgagatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctc

SEQ ID NO: 15949 - DNA, 413 bp, Homo sapiens
  misc_feature 156, 157, 158, 159, 160, 161, 162, 163, 164, 165, 166, 167,413: n = A,T,C or G
ggcacgaggtgggagacaccacttgtctttatgtgggtctcaaagatgatgtagaatttcctttaatttctcgcagtcttcctggaaaatattttcctttgagcagcaaatcttgtagggatatcagtgaaggtctctccctccctcctctcctgnnnnnnnnnnnnggaaacaaagttttgcttttgttccccagcctgaaggggaagggctcaattttggttaaccaaaaccttggcctccggggttaaagcaattctccggcctaaccctttggagaacctgggttaataggcgcaggcccccaggccgggttaattttgggttttaagaaaaaacagggtttctcaatgtggggcaggcgtggccaaaacccccaccctaaggggatcggccctccttggcctcccaan

SEQ ID NO: 15950 - DNA, 409 bp, Homo sapiens
ggcacgaggcctggggatgctccctgctaagtgggcctgctcccacccttgccataaagctctgaggcagcctgagcctgccgtgggggccccactgtgaccctgccgcagtcttcctgggtccctgcgtcctcttaaggggcagtgacacctgcctcgctggccctgtgtgggtggcaggccccactgtttgggatatcacatggccaggcacgtggtgagcctgctcagggcggacgcctgcaggcgcgtgctcggtcacacactgccttgtgtggccctcctgtccggtgcagcctggacctggacgcctggatcaatgagccactctcggacagcgagtcagaggacgagaggcccagggccgtcttccacgaggaggagcagcggcgtcccaagcaccggccgt

SEQ ID NO: 15951 - DNA, 404 bp, Homo sapiens
  misc_feature 293, 294, 296, 301, 310, 311, 312, 313, 314, 315, 316, 317,318, 319, 320, 322, 335, 336: n = A,T,C or G
ggcacgagccacttcacccccttgggggctgcttattcactctggggattcgccatggacacgtctcaactgcgcaagctgctgcccatgtttccctgcccctccagattgcctggagatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagnngntttgnttttttggnnnnnnnnnnngntttgacttttttnncttttattttggagggtaatggaaagaataggaaaatcaggcaggggggagaatggttgtttattctt

SEQ ID NO: 15952 - DNA, 441 bp, Homo sapiens
  misc_feature 134, 136, 138, 139, 140, 150, 151: n = A,T,C or G
ggcacgagggaagcgggtggtgtgtgtcccctgtttacttttagctgagctggggttgggtgtacgggttctgttcctctgagccctgcggcccacctgatgtttacgtgtgtgtgtgagggggggcggcgctncncnnncaccccccannggcctctatccttgtgaagctctcctcaatctaatacttattgcccctgactccaaatcttccaccttttgcctcttattatatctatgttcattaccttaggtcagctgttctctattatgacactgattcatacttttgttttttgataagtacttatttcctctctcattgttgctaatatcctcttccttttttcctttgtctactctcacttcatctataaaactcttacatatctctccactaatttctttgaactaacaatttttatatagaatttaagcctg

SEQ ID NO: 15953 - DNA, 387 bp, Homo sapiens
ggcacgagcagccctggaattccgcaagcacccggaggccggggggtctccgcgggcgtcccatgcggaggacatggtgcgccgtgtactcttccccacgacctcagggaccggtccccccgccggaactgcttcctacctggtccggtcccggcagctgaatctggccagcccaacctcccggtcgctatggcacccacaggcctaacattcgcgagtccaccttccgccgtccgcgaggaaaacctgattggcgccctcttggcgatcttcgggcacctcgtggtcagcattgcacttaacctccagaagtactgccacatccgcctggcaggctccaaagatccccgggccttatttaaagaccaaaactggtggcttgggcct

SEQ ID NO: 15954 - DNA, 439 bp, Homo sapiens
  misc_feature 140, 141, 142, 145, 146, 147, 148, 149, 150, 151, 152, 153,154, 155, 156, 157, 160: n = A,T,C or G
ggcacgagggaggctggaagcgggtggtgtgtgtcccctgtttacttttagctgagctggggttgggtgtacgggttctgttcctctgagccctgcggcccacctgatgtttacgtgtgtgtgtgagggggggcggcggnnncannnnnnnnnnnnngantctttttccaataacaatattaattaatccaatcttttttcttcttctcttctttctactctttttcctcctttttttttatttacttttactcatcctcctttcttcatttactctgtcttttgtattactagcttcttctctttcgcaattttcctttattgttgtcactcttttgggaataacgtactcttatgagaagttgtttcctctttatttacatttggttgtcttctcctttcataatttattttacgtatgtttgtggagttttttctt

SEQ ID NO: 15955 - DNA, 170 bp, Homo sapiens
atgagtggtcttttaattaggaacaaatctaatggaaaggagagttgactgaagttggcccacaggattgtgagctgggcagagccttcatgaaggcttgccaccttgggacgcccaatttaatgggggggcctgctgtaaggcaaaaggctttttggcaaattgctggg

SEQ ID NO: 15956 - DNA, 393 bp, Homo sapiens
ggcacgaggtagactgggggctcactgagtgcagtgacacttttcatcatgggtccccgggttctcacgtggagtctgacacatgaatacatggctatcatgtctgtcaccttcaatggggaaaacaaactttgtaatggtaggaaacacaacaggtacaataatttacaaaaatatgtttgccacatttcagggcaaggcaaaatgcagtggagacatatgttaaattcttatcattcacatttgatctttttatctttaggatgaagctcttacaccaagtgtcacgagtctggagaacagatggggtgagtagttgttcttataaattagtatctgtggaacacaatcctttatatatcaacatcacagtggatttctggcttggtgcat

SEQ ID NO: 15957 - DNA, 430 bp, Homo sapiens
ggcacgagggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagaaaagaaaaagatgtggctccttcacgggggcctcttgccacccttcaagtgggtcccttgtgacacccgtcaatcccagatcactgaggcc

SEQ ID NO: 15958 - DNA, 423 bp, Homo sapiens
atcccatcgattcgaattcggcacgagggaagcaagggcacccgccttatggatggaattgaggggaaggcacccggggctcctgcatcgagcttccctcctatattcaatgaggaaatgaccctgcagaaggctggctgcagatgcccctgcctcccggctttgcctgcttggagtttgatggacacgtggtcctgtcagggctacagcaggtctatggtctttggtaacggaaagcgctggtgaaacagtgagctttcccgtgggtgcttttccctgacgccaacaaccagggcaagctgcctgtcctgctgcttggccgctcctcagagctgcggccgggagagttcgtggtcgccatcggaagcccgttttcccttcaaaacacagtcaccaccgggatcgtgagcaccacccagcgag

SEQ ID NO: 15959 - DNA, 409 bp, Homo sapiens
ggcacgaggctaggagtactggcctagatggttatagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcgcatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggatgtgggcgtg

SEQ ID NO: 15960 - DNA, 369 bp, Homo sapiens
  misc_feature 168, 170, 171, 172, 173, 174, 175, 176, 177, 178, 179, 180,181, 182, 183, 184, 185, 186, 187, 188, 189, 190, 191, 192,193, 194, 195, 196, 197, 198, 199, 200, 201, 202, 203, 204,205, 206, 207, 208, 209, 210, 211, 212, 213, 214, 215: n = A,T,C or G
  misc_feature 216, 217, 218, 219, 220, 221, 222, 223, 224, 225, 226, 227,228, 229, 230, 231, 232, 233, 234, 235, 236, 237, 238, 239,241, 242, 243, 244, 245, 246, 247, 248, 249, 250, 251, 253,278, 279, 280, 281, 282, 283, 284, 285, 286, 287, 288: n = A,T,C or G
  misc_feature 289, 290, 291, 292, 293, 294, 295, 296, 297, 298, 299, 300,301, 302, 303, 304, 305, 306, 307, 308, 309, 310, 311, 312,313, 314, 315, 316, 317, 318, 319, 320, 321, 322, 323, 324,325, 326, 327, 328, 329, 330, 331, 332, 333, 334, 335: n = A,T,C or G
  misc_feature 336, 337, 338, 339, 340, 341, 342, 343, 344, 345, 346, 347,348, 349, 350, 351, 352, 353: n = A,T,C or G
ggcacgaggccagctgctggtggagcggcactggggactggaggctggaagcgggtggtgtgtgtcccctgtttacttttagctgagctggggttgggtgtacgggttctgttcctctgagccctgcggcccacctgatgtttacgtgtgtgtgtgagggggggcggngnnnnnnnnnnnnnnnnnnnnnnnnnnnnnnnnnnnnnnnnnnnnnnnnnnnnnnnnnnnnnnnnnnnnnnannnnnnnnnnntnaatatatttttttgtttaatgggtnnnnnnnnnnnnnnnnnnnnnnnnnnnnnnnnnnnnnnnnnnnnnnnnnnnnnnnnnnnnnnnnnnnnnnnnnnnnataaattattaaattt

SEQ ID NO: 15961 - DNA, 403 bp, Homo sapiens
  misc_feature 179, 180, 181, 182, 183, 184, 185, 186, 187, 188, 189, 190,191, 192, 193, 194, 195: n = A,T,C or G
ggcacgagtgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcnnnnnnnnnnnnnnnnnccccgccccttaaaaacaatggggggccgtttaccgaaaacccaaactggaaaaaacccttggtggagttggaccaccccccacctaaagggcggggaaaaaaaggctttattggaaaaattggggaggctttggtttaattggaacccataaaagccggcaaaaaacaggtaaccaccaccattggctttctttttaggttcagggg

SEQ ID NO: 15962 - DNA, 384 bp, Homo sapiens
ggcacgaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgctaacaggaattatgccgtcaaactcctttccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaa

SEQ ID NO: 15963 - DNA, 401 bp, Homo sapiens
ggcacgagattaagtgaattgcgttatatttatgaccttaaggaccagatacaggaggtagaagggagatacatgcaggggcttaaagaactaaaggaatctttgtctgaagtggaagaaaaatacaagaaagccatggtttccaatgcacagttagacaatgagaagaacaatttgatctaccatgtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttaagtataatccccgatggcactcccaatgg

SEQ ID NO: 15964 - DNA, 430 bp, Homo sapiens
  misc_feature 21, 207, 208, 212, 217, 249, 275: n = A,T,C or G
aaatgggagaactctgaggtncccaacgattcgcattcggcacgaggccagctgctgggggagcggctctggggactggaggctggaagcgggtggtgtgtgtcccctgtttacttttagctgagctggggttgggtgtacgggttctgttcctctgagccctgcggcccacctgatgtttacgtgtgtgtgtgagggggggcgggnnacgntatanacccatcttattatcaaattacaaaatcccantaataggtatctccatcaagctgcangaggaggagagagaaatgagagacaattatgttcctgtggtctcagccttggatcaggagattattgaagatgattcttgccctaaggagatgctgaagcttttggactttgggggtctgttcaaccttcatggtacttcaacttcagctgggaa

SEQ ID NO: 15965 - DNA, 387 bp, Homo sapiens
ggcacgaggtttcataccttctcagaattggtatatcaagacacatttaaatataagccctctggaaatggatttatatacagtcatcataattacccccttagaaattggtaatattttatagccaggtttaggtttagtgtcaagtatagtgattgctggtctatcactactcatgaagtggaaccccctctactcataaaaaccccaatcagacatatagatgaatagaaccttgataacattagaatgccttgttctctgaaggcttacaagactatacgtcaggatatattaaggagaagctgaggaacgaaagaaacttcgacaagagaatggaaatgtacatgctatagcataactgaagaataaaatacaggtttgagg

SEQ ID NO: 15966 - DNA, 373 bp, Homo sapiens
ggcacgagactagtccgactttttatgtgctatgcaaaatagacatctttaacatagtcctgttactatggtaacactttgctttctgaattggaagggaaaaaaatgtaacgacagcattttaaggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagt

SEQ ID NO: 15967 - DNA, 369 bp, Homo sapiens
ggcacgagactagtccgactttttatgtgctatgcaaaatagacatctttaacatagtcctgttactatggtaacactttgctttctgaattggaagggaaaaaaatgtagcgacagcattttaaggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaa

SEQ ID NO: 15968 - DNA, 399 bp, Homo sapiens
ggcacgaggcagcagacacggctgatgatgatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgag

SEQ ID NO: 15969 - DNA, 391 bp, Homo sapiens
  misc_feature 96, 97, 98, 99, 100, 101, 102, 103, 104, 105, 106, 107, 108,109, 110, 111, 112, 113, 114, 115, 116, 117, 118, 389: n = A,T,C or G
ggcacgagcacagcccctgactgccgcagcccccacagagcccgccgcgcaccccacgtcccccacgccagcgcccagccatggaggccatcaagnnnnnnnnnnnnnnnnnnnnnnnggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcanga

SEQ ID NO: 15970 - DNA, 418 bp, Homo sapiens
  misc_feature 83, 84, 85, 86, 87, 88, 89, 90, 91, 92, 93, 94, 95, 96, 97,98, 99, 100, 101, 102, 103, 104, 105, 376: n = A,T,C or G
ggcacgagtgccgcagcccccacagagcccgccgcgcaccccacgtcccccacgccagcgcccagccatggaggccatcaagnnnnnnnnnnnnnnnnnnnnnnnggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcangaacgactggccacggccctgcagaagctggaggaggcagaa

SEQ ID NO: 15971 - DNA, 420 bp, Homo sapiens
ggcacgaggatttcggcaacaatttacacagctggctggaccagacatggaggtgggtgccactgatctgatgaatattctcaacaaagtcctttctaagcacaaagatcttaagactgacggttttagtcttgacacctgccggagcattgtgtctgtcatggacagtgacacgactggtaagctgggctttgaagaatttaagtatctgtggaacaacatcaagaaatggcagtgtgtttataagcagtatgacagggaccattctgggtctctgggaagttctcagctgcggggagctctgcaggccgcaggcttccagctaaatgaacaactttaccaaatgattgtccgccggtatgctaatgaagatggagatatggattttaacaatttcatcagctgcttggtccgcctgga

SEQ ID NO: 15972 - DNA, 399 bp, Homo sapiens
  misc_feature 51, 52, 53, 54, 55, 56, 57, 58, 59, 60, 61, 62, 63, 64, 65,66, 67, 68, 69, 70, 71, 72, 73, 387: n = A,T,C or G
ggcacgagccacgtcccccacgccagcgcccagccatggaggccatcaagnnnnnnnnnnnnnnnnnnnnnnnggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaanaagctgcagatg

SEQ ID NO: 15973 - DNA, 438 bp, Homo sapiens
  misc_feature 94, 95, 96, 97, 98, 99, 100, 101, 102, 103, 104, 105, 106,107, 108, 109, 110, 111, 112, 113, 114, 115, 116: n = A,T,C or G
atcccatcgattcgaattcggcacgagcccccacagagcccgccgtgcaccccacgtcccccacgccagcgcccagccatggaggccatcaagnnnnnnnnnnnnnnnnnnnnnnnggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcatgaacgactgggcacggacctgcagaagctggaggagggcagaaaaagctgc

SEQ ID NO: 15974 - DNA, 419 bp, Homo sapiens
ggcacgagctttggcctgcccgctcctctcctttctggcgacccgactctggctacgcaacggggcccgcgtcaatgcctgggcctactgccacgtgctacccactggggacctgctgctggtgggcacccaacagctgggggagttccagtgctggtcactagaggagggcttccagcagctggtagccagctactgcccacaggtggtggaggacggcgtggcagaccaaacagatgagggtggcagtgtacccgtcattatcagcacatcgcgtgtgagtgcaccacctggtggcaaggccagctggggtgcagacaggtcctactggaaggagttcctggtgatgtgcacgctctttgtgctggccgtgctgctcccagttttattcttgctctaccggcaccggaacagcatgg

SEQ ID NO: 15975 - DNA, 415 bp, Homo sapiens
ggcacgaggctgagccagagacgccctccattctctcttcgcgcccgctctccggctggcctcccgatgcgctgcccgccctgccaccatgacggaacaggccatctccttcgacaaagacttcttggccggaggcatcgtcgccgtcatcttcaagacggacgtggctcctatcgagcgggtcaagctgctgctgccgtccagcacgccagcaagcagatcgccgccgactagcagtacaagggcatcgtggactgcattgtccgcatccccaaagagcatggagtgctgtccttctggaagggcaaccttgccaacgtcaatcgctacttccccactcaagccctcaacttcgtcttcaaggataatgacatgcagatcttactggggggcgtggacaaacacacgcaggtct

SEQ ID NO: 15976 - DNA, 396 bp, Homo sapiens
ggcacgagcgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggac

SEQ ID NO: 15977 - DNA, 394 bp, Homo sapiens
ggcacgaggcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgcatggagatcttcggccccaggcacc

SEQ ID NO: 15978 - DNA, 384 bp, Homo sapiens
ggcacgaggcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcccacggagaagaaggtcttcacctacttcatggtgaccacagctgccatctgcatcctgctcaacctcagtgaagtcttctacctggtgggcaagaggtgcatggagatcttcggccccaggcaccggcg

SEQ ID NO: 15979 - DNA, 430 bp, Homo sapiens
  misc_feature 430: n = A,T,C or G
ggcacgagccggctcgtaagcaacctcttcagtctgcagtgggacccgcgcgtcatgcagcgtgccagcagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaan

SEQ ID NO: 15980 - DNA, 408 bp, Homo sapiens
ggcacgagagcagaaggactttgtctgcaacaccaagcagcccggctgccccaacgtctgctatgacgagttcttccccgtgtcccacgtgcgcctctgggccctacagctcatcctggtcacgtgcccctcactgctcgtggtcatgcacgtggcctaccgcgaggaacgcgagcgcaagcaccacctgaaacacgggcccaatgccccgtccctgtacgacaacctgagcaagaagcggggcggactgtggtggacgtacttgctgagcctcatcttcaaggccgccgtggatgctggcttcctctatatcttccaccgcctctacaaggattatgacatgccccgcgtggtggcctgctccgtggagccttgcccccacactgtggactgttacatctcccggcc

SEQ ID NO: 15981 - DNA, 412 bp, Homo sapiens
tcggagcccatgcgcagcggggcgcgttagctcgcgctcttcctgacccccgatcctggggccgaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccag

SEQ ID NO: 15982 - DNA, 300 bp, Homo sapiens
gccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgca

SEQ ID NO: 15983 - DNA, 2064 bp, Homo sapiens
acctcagccagattcggcacgaggggcgtaggaccctccgagccaggtgtgggatatagtctcgtggtgcgccgttttttaagccggtctgaaaagcgcaatattcgggtgggagtgacccgattttccaggctgctatccatgtccagggccaaacatgaatcctattgctcttggggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacag

SEQ ID NO: 15984 - DNA, 1365 bp, Homo sapiens
cgagaactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcctgggaagagtttgtctttcttatctttaagcccctttaccctggtcctgtactgatcagtgaaggaaaccgtggttactgaggccctgttgaaaagtgcacgtcttgtccaataaatcacgctgcagttggaaaaaaaaaaaaaaaaaaaaaggatctttaattaagcggccgcaagcttattccctttagtgagggttaattttagcttggcactggccgtcgttttacaacgtcgtgactggtaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttaccgcgcagcgtgaccgctacacttgccagcgccctagcgcccgctcctttcgctttcttccccttcctttttcgccacgttcgccggctttcccccgtcaagctctaaatcgggggctcccctttagggttcccgatttagtgctttaccggcacctcgaccccaaaaaacttgattagggtgatggttcacgtagtgggccatcgccctgataagacggtttttcgccctttgacgttggagtccacgttct

SEQ ID NO: 15985 - DNA, 22 bp, Homo sapiens
tgggatatagtctcgtggtgcg

SEQ ID NO: 15986 - DNA, 22 bp, Homo sapiens
tgattcgatgtcatcagtcccg

SEQ ID NO: 15987 - DNA, 22 bp, Homo sapiens
tgtgtcacagccagacatgagc

SEQ ID NO: 15988 - DNA, 21 bp, Homo sapiens
tgcaaacatacacagggaccg

SEQ ID NO: 15989 - DNA, 24 bp, Homo sapiens
tttagcagcactaatgactgtggc

SEQ ID NO: 15990 - DNA, 22 bp, Homo sapiens
cgccgtgaattactgtggatgg

SEQ ID NO: 15991 - DNA, 611 bp, Homo sapiens
ccttgaaaagcctttaattaagtcctagaaactgttacatatgcattgagagtgttcaaaaggattggctagctttcaggagagcagaagattaggaggagcctcctaggagatctttgacttgatcaggacaaaatcaggttttgccatattaggatagaggggatgagagaaacaacattgcacatagtttggataatgacgtgggtttgtaagacaactcttcaaacggtgtaaatgacaggagcacaggggccaggctggtatcagagaggggaacaaggaccagttcttagatggatttgtgtatcatttaaggaatttgaatttcacatagattggggatcccttgaagggtactcagaaggagttatattatcaggcagaaacatcactctggcggcagcatgagggatgggttgaaaaatttaaaacttgaagcggcaagtccattcaggcgactactgcaatagtcttggcatgaaatgacacattaaggcaagattgcccagggctttaacattgatattattttaaaaataaattgcctgtgctagtaatgtcctgtttctttgcttactggttgaagactcaatttttatagataatgc

SEQ ID NO: 15992 - DNA, 273 bp, Homo sapiens
ttgaaacaagtatttgaagttctgattctaatatttccagcaatgggccaagtggaggtgccagataatagcagaatcagaacttcaaatacttggcccattgctggaaatattaggactagaaaacatcaagatcaggcaccgaacaggcaaatctccactgagtggttctgatgtgcaaatagctgatgaagactggttatggttataaaatggaacacagttttctaattacatagtgtgtgggtctcgtgtggtgtgtgtgtgtgtgca

SEQ ID NO: 15993 - DNA, 649 bp, Homo sapiens
tgtggagaaaggttaaataagcattctgagggcagcataatgtgagggttaaaaactccggtagccaagactctgaagccaggctgcctgggttggaatctcaaatctcccacttactaaactgttggttacttacaaagactctctgtgcctcagtttcttcatctgtaaaataggggtaataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctgccgactgtatgatgcagcctacctgtaacactgctggcctcttgactacccggagcctggtagcatgggactgctgctcacgatgggcagcagcctggcatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtct

SEQ ID NO: 15994 - DNA, 617 bp, Homo sapiens
agcaacagaataatttccaaaagaccagatataaattctttcctccaaccaaaagtcaatcattttcttctgtgtgtaaaatagcacacattcttattcaccacagctgtaagcttaaggccattcactcactactctgctgtagtcctatgacactagctatatcatggccaacttactgccccacttctgtttccagaagtcacacacactagagtcagtttcatttctttgtagttaccctttttgcaactacagggctattacaaagtcacctgaggccactactttaaacagaaacatagtactacaaagccctagaatctaagacagccccccaatctgagggtcatctcagtccttgacactcctttctttgttaattccacaagaagaagaaattatagagctggcaccaatggtggcttcagcaccaatagtaaagggctggaggcaattgtaaacatcacctccacaatgaaggtaaccttattactcatcacattcaaagtgcagccctaaagaaaataatcacttcttattccttttcttgtatttttttcttggccactcattttcagctgagtgaagtattctactatgtgaaaatgattact

SEQ ID NO: 15995 - DNA, 304 bp, Homo sapiens
agagttatctatgtcagtattccctctatgcaaagatagttgagagttcacaagttgtaggctttcaagttgagctatgttagatatatgctcccctgatggaagacagacatgtctccagggttttgagggtcaaatgacagaatgtatataaagtgttttgaacattataaattgcctccttagaggcaagggaacatcaaatttggttgttttcttgcatcagagacttctagctcagatttctttgttggccatttttaagggcatttccaatgagtttttaagtgtaatgagtttttaa

SEQ ID NO: 15996 - DNA, 574 bp, Homo sapiens
tgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaataga

SEQ ID NO: 15997 - DNA, 544 bp, Homo sapiens
agactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggctgagatcatcacacatttgcaggggctgcagagggacttatctctagcagtctcctacagcaggctccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggag

SEQ ID NO: 15998 - DNA, 536 bp, Homo sapiens
  misc_feature 430: n = A,T,C or G
aattcgctataacagcaataggaatctaatacatatagaaaccagttcacaaactacactactgagagttcagagttttagaactcacttgttctggtgactatagaagcatcctgcatctgctgccactccaatggatatcaatgttcccagacagctgggtctattccctcatctgcaagtgcatcttccaagccttcctgcctctctgcacgaatgcttttactgttcccttcttgtgaaatgacctcttgttattctgttcagattcctttccagccagcaggttcacttgtttctataggtgcacgattgtctctttgttctgtattacagtcacttggctgagagaagtcacctatcttggattagttgtagaaaactacatactctcttgtgagcaaatattttccatgtaagtgagtcccanatctaagtatggccaagagttgagacgagaaagttcaatttcaactcaataaacacttggtgaatagcagctatcttcatggcagggagattattgaaagaagaat

SEQ ID NO: 15999 - DNA, 526 bp, Homo sapiens
cgaattcggcacgaggaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagaactgaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatag

SEQ ID NO: 16000 - DNA, 594 bp, Homo sapiens
cgaattcggcacgagcaaggtctatgactactacctaccagatgaacaggcaacaattcagtattctgatccctgtgaatgaggataggagctggaaactcaattagtcctctgtgacattactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggacagggtcatagggggaagaaaggtggtttagctgttttatttagccattcaaggggcttctcaaaagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttgga

SEQ ID NO: 16001 - DNA, 588 bp, Homo sapiens
  misc_feature 241: n = A,T,C or G
cacgagagatcggagcactgagtacatggattatattcactaaagattggagagctaaaagtttctctgcaagagtgacctgatctagtaagaatgtcaaaattgttactatatttgtacccttgctcttcggtttagagggcaggtgcttccgtgtgtacatagaagcagagcttgttggagaagaggagctaaaaaggaattagattagaatccacctctgtacaatggcaccatctgngctcccaaaagctcattgttaaactttcgagaattttgagagccagttgtaaaacacagccattataaaaactaaatcatataaacttacaattaaacacattatatgaagagccaagataataaatactcaaaactcttcctaattattttgctatgtttcactattatctattctcttgaggttagttacatctattgtggctatatggtggaaatactgtataaaatgctgtgcaactgagcttctcctcccaattcttcattcagtgatgtcatattcagaacttgaaattgaccatgatggaagtaattacaccacagaaatcagcccatgctacaaagcag

SEQ ID NO: 16002 - DNA, 388 bp, Homo sapiens
tatacaagatacctgccaaaggaaatggtcttactttcaaacgactttgggagcatgtataatcgcggacagagcaggagaagactttaaacagaatggccttgtgtccttttcctttactaagtgttttgaataaagaaaaaaaaaatgtatgacctcagagaatgaatacccttcaggaagccacttcctgattttaggggataatattgttctctgtagcacaaagatttaaagtcctagaatttctaatcctagttctcagaattgtagaatatgacaaaaataatggtttccccatttgtccactgacttcagggatatttcacaagttatttatttatagaatgaaaactatgtagttaaatctgtcattcagttaaacctg

SEQ ID NO: 16003 - DNA, 613 bp, Homo sapiens
ggcagagaaactagggagcccggggacctctccacatattctttgctctgtacacttaatcaagataagaaataaagacagcaagactgcaaaaagtctattatgtagacttgcaaaaagtctacataataatataaattcaagccaagtagaagtgattttgcaagtctgtgtatgattaattggctagtgaaatatatggataaaattagttgtaggaattaaagcatctgaagtgatctcttgaggctctggtggcaaagcagaaaggggaatttgaatttgaactaggtttaaaagtgtgagtagtagccctttcttttggcaggggaggtgatcctacccattctccttagagcctgtgcaattggtctcagtgtttctcaacatctaagaatgaagctgcattcttaatgctttagtagctgtgcttcaaaacggcaagtttccttttgagagtgattttctctttgttctagcttgtttcactaggcggataagcgtgggcagtaaactgggaggtgtccctttatcagcacctctcagcttcacccaccctgctgcttgccctgggcagtagcctggtcacatctttgaaaacctctgtttagtc

SEQ ID NO: 16004 - DNA, 578 bp, Homo sapiens
taaatgaacaagtatacttccctgatgtggctgataaaaggtaataatacagtatcatgatgaagagagatgacactgaggctccagtctactttaaaaatatgtaagtctctgataggtcatgattttagaccacatacagactgtcctatggggaaaacacagggaagaaaagcagcataaacatttttatcctttattgtgtttgtccaaagcagagttaagagggtagcctaagagtataatacttgcctttccaactacagaataatcttttcctttctccaaattgtataaagtagatttttttttttcagtgagtgaaacgatgaaacttagactcacttaaatgtatttcctaatgtaagaatgtgtgtgtgccaagtaaatttactaagcattagaacatggaaagcagagtatgattaataccctcgtttacctcactttttcccccattttcaaaatttgttttcaaatatggaaattcttctgtacactaaaatgatcttaggaaacaggtagctcatggtctaaagtttagcagttcatgattaagggttgccgcaatctaatct

SEQ ID NO: 16005 - DNA, 612 bp, Homo sapiens
cgcctggctaggagcgccgaccgcagggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggattattatgttacagttgtagaagatgtgactctaggacagattgttgctacggcaactctgattatagaacataaattcatccattcctgtgctaagagaggaagagtagaagatgttgttgttagtgatgaatgcagaggaaagcagcttggcaaattgttattatcaacccttactttgctaagcaagaaactgaactgttacaagattacccttgaatgtctaccacaaaatgttggtttctataaaaagtttggatatactgtatctgaagaaactacatgtgtcggaggtttctaaagtaaaaatctt

SEQ ID NO: 16006 - DNA, 629 bp, Homo sapiens
tcaaacgtaagccttcctgacctctaagacctacctttgtcatgtacctttaccctcaggcaaggagcaatctcttctcttcctcttctaccttgctgtagcttctccccaaggatttatcacattctgccttgaatcatagggaacagcatgtgtagtggaatgaacacaggcctctgaatccaagatacgagtttaaatcccagctttggaggtggttacttaaagtctcagtgccttcattcttcttcctatataaagtagatattacaatatctaacttacagagtcattgggagctatacatgcagcgattgggtaaagcacctggcacatggcaagcgattagcaaatgctggttacttctacttctttctcttcccttttcccagtctatcataatttccttgagagcaggcaccatgtcttatttacccttgtatttcccacagtacttcccatagtgagttacccttagtaaatactcagtaagttgaattgaatttaaattacctgtaagtcttaaaatgtgggattaaattaagaatatattgtcctggaaatacccaaatgtctattgatggatgaatggataaacaaaatgtggtatacacataatggaatattat

SEQ ID NO: 16007 - DNA, 628 bp, Homo sapiens
ggcacgagctagctgcacctctaaagtgacttttaatcccaggattctatgattatatttaattggagttgttaaaagtaacaattaattagaataatttatctgtttatttttgataacctggtgcttgtactgaagaagaataatatcatgaagtaaaaagcataatctagatcagtgctactgaaagaagggtttgcatactgtttgagataagttcaaaaattgaaagtgagcttttggaaactttggtaacaatttgatattgccgggacatccaagcacatcatcattctttgagtaacttctgtttttattgtactttatatcagtccataatggaacacacacatacacacaataaaactggccccttcgccacagattatttgagaagcacgggtatagacaaccatcaaattcaaatgatcagcactagaatgatcagcaataatctgaactttgtatgtggctaacgaggtacatattaaactattgctttttctttgtgggtctggtcaagaggagtaacagatgaattcttcacactactttctttcgctttgcagaaggatttctccagtcagttattttatgtgactcctacagtctagctaaggaaaaaatt

SEQ ID NO: 16008 - DNA, 627 bp, Homo sapiens
caggcccctttgagaatgtgatcattgttattgaccataggcacaaaatacacacaaatacttaacatacacaattttgcataaaatctcagtgagttgactctctaagacatatctagagatctaaggactccagatgaaaagcaactatcctaacataatcccaattatttcaagaaattaaaccaaattctcaaaacaaatttaccttcagtttacttaatttgaaaagtacttgtatgtattacttaaagtcagacagacaacaatattgtgatgcagttataagaaagtggcctgaccttaggtgaaggaactccagaagtaaaaattgatgtctgacaaagatcttcttatgtgtagtaaatgaattctgctctccaaatatgaagtgaaactgcatcaattcaagaaatgcctacaatcccttcagcatggtggttccactgaaaggcccttaagaataacggatattttactcacatgttttgagattagtagaaccgtcgtggctttatgtgtctatttagttactacattcagaaaactgagggtataaaacaaactttaactttgttttcttcccgtgtctttagtttccagtctttaagctccattgctttccct

SEQ ID NO: 16009 - DNA, 630 bp, Homo sapiens
aggcctggcttggtggctcatgtctgtaatctcagcattttgggaggctgagatgggaagatgacttgaggccaggagttcaagaccagcttgggcaacacagaccccatctctacaaaaattagccaggtatggtgggtatgtcctgtagttctaggtacttggaagtccaagatggcaggatggcataagctcaggaattcaaggttacagttacctatgattgcacaactctactccaggctgggcaacagagtgagactctgtctccaaaaaatcccaaatattagactgggcatggtggctcacagctataatgtcaacaccttgggagtctgagatggaagaattgcttgaggcttgcctgggcaacatagggagaacctatctgtaagaggtaaaaaaagattaactgggcacagtggcacatgcctgtagtcccagctgttctgtagtctcagtctcccaaagtgctgggattacaggtgtgagccactgagactggccctagttagggtttttatgtaagaaatttgaaatctcgtatttgtattagcagctaatgtaacttctagtttttaccttagatctggtctatttttatatagaagtaacctgggtagcattatg

SEQ ID NO: 16010 - DNA, 605 bp, Homo sapiens
agcccaggttgggaagcccagtcagccctgtctgtcagctcatggagacagacacattgcattactggaacccagagcatgttaaaacacccaggctgaagttggccataattttcagcctcacatccagttgaccgtagttctagagacaaaggactctgtctatatataaacatttacaatgatgtttatatgaagatccacctgaagtgagcatttgtcatatgggtacagtgtcagcgatagtacatcacggtctgggctggcatgttctcacttcctcagatgaacagaacataccaatgcaaaacctatatttgatatgatttctgatacagaaaaagaggtagttcttatatgggaagaaaaaagggaaatcactcaggctttagtctctaaataatattgtaaaataccaacaacaaattactaaaaataaaaacagacttgcagacagtaagacagtctgattatttcaactaatacccaaatcaaattaggcaattattcacacacatacacaaagttattacaagcacagattgatgtatgaagaaaaaaataaaacttgagggttccctaactgggggattatgtaaatatat

SEQ ID NO: 16011 - DNA, 515 bp, Homo sapiens
acaaaaaaaattaggacccttgacaattctattagtgcctgacaattttattgggggttaatattccagcattttaaattgcctctttattctgaactcagactcacataaactttagaaagatcatagaaacttttgattgaatggaggtaaaagagtttcagacaaaaagtgctggaggctgtgatctgatcaaaaatgtataaaatgttgattctcagtattttatagaaagaagaattcaagggctcatctaatccagttccttattttactgatgaagaaatgtaggttccaaggtcatataaatattggtggcagataaaggaagaatccagggttaaatcacagcactccttccacagcatcacacactgctttctacttttaagactatttgttgagttactgaggtaaaagtttgtgattttttgctttgttttcttttactaatttgcaaacatttctttgctgagtatgtttttacttaatgatgaatgtttacagggctctgt

SEQ ID NO: 16012 - DNA, 177 bp, Homo sapiens
gtgcctgttagactcaaagtggagatgtcaagtagggtaatctgatctaccacctagcacgagataaaaatgtgggagccatcggcatggagagagcatttaaatgcaggagagtggacagaatgccctaaggagcccgtggagagagaagacaggcagtgtgaaggaggtgtgtgc

SEQ ID NO: 16013 - DNA, 182 bp, Homo sapiens
gacagcagcttttctgatttacagagttcttcagatttacaaatggacaatgacatcacaatgaatactggtatgaacggggagtctctgcagtcgccagacaaatcatactcagccccttcccccgtagagcaacaagtggttcttttagagttgactggcagcatttcctgtcgggggag

SEQ ID NO: 16014 - DNA, 622 bp, Homo sapiens
tcctatggaggatagtcctatggaccagacgaagcccctgccccaaggagtgcccgggtgtaaccgcaagttaaggagccctggggaggtgacacaggcaccctcattccttttgttcagtaggagtctctgaggcctccccagcaccatgccgcgtgggtgaggccgaggacacagagaaatatcaggcaaggctcctgcccccttagggtggccctgacaacggatcataacctcccagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaactctggggagggcgaactgcaagagggctgccaggattagccgagggattccgaatgaagacggagtatttccgaacatacacacctctcccaagagcgtttccggagggttccgaaaatacccgagcgggcctcggcgc

SEQ ID NO: 16015 - DNA, 646 bp, Homo sapiens
atttatcaatatatacacatacacacacagacacgtttctttgtaagtcattttaggctattagatatgtctaaagtttagaaatgacattaatccagatcaacaagtaaacatcaaatcccataccttttttcctgtattttccttgaatcctttaaccacttaaacatttcctctagaacatctctgtcaaaggacccaccagtgcattattttctattagtaccaaaaaaagatatatctcagcataactctttaataacttgctctttagaatatatagcctttccaatattgaaaagtgtatgctgtcctgacgtcaaaaacaggctttccactgcactgattctcagtctttggcacaataaacagagattgagtgatataagaatcaaggtctgaaaaattagacagtcaaatgttttccaatgtggatatgtttcccttcatcagtacattttctcttaagtttggcagaaatggaataaagcaaaagcctcctctagatactttgtagatgaacattctataattaaaattaaactgtttagggtatcaaatggtggaaattttatatttatcttttagaggaaacatttcttaattcactgctactctgtataacatctatcttttaggggcatga

SEQ ID NO: 16016 - DNA, 562 bp, Homo sapiens
ccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctca

SEQ ID NO: 16017 - DNA, 464 bp, Homo sapiens
gtcggtcggcgctcacgagaccatggagaagtaaactcttcacccatcaggttggtggtcactggctgtctgaccgtgggtgaggtgacagggctgcttttgtctcctttatggtgttctcaccgcagctccgaggggttggagtatactcagaggctacagtgatcagaagacataggtcgtttttttttcatcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtctgtatgcagtcttcaatatttagcttatttgaaggagtaggt

SEQ ID NO: 16018 - DNA, 542 bp, Homo sapiens
cacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatct

SEQ ID NO: 16019 - DNA, 641 bp, Homo sapiens
aagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgat

SEQ ID NO: 16020 - DNA, 602 bp, Homo sapiens
gtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaaggg

SEQ ID NO: 16021 - DNA, 669 bp, Homo sapiens
ggcacttgagataagcctcataggaggagagaagcttctccctgtgtggaaggaggcagcacacaggccacagagaggcgcagaagggacaactgaggccaagagaggcggaaggtccccagacgggttttctaaaatatctttctctgaatagcatttttacttaaatttgatatgcaaatgcagataattggtattcatgtaaatatttactgcttaaaacagaaagttacttgtaataggccaggcacagtggctcacgcctgtaatcccagcactttgggaggctgaggcaggcagatcacgaggtcaaaagatcgagaccatcctggccaacatggtgaaaccttgtctctactaaaaatacaacaattagctgcctcaggaggctgaggcaggagaatcacttgaaccagggaggcagaggttgcagtgagccgagatcgcaccactgcactccagcctggtgacagagcaagactccatctcgaaaaaagagaaagttacttataatagaaagcctgttcaaatgtggcaagtgcaacgtattcttttggaggctctaaacccaagcctgcaggtccctgatacgtcttctttgccatctagtggtagccattagaactgcatgtgtgggcccggcgccgtggctcacgcctgtaattcccg

SEQ ID NO: 16022 - DNA, 575 bp, Homo sapiens
agttctctctccagaaaactacaactccatgagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggtttaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacat

SEQ ID NO: 16023 - DNA, 654 bp, Homo sapiens
aaactagaagtggacattggtgctgattgtaaagggctctgagaaataggcagaggcagctagccttttccctagaggcttccaagagcctttgaagaccttacaccactggtgtgatctgatcacttatgtgttttgctaaggtagctctggtgtcaatattgggaataaatttgggacgagaagaattgtactaatgaggttattgtggttgagactaagttaaaaagtaggttccatgtaaagatacttccgtgctgattgaaaggaaggaatagatacgagagaaaatgacattagaacaagtaggactgtgctactgaatggatataaggtgtgaggaaagggggaaattaaagtgaattagactatgtataaaccaggggcccagaggataatcatgaaacagaggaagacttagtgtgtgtgctggtagaaggtagtggaggtacaatgaatttagttttagacctcttttaggttggtagaaatgggacatatacactattttgacttacaggcagttgcagttagtcaaggagatggatgaaaatgtaggaattatctgtgtaattgtgctaattgcacatgtgggaaggatgagatttattaagagaatatactgccagtagagtatagaatctcgaggaatgc

SEQ ID NO: 16024 - DNA, 625 bp, Homo sapiens
cgggcgcccctcccccagcctcgctgccgccttgcagtttgatctcagactgctgtgctagcaatcagcgagactccgtgggcgtaggaccctccgagccaggtgtgggatataatctcgtggtgcgccgttttttaagcccgtcggaaaagcgcagtattcgggtggggtgacctgattttccaggtgccctcagtcacccctttctttgactcggaaagggaactccctgaccccttgcgcttcccaagtgaggcaatgcctcgccctgcttcggctcgcacacggtgtgcgcacccactgacctgcgcccactgtctggcactccctagtgagatgaactgggtacctcagatggaaatgcagaaatcacccgtcttctgcgtcgctcacgctgggagctgtagaccggagctgttcctattcggccatcttggctcctcctgcttctttccttgatatgatgttcaaaccaggaaaatgtgcaaatatcaaggttacctgggtctgctggtcacttctagtttttggactcttgaagatggaaactgttcttagaagaggcctgaagagaaacatgactgactagatccaatcctctggcattacatcaatgcagaaagag

SEQ ID NO: 16025 - DNA, 659 bp, Homo sapiens
tgactttggtgcattttgtgaccaagtgtcattgcctgtattttaggtcaggttcaaagtaagggaaaagatatattagggattttatattcaagaaaaataccacactgaatttttaaaaatgcaatgtaattttttaaatgtctgctccaatttccacagtttggcttgcaggcagtttgagctaattggacctcatgaaaggcaaaaactctgcaaagtggtggagtcgccaaacctggactgttttattggttgaatggctagcttctttctttaggcaaagcataggatagtattcaagagtacatttttaataataaactggagataattaagtactggcatcaggcatatttcctcagatatcactgggtttgtagccatttcatccagagcatctctggatgacatctctggttggatccctggttgacatcatttttatccagagcagtctgtttcacattctgctgccaaactctgacaattgtttgaagactaggattaggagaagagagagagacataaacactcagttgtcctgccttgactttgacagatactaagatctaacatagtctaccaaatgaagagtgacagttaaagacagcttctgttattacctgaagtatcaaatatttagtgatacctttttt

SEQ ID NO: 16026 - DNA, 607 bp, Homo sapiens
agctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggat

SEQ ID NO: 16027 - DNA, 645 bp, Homo sapiens
atatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaact

SEQ ID NO: 16028 - DNA, 614 bp, Homo sapiens
agcgcgccatggagcatgtgacagatggctcctgggagtcggtgcctgtgccgctacacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgctggggtcatccccatcctggaaattcttctgagaagagaagagaagttaaaaaagagtcaggttggagccataatcatcacccccactcgagagctggccattcaaatagacgagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagc

SEQ ID NO: 16029 - DNA, 557 bp, Homo sapiens
  misc_feature 495: n = A,T,C or G
tactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctganaccccccctggaacagctgaacattgtgctcatagactttgggctgagtttcatttcagcac

SEQ ID NO: 16030 - DNA, 613 bp, Homo sapiens
gtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcct

SEQ ID NO: 16031 - DNA, 625 bp, Homo sapiens
  misc_feature 136: n = A,T,C or G
agtctcgagagcagttctctccacaagtgctaaaaattacttgtatgaattatttaatatcattgcaaataagatgttattttaactttttttaagtttctgcaaatatgtttattatgactttttatttttatantgattggaaatacatatactaaaattccacgttaccagtttcttaaccacagaaacctgaaaaattgccatagttgatttgttacttctaccttggtgcatttacaaaatagtcatatttttattatgaagttaaatattcatttgtttatagctacttcagaaggctcagattatttttttctttaatagcacagagtcctctcaaggtaagcactgtgcagttagtataaaccattattccccatgtgtacatgattcacagtttgtattgtgttccaagtgaaccatagccctttcagaaatcaagacttatattcattttacttctttgagtactcttgaattttagaaagtccattatgatcctaaggtagcaacaacatagcctattaccgtctatgatggtttacagatctattattccacgttagttcatcactatcaactaccatgatagagttaagctaaaccattttcccaacatatg

SEQ ID NO: 16032 - DNA, 657 bp, Homo sapiens
agcctcataggaggagagaagcttctccctgtgtggaaggaggcagcacacaggccacagagaggcgcagaagggacaactgaggccaagagaggcggaaggtccccagacgggttttctaaaatatctttctctgaatagcatttttacttaaatttgatatgcaaatgcagataattggtattcatgtaaatatttactgcttaaaacagaaagttacttgtaataggccaggcacagtggctcacgcctgtaatcccagcactttgggaggctgaggcaggcagatcacgaggtcaaaagatcgagaccatcctggccaacatggtgaaaccttgtctctactaaaaatacaacaattagctgcctcaggaggctgaggcaggagaatcacttgaaccagggaggcagaggttgcagtgagccgagatcgcaccactgcactccagcctggtgacagagcaagactccatctcgaaaaaagagaaagttacttataatagaaagcctgttcaaatgtggcaagtgcaacgtattcttttggaggctctaaacccaagcctgcaggtccctgatacgtcttctttgccatctagtggtagccattagaactgcatgtgtgggcccggcgccgtggctcacgcctgtaattcccgc

SEQ ID NO: 16033 - DNA, 608 bp, Homo sapiens
  misc_feature 510: n = A,T,C or G
cgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaaaagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctanacaaatccgagctatgctgggccagttcagccaggcagaagccttattaatgaaagctggagtgcagccaggaacttttgatggagttcttatggatc

SEQ ID NO: 16034 - DNA, 636 bp, Homo sapiens
tgggtttaccacctttctctaccccctactcacatcctggttatccaagagaacattatctcttttcttccaactgccttttcttcacctgtaatataaggaggctgaattctgatgtccatgccagcattcttatcctgtgagctgagcatcaggttttaagattttactcgttctctcatgcctgatacgggctgtgcacatgtagactattgactgacccagagaaaaaaccctgagggtcaggaagtgttacccaatgtggctcacttcgtaacaactcacaaggccaggccagcggagcccagaaagcaggcgctgatgccgagagtgatttgctcttctcactctactgctgctgcctggcctgtcggcctagagcggacagaactgtgtgctttgagccatccaggtccagttctctaaagacattgtgtggagatcagaggaagggagagactggtccctgcacttgtgggactagcctctcatacattaggatatctttcaaaaacacaaatataaaaggtactaaagcagctgcatgctggggagatagagcagatgaacaaacatgaatgggtaccatgcaggagagacgtcctttgcgtgggatgtggaagggacagaagctac

SEQ ID NO: 16035 - DNA, 587 bp, Homo sapiens
ttgacatgattatttatttagttttaaatctttttattataaaaacatacaggaagtgacacaaaacaaatgtatagcttattgaatgattatgattgtaaggtgaataacctttgtgtccaccacctggtgaagaaatagtactttgccagataccccaggaggctctcccaagtgcccctccagccgcagccctcttcttctccccctccttgccccaacaagtaatcctgacttttacagaaatgactttcttggttttttgatggcagtttagtcttgtctgcttttttttgtttatttttttatctacttcagtgtccatttgcagtcccgtcggcctcactgttttccctgccgtttatctgttgaagagcctgggctgtttgtcccatggcttcccacagtgtagattttgctgaccacgtggtcatggtgtagttcagcatggtcctctatgtttcctgcacattggcagctgggtccagaggcttgatgagcctcaaatttgatccctttggcaggagaacaggcggttaggagctttcctcaggaaagtaccatgttgacggcagctgatgctcagt

SEQ ID NO: 16036 - DNA, 634 bp, Homo sapiens
tctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattaaattaaacaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataaactctgcacttcagcctgggcaataaagcaagacccagtctctagaaaaaaaaaatgattaggtaaagaaaagaaatcaaattttcacaatgggagaatgtggttttactatctgctaggccccttccatcaattcttattaaattctcaaaataatcctttgaaaagggagtataattacattttacagtgacctgaaccttacccaaacaagtgggagagccaggagccaaactatcaggctccaaagctttttttagtgcatcacaat

SEQ ID NO: 16037 - DNA, 502 bp, Homo sapiens
caggtgctagcggccccttcgccctgcagtgaagagtaagtgaagaatttgagggtcatcagccattgtgaactcatcaaaatattcccactctggccactgcccaaaggggctcttatctgaggaatactgctgacttcgtgtacctagttttacagagccatctttctgaagcataaattagattacattattctacagcttaaatccctccatgaacttcccatcacccaagagtggactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaacatcctgtgcattggtgagttggccctgaccaccattttcttagcatgctgaattacttctgttcccctctgtgtttgcacagctttgtttgtgcacagtagacttttggc

SEQ ID NO: 16038 - DNA, 541 bp, Homo sapiens
agaaccttaagggggaaggaaagacatgaactgaccccagcttacaagaccctgggcagctgtgaagtgggagtgatgcagacacgcccagctaaagagcaggtatgctggaaagcgggaagaaacctggcctgtcgtttgctctgaggtggaaggtggggcctgggcacaagcagttgagggaaggagactgtgcccctcctggctcccaagtcttcaaggagaagattctcccgggaaatctgacctcagaagacacctccttggggcctctctgctgtcacagccatgccaccttagagctttgtaaagcctgcaaagggctctttaaaaacttcaagccaggcgcagtggctcacacctgtaatcccagcactttgggaggctgaggcaggcggacacttgagcccaggggttcacagctgcagtgagctgcggtcatgccactgcactccagcctgggtgacagagtaagaccctgtctcacagaaataagtctaacttgaattgaaatgctgtagcaggctgagcgcagtggctc

SEQ ID NO: 16039 - DNA, 572 bp, Homo sapiens
ttttttaacctatcaacagtgaatacttttgagtagtaattgttttgtgcctaatgctaagtgtatttattagcatttcggtgttgatctagaaaatttttacttttaatcctgtagttttagaagtatgttattcctttatctgtttctttatatcagtttttcccataattgggtaaactcctattttataaaatacgaagtacatttctggttttttctacataggttactagacattttttcaatttgaaaaaacattttgaattaagaaactttttttttaaagtaaatacgaaatgtggttcttgagtatgcattgatcctgatttaccatgtacattgtcaatggtttggaccattttctttgctaacagttacatcatgtcatgtgatatgtgcagtgtgatgtgtagttctaaaaataaggcaaggtaaaaatgctcatcccttgggaatttaaaaaatgtattataaatgtggaataactaccttcagtcatgaaattctgaattggatttccactaggtttatgcaacaaagtgtgccgttccttcgacctttagcatatt

SEQ ID NO: 16040 - DNA, 555 bp, Homo sapiens
gcattagagggaatacctaatgtagatgatgggttgatgggtgcggcaaaccaccatggcacatgtatacctatgtaacaaacctgcccattctgcacaagtatgccagaacttaaagtataaaaaaaaatgaaatggatggaagcagagtacctggagagggctttgtccatcctgtggttgaggactccctggccatgacacccttttgtgctttaaagccaatgaatgacattatcttggcctcttgtctcacaaggatggaaccataaatgagtcctttcccacaccatgacacacatagaaaataataatatttgtgcagcctacatcatttgtgaagttgaggaggtttgtgggctttgctttttgatttatttgttaataattattttttataagacacattaaggaagactgattttgtataaaaatgtccaataccatattcttgaaatatatttttaacaatttatggaggtatactggatataaaataaactgcgtgtatttaaactgacaaatgtgtcagtgaaaccaaaaaaatgtcctctt

SEQ ID NO: 16041 - DNA, 616 bp, Homo sapiens
ccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccgctgatgcagtcagccagcacctcctcacatgcacacatgattagacataggtgcactcggt

SEQ ID NO: 16042 - DNA, 557 bp, Homo sapiens
acacgtagcaacggggctggttcagggtctgaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgacgcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggtttttttgccttgcttttggagccacattgctactggctggcaaaatccagtttggctatgtatacgggatcagtgcaattggatgtcta

SEQ ID NO: 16043 - DNA, 647 bp, Homo sapiens
ctaaggcagcttcaattaagactagggcattgttccaactaagggcagattttattctttaccttcctagctataaccttaggtatcctgaggatctaacaatgaaaatttttaaattatgaggaaaaacactaatgaatgtattcactattttgcattcaactatcctacatgaacatgaaaaaaagggaaatatatgtggcttatgtatataatggtatcattttaaatatcataaaactgggtttcttttcccttctctaaaaatagacctcaatagaaacctagtattaagtaacctagaatcaggaggtattccattactgctgattaagaagtgggaataggcaagtaaaatattaagtttcttttcaaactgcaaactatcttctaaaagatcctttctatatttgaagcataattttcactctgctctgtttaaacaatatttatcagtttaagttgtatttatttttagcagttcaattaaacaagaatcattactttggaaagcatattaattataaattttttttttcttgacagaatcactcacaaaaaggagacacggtatacatttttaaaattcagaattatgataaatttagtaaagttccaggacacaaaatcaacatacaaaaatcagt

SEQ ID NO: 16044 - DNA, 669 bp, Homo sapiens
  misc_feature 583: n = A,T,C or G
gtactccagcctgggcaacaagagcaaaactccgtctcaaaaaaatacaaataaaaataaatagtaatgtggctaatgttgtctgtcactaatgtctacttgtttttcctccttatggtgtaatatacaatacatattaaatatatgtcgttcttttctacctcagtgggaaaggatgacgataggtgatttatttgtgttgtagttaccgtaattacagaatatacttgatctcatcatagcagtctagaaatctttccgtgaagttgtccctgatctgttaatgaacttcatgtgagatacgcctttttgctgtggatttatcagagggctgtgatcttcacaaacgaagtggtagtattttaagtaaaatttttaaaggtgcttttgggtctttaagtccactattggagaatatcttgtaatctttttaataatgatgtgttactaaaagagctactctaaactgtaatggctaaaggaatttcaaagactttattgtctgtcctcagacttcctggtctcttaacacatttatttggttaaatatgaatgtaatacaggttgagcatccctaatccanaatctgaaatgttgcaaaatccaaaactttttgagtgctaacatgatgccacaggtggaaaattccacacctgaactcatgggata

SEQ ID NO: 16045 - DNA, 701 bp, Homo sapiens
ggtgcaatctcagctcactgcaacctttgcctcctgggttcaagccattctcctgcctcaacctcctgagtagctgggattacaggcatgcaccaccacacctagcttatttttgtattttagtagagatggggtttcaccgtgttggccaggctggtcttgagctcctgacctcaagtgatctgcctgccttggcctcccaaagttctgggattacaggcgtgtgccaccacacctggcctaatgtagtgttttgagatccatccacattgtagcatgtatcagtacttcattcctttttatggctgtatcatatcccattgtattgatagagcacattttgtttatgcactcatcagtgagtggacatgtgggttgtttctactttttggctagccagcttcctttttgtattccagacataccaggctaccttttagcctttgtcctcttttcaagtagccactgttggtgggatgggaaccctttgccatcttcattgtctgtcctggtctgcctggcagttccttcttcttttgagttttagctttctcctttatctatcagtctcttaacgagtttggtaggaactaggtcacaggacctttaataaatactccctggtaaattatgaaaggttgaatttctgaccctgcaaaatgaaagaccagagctttaatagtgagtgcactaagttggac

SEQ ID NO: 16046 - DNA, 683 bp, Homo sapiens
gcgcccctcccccagcctcgctgccgccttgcagtttgatctcagactgctgtgctagcaatcagcgagactccgtgggcgtaggaccctccgagccaggaaaatgtgcaaatatcaaggttacctgggtctgctggtcacttctagtttttggactcttgaagatggaaactgttcttagaagaggcctgaagagaaacatgactgactagtccacagggacctctggaatgagaagaactgagacagagaggctggagtaaaggagcagcagacctccagacacatgatgatagttacccttgctgatttcacccctttctccggtcttacttcatccttgtagatggagcccctaagatacaacacttcatcttcttgttgggaaaaagctgagtgttgggaaaaaaagctgaggcagggcttgcatgtctgacataatgtccagggctcagtgcataaaacccctcgtggcctctggaatgagtctagacttgctggctccttgcttctagcttaaactggaagaacatgctccctattatctcaagtagcagaatatgttccatatgcttcaaaggaaatgctaaactatcacagctgtagatcatgtgcttgcccttttgacccacacattctcaccacctgtttctttgtttgaccaccaataaatagtctgggct

SEQ ID NO: 16047 - DNA, 673 bp, Homo sapiens
  misc_feature 504: n = A,T,C or G
cggcaggccaatgcctcgggccatgctgcctggggccccccaacagaccatacgactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggccgggcccggcctgggcggatacagctgggactggggcggnggagccaccccctctcgttacccccagccccctgtggaccacaccctgggcacagaggcagatcgtgtttgaagccactctgggcggccagccagccctggggcccattgccctggatgacgtggagtatctggctgggcagcattgccagcagcctgcccccagcccg

SEQ ID NO: 16048 - DNA, 620 bp, Homo sapiens
ccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattat

SEQ ID NO: 16049 - DNA, 638 bp, Homo sapiens
tgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggct

SEQ ID NO: 16050 - DNA, 576 bp, Homo sapiens
  misc_feature 482: n = A,T,C or G
ccatccaggtggttcgggaggagctcaagccagatcagaaacagagagatgtatccttgaaggagagccagggaaggtgtctaatcttcaatacttgcatagctacctgacttacatcaagctatcaacggcaatcaagcgtaatgagaacatggccaaaggtctgcagagggctctgctgcagcagcagccagaggatgacagcaagcgctcaccccggccccaggacctgatccgactctatgacatcatcttacagaatctggtggaattgctccagcttcctggtttagaggaagacaaagccttccagaaagagataggcctcaagactctggtgttcaaagcttacaggtgttttttcattgctcagtcctatgtgctggtgaagaagtggagcgaagcccttgtcctgtatgacagagtcctgaaatatgcaaatgaagtaaattctgatgctggcgccttcaagaacagcctanaggacctgcctgatgtgcaagagctcatcactcaagtgcggtcagagaagtgctccctgcaggccgcagccatccttgatgcaaacgacgctca

SEQ ID NO: 16051 - DNA, 584 bp, Homo sapiens
tgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattct

SEQ ID NO: 16052 - DNA, 573 bp, Homo sapiens
gccctgtttgggtgatcactcataaatccgactcgtgctcagatttggacctgtgtaactgcttgcccatgggtcatctagggtgcaatcacatcacacccctttttatttgaaacagggtcttcttgctctgtcacccaggctgaagtgcagcggtgcaatctcagctcaccgcaacttccacccctcccccaggctcaagcaatccttccacctcagcctcccaagtagctaggaccacaggtgtgcaccaccatgccctgctattttttttatttagtagagatgaggtttcgccatgttgcccaggtgggtttcgaactcctgagctcaaacaatgcactcacctcggcctcccaaagtgctgggattacaggtgtgagccaccgcacccagcctacacttttttgaggacatgtatgtccctaagaatctgcataccatggcagacacggtggctattgcctgtgatcccggcactttgggaagccaaagtgggaggattgcttgaggccgggagttcgagaccagcctgggcaacatagtgagaccctatttctattaaaagtcaaa

SEQ ID NO: 16053 - DNA, 633 bp, Homo sapiens
acggctcaactaggcagttgtagtggaccaggaagcaagacccttctttgctctgggcctctgtaaaataggacatccctctgtcctgattcatgcctcttgccacagcataattcctcgtagcacccacttttactttcagagctgccctggtttttggatgacaaaatatacgaataccttcagtaccccagagattgcttatgagaattaaatcaaataactcatctcacttctgctgattcacggggtacctcaggcaagttgctttttccatctcagcttcagttcgcccatctggaaaatggcaataataccaagcatctggcagcctgaggatgaaataaaaatcacagaaccttagagagttcagatcaggcaatcctgaggttcagatcccaattcggcctcttgatggctgtgtggcttgggcaaattgctcaacctctctgtgctttattttattcatttagaaaatgcagtgtgaagctgggcactgtggctcatgcctgtaatcccagcactttgggaggccaaggcgggcggattgcctgagctcaggagttcacaaccagcatgggcaacacggtgaaaccccgtctctactaaaatacaaaaaaattagctgggcat

SEQ ID NO: 16054 - DNA, 496 bp, Homo sapiens
gcttccgcgcgccccggaccagccccccttcccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttgggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacg

SEQ ID NO: 16055 - DNA, 591 bp, Homo sapiens
tgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaa

SEQ ID NO: 16056 - DNA, 493 bp, Homo sapiens
cgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttagcccgggaggcggaggttgtggtgagctgagattttgccactgaactccagcctgggcaaaaagagcaaaactccttctcaaaaaaacaaacaaacaaacaaacaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttt

SEQ ID NO: 16057 - DNA, 420 bp, Homo sapiens
ggggctggttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatgagcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgc

SEQ ID NO: 16058 - DNA, 499 bp, Homo sapiens
cggcacgagttcagggtctgaaacagagtttgggggttgtttgggattagtgaagctactgcctttgccgccagcgcagcctcagagtttgattatttgcaatgtcaggctttgaaaacttaaacacggatttctaccagacaagttacagcatcgatgatcagtcacagcagtcctatggcagccacaacagccatacaccgggcagatttaccagccaactcaggcatatactccagcttcacctcagcctttctatggaaacaactttgaggatgagccacctttattagaagagttaggtatcaattttgaccacatctggcaaaaaacactaacagtattacatccgttaaaagtagcagatggcagcatcatgaatgaaactgatttggcaggtccaatggttttttgccttgcttttggagccacattgctactggctggcaaaatccagtttggctatgtatacgggatcagtgcaattggatgtctagga

SEQ ID NO: 16059 - DNA, 614 bp, Homo sapiens
ggcacgagggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctgga

SEQ ID NO: 16060 - DNA, 481 bp, Homo sapiens
ggccttctgaagcagagggaagcctatcagagtaagctcaggtgggcctggtcagcctcgccgagctctcatttccactctgcccacagccacagagggaatgggttgcctggagaggtagcgagtgctgcatcagtgcaggtattctcgcacagattcgacaactgcgtatcagcctgtaggtgagggaatagttaggcttgatcatccagaaagttccttttgaccctaaaagtctgattcttgtgattctagcctttggcaaaccacagataaccagtctctcctcctatagtatagggttcttattacgattattgaccttgtgatgacaagggtcacaaatccaggaggctgtgaagcccctgaaattattacttttttcttccttttttttttttttttgggttttttaaaacctaaatctggaaaagaacccccttaaatttttttcccaatttgggggggttgccttttggcc

SEQ ID NO: 16061 - DNA, 619 bp, Homo sapiens
cggccgcgctccgaacggcgcctcccgccccaccatgggcaacagcgcgagccgcagcgacttcgagtgggtctacaccgaccagccgcacacgcagcggcgcaaggagatactggccaagtacccggccatcaaggccctgatgcggccagacccgcgcctcaagtgggcggtgctggtgctggtgctggtgcagatgctgacctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcg

SEQ ID NO: 16062 - DNA, 456 bp, Homo sapiens
gcactcacttcagactgggtgacagagcaagactgtctctcaaaaaaaaaaataaataaaaataaaataaaaatggctaatttttgtatttttagtaaagacgtgttggtcaggctggtcttgaactcctgacctcatgatctacccgccttggcctcccaaagtgctgggattacaggtgtgagccactgtgcccggccctatagattatcttatatttggtccttttcaggtttgaggatgcaaaaaatacatgtatacatgtaaatggttaaaaaaacattttgtttctttttctattagcactttttaagagcactggaaaactatgaaaagcttctgtaatgtagtaataaccgtatgtggagcatctgttttttatttgggttttcttgtggtggcatttttccttgaacacttatactgttcttctaccatttttttcctaccccagta

SEQ ID NO: 16063 - DNA, 534 bp, Homo sapiens
atgattccagccagaatgtcttgagcctgtttaatggatatgtttacagtggcgtggaaactttggggaaggagctctttatgtactttggaccaaaagctttacggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtttgtcaattaacagatgaacagatccatcacctcatgaaaatgatacgtgatttcagcattctcttttacaggtgcc

SEQ ID NO: 16064 - DNA, 585 bp, Homo sapiens
gaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctc

SEQ ID NO: 16065 - DNA, 630 bp, Homo sapiens
gagaccctgtcaatcagcataaaattctcagtttctaagattttttaatataaaaagcaagtagtaacagatcatctgttatttatgagttgtgatcaatagacccctaaatatctacttatttagtctactgtatcaaatatcatcatcaatgttgcaaaaccaacattagggtattgaataacatcactatcaattaacattttaattggaattttgaattattaggcttttcatttaagtcatctacaaattgattgacaattgaactttatcatttgcttagttcactgctaaatcaaactgtttaatacttttttctaatagtaaaaacatactgaagattgagaagcactggtttagaaaaaatatgtaaatatataaaatgtaatagcctggaaatcaatcagaaaattggaactgattccatttgtaagaacagaaacataaaataagttttaaacttataaaacttttattttaaaattactacaaacctcaatgtaggttataaaagaagacttcaataaatggaaaaacacaccatacttcctgggatgaaaagactcaatgcggtgccttgcaggcatttgtatacatagaggaaactgttttcaaagctgagctgca

SEQ ID NO: 16066 - DNA, 596 bp, Homo sapiens
gaccctgggttttgtgtttttactctgtggatgttgtggtcacgctggatcatgttgtgtggaggcttgggagcatgtgttggaggaacagttgagattttaattttatttttggtggcttttttggtacatccaaccctttcaggttaattaaatgccaggtagagctagcccacaagtggattttgttttgaaaatgtgcctgttttccaggagccctttgtggcagcctggtctggttgcccagatatcattttggcttcttggtgccttagtgcctgggatgaattggcctgcctgctgcagtctcttctcctcagccctgatatccgccaactgggtggctttgatgcctctgctgagggctctggtttcctgccagtctgggaggcgtgggatctcatgcgtgggaaaggtaatcaagcaataaaactaagcctgggcgtgagaggtggattaaagtgggcaaggaagaagcaggggagagggagggagccagctgtccagagtggccggaagaggcagaatgtgggctccatcctggctgggacctgtcagcccttgtgagaacttttagggcggtagtattatagttt

SEQ ID NO: 16067 - DNA, 654 bp, Homo sapiens
catggcgctggccaccgcctcgcctgtgggaggaaagcaggtgtgagggcccatcaggaggccatgccaacctctccccacagggctcacgagtcccgccccctccactcatttcccattcattttactccttattccttctacatttttaaacttcgaatttcagtgtaaagtgcagggaactgcctgcatcataagcttgatggactttcacaaaaggaacacacctgttttatggtacccaggccaggagacaggacattgctaatcccctgtagggtccctgggcccctcccagtctctaaccacaccacgctaaccactatcctgacttctaacatggactggttgtgcctggtttgtgtatgtggtaagatggaattctacagtatgtactcatttgcacctggcttctgtcacttcatactatgtgagagtcatccaggtggctgtgtggggagtagtctggtctgtctcatcgctgtatggtatttgttgtgtgactatgccgcaatctattcatcgtttctgttcttttagagacagggtcttgctctgtcacccaggctggagtgcagtggtgcagtcatggctcactacagcctcgacctcctaggctcaagtgatcctaggcatgcgctagcatgcctggct

SEQ ID NO: 16068 - DNA, 677 bp, Homo sapiens
caagtgctacctcctggagcttctcttggaaatgggctcacaccagaggcagcaagagaccttggccttctccctgggattgcggtcgcagcttcactcattgatgcccatgcaggaggactaggagtgattggggcagatgtgagagggcacggcctcatctgtgaggggcagccagtgacgtcacggctggctgtcatctgtggaacgtcttcttgtcacatggggatcagcaaagacccgatttttgtaccaggcgtctgggggccttatttctcagccatggtacctgggttctggctgaatgaaggtggtcagagcgttactggaaaattgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtac

SEQ ID NO: 16069 - DNA, 627 bp, Homo sapiens
gctgagttttgtgggtggggcttgttgactgttgccttttctttgggggaatgccatatatgtgttactttaagtctttttaggtagtctggttcccagagaagactcctggctgctaggtaaaggctggcagccagcgggaagagactttgcaggttgcctaccttcacgtaaaactccccttttagtactttctgctgtgtattagagtcctagaaactcttttcttcagttaagagaatagggttaaccacttttctctttggataaggaggcagcatttgatgcttctttggagaggatctagacctttaatagcttctcagagagactttcaacccgtccttcttcctgccctccttccacctcaattcaaagctacctggggcagccagttatttgggggatgtggagagggaatttgtggtataaaatagcttggttcttaacttgttttttactgatgacttattaagtgttttggagtgtttgcaaagtcttgtccatctgctttccagcttaccaaatttgttgctggttttgttttgctctcaatacttttattttgccttttaaaaaaattctcaggctgggcgcggtagctcacgcctgtaattctagcagttt

SEQ ID NO: 16070 - DNA, 698 bp, Homo sapiens
gtgttttaactgctttttgtacttaatatcttaaacatgcttggaattgattggacagaataaaaccaagataaatatacaaaattaaatgattcagggataatgtgggttatgccttgcgtgcctgtctgaggagtttggacttgattctctagaccaaggattggcacactgtaacttgtgggccaaatccagccttctgcctgtttttataaataaagttttattggaacacagccacatcaatttgtttgcatattgcgtgtgactgttttggtgctataatagcagagtaggggataggcttgcagggcttaaaaaatctgagcttttacacaaaaagtttgccaaccctgatataagtagtgggaagccatgaaagggttttgatcagggaggtggtatcttcagatttgtgtgtcagaaagcttactccagcagctgtgtggaggatggatcggagaatacaatgaacagggggatggcagagggaatgggagggaagggaacagcagaaagacattttggacatagaatctactataagcctgggtatggggtatgggagggagaggagccaaagacagttttgtaaaaaaactattaaacccatataacctcccccaaaattcagaataataacacacccgaccacaccgctaacaatcaatactaaacccccataaataggagaaggc

SEQ ID NO: 16071 - DNA, 635 bp, Homo sapiens
ccatctctactaaaaatacaaaaattagttgggcgtgatggcgcatgcctgtaatcccagctacttgggaggctgaggcaggagaattgcttgaacctgagaggcagagattgcagtgagccaagatcgagccactgcactccagcctgggtgacagagcaagactccatctcaaaaaaaaagaaagaaagaaagaaagagtttttctggctaggtgtggtggcttatgcctgtagtctcagctacttgggaggctgaggtgggaggattgcttgagctgggggagtttgaggctgcagtgagctatcacaccactgcactccagcatgggtgacagagcaagaccctgtctcgggggagaaaaaaaaatgcaaatgctttcctgacagaactaagagagtttggaactagggttctataaagtcagccctggtgtgggacttctgttattacagagagtacagaaagtgtcctaaaaggacagctgggtggctgggcatggtggctcacatctgtaatcccagcacttcgggagcagaggtaggcggatcacctgaggtcaggagttcgagaccagactggccaacatggtgaaaccctatctctactaaaaatacaaaaattagctgggcata

SEQ ID NO: 16072 - DNA, 545 bp, Homo sapiens
tgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacat

SEQ ID NO: 16073 - DNA, 568 bp, Homo sapiens
cattaaacttgtacactgagttactaaacaacagactccatggtgagtttgagaactcccctctgtccctttctccatttccttcttttaattgtctgtgtgaaggctttggatcgtgcctcagtcattggcctacactttaccttttcctgaggcgtagatgattgaagcaagagtagagatccagaaaggagagtagttttccagttttgtggacatgtgattagttaagggacacataggaatgactgctttgccttaaactcagccatttagggattaatcttcaaccccaaattttatcattttattattttacagctgatgtatacacatttaatgcattgattgaagcaacagtatgtgcgataaatgagaaatttgaggaaaaatggagtaaaatactggtaaggaggaatcctcagtttattttttaatagggcttaaatactctttaccagaaatacatgggctggccagagatcacctgaggccaggagttcgagaccagcctggccaacatggtgaaacccgtctctactaaaagtacaaacaattagctgggcgt

SEQ ID NO: 16074 - DNA, 562 bp, Homo sapiens
tccagttgtgctgagacagagcaatgggtttccttcttttacatccttgtgcattgctctattgttatggatgataaatttctaaaagtaaaatcactgggacaaaggatacacacacacacacacacacacacacacacacacacttttttgtgacaggatctcactctgtcacccaggctggagtgcagtggcgcaatcacagtttactgcagccttggcctcccaggttcaagcgatcctcccacctcagactcccaagtagctgggaccacagcgcacaccaccatgcctggataattatttttctcagtttttgtagagacacggtctccctatgttgcccaggctggtctcaaattcctgggctcaagcaattctcctgccccagcctcccaaagtgctgggactataggaatgagccaccgcacccagcctgggtatgtattttataaatattgtgctaacttcaaccaagtttttgattagagctgaacagcacacaattaaaataagatcacttttgaatacttgaaggatgacagatgtctagttcattagt

SEQ ID NO: 16075 - DNA, 590 bp, Homo sapiens
caaggaaaggcactttcaggcccggctggttccagagcctcaattgatgcccatccatcccgtcgctcagactctccctctcctcttcttgctctggggctggctgacattgtggctgactcacggggccgctgctgccatgagtgcactggtcccacctccatcagcattgagtgacatgatctgaacccctgtgcttggtgccgggggctcaataaaggttcagccactgggtgtcagcagcccagagcaggaagcaagatcaagtggtggatgcggaacagaacatgcaagctagggccaggcgcggtgggtcatgcctggaatcccaacacttcgggagagaggctgaggtgggcagattgcttgagatcaagagtttgagaccagcctggccaacatggagaaaccccatctctactaaaaatataaaaattagctgggcttggtggcacatgcctataatctgaggctgaggcaggagaatctcttgaacccagtaggcgcaggttgcagtgagccaaggtgccactgcactccagcctgggtgggagagcaagactgtctcaaaaaaaaaaaaaaaaaaaaaa

SEQ ID NO: 16076 - DNA, 469 bp, Homo sapiens
cccagagtgctgggattacaggtcttgctcttctttaagttgtgccagatatgatatgactgcatagtgttttcgtaagaataccattgggaaaatgagaagttttactgggctagttcttccatgatttgaggatgatattcagattataagataccctttgtctttcttacagtaatgaagtataagctccatatctgttccagagactttaacttgacttgcttcattcacaaagaacagagttcaagaagcagtgcatcctgtgagaagtgtgaagtgtttgtacatcactttaaatatattacttaatatattctaagttgctgtgtggagcagtatactgttgttttaaaaatgcaagattcagacaaattttaatattatctcattaaaataatttaaataatggtataaaatatctatatcattaaaataattttccatagtgtttagaaaccatgaaaaa

SEQ ID NO: 16077 - DNA, 571 bp, Homo sapiens
aatggatctgctaaatattcaacaggtatatgtggacttttcttttagaatgagcagtgttgttaagagttagtgtcagacaaaactgtgtttgccattcctgaccctttctccctcttacctagccatgtgacattttgcaggtttaattcttctgagctaatttcagcacttataaaatggagtaataatagtgtatactatgtcagtgaagtgccagcagataacagaaaatacacttacctggaatttgaagataatttaatgaagggactatttacagagatgtagatggagtttagggaacaagtaagggatgatgaagaatttgtctaggggattagcagcagtagaaaggcagcattgccacctggagccctccagctggtgcatctcattggctaaagttaacagccagagaggggtagggaacacagcaggtcagagagggggagataaaggactgggagagagttgtatgccaaacaggaaccagctagttacctcttaaggttgttgtgaaacaatgagtagaatgtgacgcaatacaggttcagtaggtaaaggtagc

SEQ ID NO: 16078 - DNA, 678 bp, Homo sapiens
gctttacaaattaagctgaaggccgggcgcagtggctcatgcctgtaatcccagcattttggggggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcgcttgagcccaggaggcggaggttgcagtgagctgagatcgcgccactgcactccagcctgggtgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaagagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggct

SEQ ID NO: 16079 - DNA, 547 bp, Homo sapiens
tggggaacaatttgtaatcctttttagttcatatgtcacaatcacagaattgagactagctagtttaaatccctgcatcttgcacatggtgaggaaaggtgaggacatttagatgacctttgcctgtcaccacacagctgtatggtagcagagctgggcgtgaaacctgcattcctggcctctccttttgtggtgcttacagtgctgtgttaggtccagttttacctcttaaatctgtattattacttttttttcgagaccagatcttactctgtcgcccaggctggagtgcagtggcgtgatctcggcttgctgcaatctctgcaattctcatgcctcagcctcccaagtagctgggactacaggcatggtagtgggtgcctgtagtctcagctactcgagatgctgaggcaggagaatcacttgaagctgggaggtggaggttgcagtgagccaaaatctcgccattacactccagcctgggggacaagagcaagactccatctcaaaaaaaaaaaaaaaaagtttttggttttaattttggaaa

SEQ ID NO: 16080 - DNA, 625 bp, Homo sapiens
taatcccagtgctttgggaggccaagcaggaggatcatttgatcccaggaattccagaccagcctggaccttgtgtctacaaataattattattgttattattattattatcctggcatgatggctcatgcctgtagtctcagctgctcgggaggctgagtcaggaggatcccttgagcctgggagttcaaggctgcagtgagctatgatcacatcactgcactccagtctgggctacagaatgagaccctgtctaaagaaaataaaataaaaatctcaggagcaagtgagagtggagagagcagaggcccaggatagagccctgaggagcccttgcatggggcaggagaggcaggatgggccactgacccatgacaggcccagaggtcagggttagaatctaggcctccctccaggcggccagcaggtggaagggacttagggcctgtaggtcagggggctgggcttccttgcctcttcctcaggcatgagtcatggggacctatgggaccttggccattcccagtggggtgggtgtgtgtgagcgtgtatagtgtgcatatgtggcccagggcatggggccagtatcagcgcctgagggacagtctgtgcgaggctgcttagc

SEQ ID NO: 16081 - DNA, 658 bp, Homo sapiens
cctttctcctgctggatgcccgctcctttgcagagtcccggcatgcacactgacactgacatgcctcttcttgtttgatgatgatcacaggaacactgaggccaatctgctggacagagctccctgcgagagaggcaagagagactgctcttcaagtagctgcaggggcaggagcatgagggacagggatacatggactaggtgagagcagagtgccatgggaaccatgggaaggatggttgccacacttcgggcttcgttctgctttaaattggaccacatgccctctgaggtaaaagagggacactccccagcccgagacaaagtcccgtttccttagaaagtcacacacacgatctagatgcaccctgtatttccagcttcatttccagtcattctccattgcaccctccctgtggaggcctacttttcctgacacgttctttatacccctgggcctgtgggctcttccttacgactaaaatccctggacacctctcttctggagaactgacactcatctttcaagacctagctcactcccccactctctgtaggcctatgcagaggactagcttggatgaagccggtacccagcctcccggcacacatgcacagtgctgctgttttccttccacacctctctccttgcggtaca

SEQ ID NO: 16082 - DNA, 653 bp, Homo sapiens
caggtctggatgcaggcaggagacacacgcgtccacactagcatgcgtgtgtacacacatctacatgtgcttatcccccgcgttcatgttaaaaaccatgggatcataccggtgtttcagattcacatccaccccagcagggtttctcgcctcccccattgcttataaccttagcaggtgttgagaaccctggcgctcactgtccacagtgagtttgcttattcgttgaaacctagcgtgcctgtagagtgtggagagttgccggcccgcacccctgcgagacacagactttctgaccgcagccctcatgtgtgtggctcttcttgtccttggccttacagtgcagtcggatcgctgctttccagagttgcctgggggtaggtccctcctcttctgtgctctgcggcgcagtgagcggcctttgcctcaggcctcccgcggcttccttaagcctctggcctgcccggtccctggcgccaggtctgttttccctgctcccttctctctgatcctgctttggtctgagccgtgcctctgggccccagcattgctgggccgcattgtcgttttatttctcttgtgtcgttgcgtctagtgtaagacattcagtggatcattgtggatggtcattagtggtccagagtggaaagtga

SEQ ID NO: 16083 - DNA, 667 bp, Homo sapiens
tgaaccaggggagtactggtgaataggaaacaaagagtaggtgcatgtctgagagacatttcgggtcagcctgacatgacttaatgacagataaaaaccatgtttttttaaaaaccagaaatgtattatttatacagcaacctgccacactgaattactgggaaatgattagttttcatctgtatacaaacctaacaatataacactggaaatgactatcaggatactgtggttgatatggctcttgacttaacactgttccaaaccaccaagcatcatcaataatagagcggaatctgtcacctaggagagaaatgatcaagtctgaggcatttctctgctaacattcattaacatttttttaatctacaaaataccatatgatacagataaaaaagaagccaaaagcacaatacaaaaacaggcaagcagcgctcctaaacaaaccaagaaaaatatggcataaaaaatttaacttttagattaaatgcatttctagatgtattttacaactctaacacttcaaccagtgaaataaactgcactagatctgtgtttaacatatattacaatagaaacatgaactgctgcagtaaccatatctcttccttcttacccttcccaccatttacaaaacaaaaccaatgaaacaataaaagtcacctat

SEQ ID NO: 16084 - DNA, 684 bp, Homo sapiens
aatattaacgagctcattaatcatattaatgagcagagcttccttagatatatctgtttataatgaatgatacacatatagctctgatgccatagggggagagtaagaatgaacaaagaaataaaataatttttaaaaaatgatacaggccacgtgtagtggttcatgcctgtaatcccataactttgggaggctgaggtgggaggattgcttaaagtcaagagttcaacaaaaattttaaaaattagctgggcatcgtggtgcatacctgtggtcccagctacttgggaggctgaggcaggaggattgcttgagccctggagttcgagcctgcagtgagctgtgatcacaccactgcactccagcctgggcaacagagtgagaccctgtctctaaaaaagaaaataaataattaaaaacatatatgataggccgggcacggtggctcacacctgtaatcccagcactctggaaggccgaggcaggtgcatcacctgaggtcaggagctgaagaccagcctggctaacatggtgaaaccccatctctactaagaatacaaaaattagccaggcgtggtggtgcacgcctgtggtcccagttgcttgagaggctgaggcaggagaatcgtttgaacctgggaggtggaggttgcagtgagccgagatcgtgccactgcactgcag

SEQ ID NO: 16085 - DNA, 619 bp, Homo sapiens
ggctttccttttcatttaaagaaaaatccaaactcctttcttttgtgttgagatggagtcttgctccatcacctaggctggagtgcagtcacgcaatctccactcactacaacctccacctcctgggtccaagtgattcttgtgcctcagcctcccaagtagctgagactacatgtgtgaaccactacgcccagctaatttttgtatttttagtagaggcggggttttgtcattttgcccaggctggtctggaattcctggcctcaagtgatccacccactttggcctcccaaagttctgggattgcaggcatgagccaccacacccagcccaaactccttctaagacttataatgtctcccattatctatctgctaatctatccttccaacttcatgtattgctgttctctaccaagctcactttgctgaacatagcaagctccaatctcttcctgaaagtttctacctctacctggaagctcttcctcaccttcacctggcaagctccataccttcctttagtaatcagctaaatatcctataggtctaatccttgctattctgtcttactctttctcagcatttaaaacaattatttatctatatgtataattggt

SEQ ID NO: 16086 - DNA, 549 bp, Homo sapiens
gaatcataagtcatgcacagttgtggcttccagggaagaattggcctgggggggccttggtggcaccagaactacattcttcccagagcactggcctgtcgtgtaacttgttattacacgcatgggctgatgaagagcattttgcacgtgagtgaggctgagaaattaaagtctgtgccactggcccttatctactttgggactcccggggatttcaacttctcatttaatggatgaaaaataatggaagtttaagaattttttactgttcacttcttctatcttcttaccaagccaatcatgaccatttattttgctgaaatggtgcgtctaggtgctgatttctctctttaaaatcagagtcttcagtctgtgcaattaaagcacagtaacattttgaaaatacctttaacagagagttccattcctcattatagaacattccatcatggcctagagatttcaaggcaggtaaccagttcaccccaaaaaatcttcaaaaggaaacaaattttcattgtgtttatttcgaaactacagtactcttta

SEQ ID NO: 16087 - DNA, 664 bp, Homo sapiens
ctttctttctacctggaatagtacttaggttgtccctcctggatgttcccttagcactcttggttgtactcctattatgaaacttaatagctggtttatttgtctctccaccctaggctgaggtcttggatgggaggaactggaatttttttaaaaaaaacttctgattttttatttcattgaattaatgtttgttgaattatagaactgcttaaacataggattaatcattgaaaactgggtaggagatgccaaccacattgcttagcaactgctagttcatgtggacatggaatctgttttgctgaccactgtgcatttagtgctggtgcaatgagctatacacagtaggtgctcagtaaatacttggtaaatgattgagtgcacattcctgtaccagcctctgccttttccactgcttccctgaaacccatgggttaaatgaacccaaaatcccttaacgtttcctgacagccttatctttccactaatcttatgcgcaagaaatgccaaatacttagagatgcattctttcaccataaataaatgtaataataaagaaatacagtagcaaagaaatgtggaaataatttatctccaagttaaataaataaagttcattgcagaatgttttggctcattcacacttctgtttttctttctt

SEQ ID NO: 16088 - DNA, 582 bp, Homo sapiens
cagctcctcccctactttttgtctgctcaggctactttctgaagggatcctaaagtgcaacttatcaacatattagctggcctgttatactatctaacttcagcaattatcacctcatgactcgttgtttcatctgtagcatctgcttccgttccaccagattatttgaataaaataccagagatcataccattttatctgagccccatgggtcagttttgtagggaatgccttgaaatatggacgtgtgcctgaacagcaagcccattgtttggtcttctaatgggccacagacttttcccacaaagcactgacagatgaatcattgaaattccaaaattcgatagaacacggccagagtgattttaatatagaaaacttctgtggtttgggtagaatggattggcgcagaaatatacaacagaatgtttcttaatttttaatattttgggctagtagtctaatttgcagattctgaatcatacaatatcgcccttctacacatacacacacacacaccccccacaaaaacatttgtttccctagacaactttcatttaatgctttctagaaaggggaatt

SEQ ID NO: 16089 - DNA, 496 bp, Homo sapiens
cttgaggagggttctttcaccagtgtgagcatagctgactttgggattcttttgttgtgatctgtggatcaatcctgtccctgagctctcctgattttgttataacagcagagtccacttagattttaaccatttgatcagcagagccttgtttttggcctgttgtgctgcatgatttacagtgtgcatctggatttgtaattatgcctcacatagtttatattttgattcacttcaggcttttctgctttctcctctttacctgcctctagggccatatggagtggaagtttgcatgttgttgtaaaagcattttgaaatgttcatcagactttcatggtttccttacttcccttttaggttttgcattttaaattaggttatagaattgtgaatttaccaaactatattgtggattttattcaaacagtttctgtgggtatgaaatactggtcatgtgtatgtatcaatattttatatggaatcattatatttc

SEQ ID NO: 16090 - DNA, 662 bp, Homo sapiens
aggccgaggctgagccagagcctgaactcgcatgagaaggggacaccccacacccctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgc

SEQ ID NO: 16091 - DNA, 642 bp, Homo sapiens
caatttatatcaccaaattaaactctagcaatgaatttattcaggatgttttaatattcattgaggcactatttcaaaatgtacatctgcttgcttaattacaatatttctgaatttgtaacacttgtcactattacatttagtcttaaaaaaactttagcaactgatgctgaattattaatttcaacattatgaacttttcaacttctaagtattgaggaagaaatactaagctaatttgactaattaatctagttgattatagtatatttatccaagcagagttaatctggcagaccaaaaagtttaaggagcctctggtaaaactataaatgaagccgactagcaattcagtgactaaacaagttattcgattgaaaattaacactttaggccgggcgcggtggctcaccgcctgtagatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtct

SEQ ID NO: 16092 - DNA, 671 bp, Homo sapiens
ggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagagaggaagaagagc

SEQ ID NO: 16093 - DNA, 518 bp, Homo sapiens
ttcttgacctatgagaaataaatgttgtttaagccacccagtatagttttctgttacagcaggcttcactgactgagacagttgtaaattctgattaagtttacagtcattggacttgaaataatcgtgctgcttccccatcacttcagctcttctgatctgtaggtggtgcatacaacatgatttcccattgcttttaaaagggaattctgatcttagaaaactacccttcatgtttagtgataagtaattgcaaaataagaactatttggtgattaaacagcatgtgttctatagcttctactttcatcataatatcatttgctggttgggcttagttgcagttacgacatctggttcttatgaaacgtgtaaattcattcaacaaatatttatagaatgccagttctatggcctgcattttctaaatatgtgggaatggaagtctttgggaagctgataaagtacataacacattattggaacatttcaccattaggtaaaaccatgtgtttttt

SEQ ID NO: 16094 - DNA, 674 bp, Homo sapiens
gcgggggccctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcag

SEQ ID NO: 16095 - DNA, 463 bp, Homo sapiens
cgaattcggcacgagccgcgcccggcctggcctgttcctttataggtaactaaccctattgactgcatcttgctggatgggaggtgattttggggtgtgtgggtgtttatttgcacaaaatggtggagggagctctgacaagggtgaggcatgacctgtgcaaacacaggagggaatgaagaggctcctgcctcgatggacagagcttgggaagggcttgggggcctatgactagttcctggtaaaggaggaagggcaaaaatcctaatgcaggactgttcttaatgaattcaaggactgaaaggagaccaggttggtacaagactaagaggaggagaggtgtatgagaagatactggagcgcaaagcaggtcccatatcactcaagaacttacagggcatagcaaggcattaagattctattctaaggtcagtgagaagccattgtatattttgagtatggg

SEQ ID NO: 16096 - DNA, 508 bp, Homo sapiens
  misc_feature 290, 291: n = A,T,C or G
acagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcatnntttcaagaaaacagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatgga

SEQ ID NO: 16097 - DNA, 526 bp, Homo sapiens
ctatgtaatcaggccagaatagtctctatttgatagacagacgttaaagaatttgaactcaaatcatgggctttgttaaaactaacactgtagtttactaactcctagctcaggactctagggattacactatataatcatatcatgatagtaaagactgcccaacatgtcatataaacagggaatgaaagctgagtgtagtggctcatgcctataatcccagcactttgggaggccaaggcaggcggatcacatgaggccaggagctaaagaccagcctggccaacgtggcgaaatcctgtctctattgaaaatacaaaaattagccaagcgtggtggcacacgcctgtaatcctaactatttgggtggctgaggcttgagaattgcttgaacccaggaggcggaggttgcagtgggccaagattgtgccactgcactccagcctgggtgacagagcaagacctagtctcaaaaaaaaaaaaaaaaaaaaaaccgggcccttaaaaattttgggggggctttttc

SEQ ID NO: 16098 - DNA, 682 bp, Homo sapiens
ggcgcgggaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcag

SEQ ID NO: 16099 - DNA, 563 bp, Homo sapiens
ctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccagttgtagattgtggccgggagcagtagctcacgcctataatcccagcactttgggaggccaaggcggacagatcacgaggtcagcacttcgagaccagcgtggccaacatggtgaagccccatctctactaaaaatacaaacattagccaggcatggtggtaggcccctgtaatcccagctactcggtaggctgaggcaggagaatcacttgaacccgggaggcagaggtttcagtgagctgagactgcaccattgcactccagcctgggcgacagaccaagactccatctcaaaaaaaaaaaaaaa

SEQ ID NO: 16100 - DNA, 599 bp, Homo sapiens
acccgtcctgcagacgtggctcccccagggtcactgtgcactcgccctgaggtccacgtgagacacagaagcagtgggggtgggggacgggctctgcatggccgaccctggtgtggatggcgctgctgcaccagcctctcgccggtggcctcgttccccaggtccaccgcctctgctctccctccagctcctgggtggcgattgccccgaggcttaagtccaggcctgccatggttgtgggctgcctgggtgagcctgggcgtggatggaacccggtggagaaagtgggtttcctgggcaggcgccatggttcatgcctgtaatccagcactttgggaggctgaggcggggggatcacgaggtcaggagatcgagaccatcctggctaacacggtgaaaccccatctctactaaaaatacaaaaaattagtcgggcgtggtggcgggcgcctgtagtcccagctactcggggggctgaggcagcagaatggcgtgaacccgggaggcggagcttgcagtgagaggagatcgcgccaccgcactccagcctgggcgacagagcgagactccgcctcaaaaaaaaaaaaaaaaaaaaaaaa

SEQ ID NO: 16101 - DNA, 481 bp, Homo sapiens
  misc_feature 397: n = A,T,C or G
gtttttaacctgggcatatgttctaacacatttactctccactattcgtactctggtagccatgttaaccccatcagagattccttctcaagccatgtctcagagctgagaggcatcccagcaagttttgcagctcacagttttttccgtaaattacttattctataaaattggagtaggccataaactttggagggccctagaccaattttttggattatttttcgtcttctatcattccgctgatcttagatattctctgcattaaatattaaatatcacttctaggctgaaaaatccaaattctgcaatagaagatcacaatgtgaactctgcatctccatgttaaagtctaatggacattcacacttagcatgtctcaaagaaatctcatgtnaaccatggccatcctgttctaccttaactttctgagtctatggaatgataatttcacatctcataaacttgactgatgtaagtg

SEQ ID NO: 16102 - DNA, 621 bp, Homo sapiens
cccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgccaagatccgcaaggccgcccgggaactgctgacgcttgatgagaaggacccacggcgtctgttcgaaggcaacgccctgctgc

SEQ ID NO: 16103 - DNA, 634 bp, Homo sapiens
cttatgcccacaatcccagcattttgggaggccaagatgggaggatcacttgagcccagaagtttgagaccagcctaggctacagagtaaggccccatctctacaaaaaaaccttaaaaattagccaggtgtggtggcacgcactgtggtcccagctgtaccagaggctgaggcaggaggattgcttgagtccaggagttccagaccagcctggacaacatggtaagaactcatctgtacaaaaaataaaagccaggcatggtggcacacgcctatagtcccagctacttgggacggtgaggtaggaagatctcgagcccaggacgagactgcagtgcacaattatcgtgcttgtgactagccactgcactccagcctgggcaacataaccaaaccccatctcttaaaaaaggtggggaggggtggttaggaagcaagcaatgttgaggttctaacagattggtaccatgaacatgtaatggtaccaatccatatctttgtgctattttctctagaagcacctagctccctgggtacaagagcagggacgacattattgtttagatcctgagtcaggatttgtagacagataaagtatactaagaaggaagcaaggggatgaaagtgctggtga

SEQ ID NO: 16104 - DNA, 630 bp, Homo sapiens
cccgcctcgggcaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagtccaggcagccagttgctgctttgcaggaattgagcagaaatgcactcggaatcgcg

SEQ ID NO: 16105 - DNA, 541 bp, Homo sapiens
cctctttttctacagttactcccaaagtttcaaacagtgagccagatcaggcaactaacagaaaatggatgtcatcactcttccctactgccaaccaactgcttttctgagggattaggcacaggccccattttcctgaacttcacatcaggaagttcaattaatctctctccccaccacaccccacttccacacattttctttcaaaattttgtgcaattacacattcccttttgtacatttaaggaaaatgagtgtcatcaaattctaatatcctaagcagtatctaaaagagaccatgaaaccatattatttttcaacttttatggttttatagttttattgtttactagtattgcaatataatttatcttttattgcaaatgcatttcaaacactgctaaaataggttttttgaggttataataaaagtgcattccaatttccaagtaaccaatttatgaagaaacttaatatcaattttttaaattcagggatttcctatgtcataaggactacagtgactaccttcatagcaatt

SEQ ID NO: 16106 - DNA, 632 bp, Homo sapiens
gcctcatcttctctgggaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccag

SEQ ID NO: 16107 - DNA, 619 bp, Homo sapiens
gtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggcgtccttgcaaatgcgcttgcaggtcgggatgagaaggaaatcagtcatgttcttaattttttgataaggaatctttctcagccaagatttgcccctgttttaatcaatgctgctgaaataattattgata

SEQ ID NO: 16108 - DNA, 625 bp, Homo sapiens
gaattcggcacgagccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcactt

SEQ ID NO: 16109 - DNA, 637 bp, Homo sapiens
aggcctctctgcagcccctaaggaccttcagaaagtcagggctctgaggaataattttcaaaaaccattgttggccaggcatggtggctcacacctgtgatcccagcgctttgggaggccaacacagaaggattgcatcaggccaggagttcaagaccagcctgggaaacataaaaggaccttgtccctacaaaaaaatgtcttaaaattagccaggtgtggtgacacacacctgtagtcccggctactccggaagctgaggcagaaggatgacttgagcctaggaggttgaggctgcagtgagctatgattgtgccattgtctgcgtgacagggcaaaactctatctctaaaaaaataaggtttaaaaataaaaaatgaaaaaaaaccattgttgcccattgtgctcccagtctccactcccaccctagaggctgggtctccgcgacaggcagccttgagggcagcccctggaatagcccctgggcagtggcactggccaccacaggaacagactgagtctgtgtctctctcagacctcaaagcagatgagaagagttcgtgcactctgcctgagggtaccaactcctcgccccaagaaattgaccccaccaaggagaatcagctgtacttcacct

SEQ ID NO: 16110 - DNA, 631 bp, Homo sapiens
ttttcttcaaaatctgtttcttttgggtgtggggagaaggaatattttctattctccctatcctagattttgcttatttagaaatatacagcactggaggccgggtgcggtggctcacgcctgtaatcccagcactttgggaggccgaggtgggtggatcatgacatcaggagatcgagaccatcctggctaacacggtgaaaccccatctctactgaaaatacagaaacttagccgggtgtggtggtgggctcctgtagtcccagctactcgggaggctgaggcaggagaatggtgtgaacccgggaggcggagcttgcagtgagccgagattgtgccactgcactccagcctgggcgacagagtgagactccgtctcaaaaaataataatatacagcactggagagtatttacacataatcctaacagacatatgccagtagggcaaagccacattgataaacatgagtatccggtcccttccaagcactgccattaatgcaacatctgctctagccaggctttaacattgcacacattagctattcttgtccctgcctgcatgctattgtacatgattctgtgtctacttggatttattatcacctatcaaaaccttgcctgtcctct

SEQ ID NO: 16111 - DNA, 627 bp, Homo sapiens
agccactgcgctgcagcctgggtaacacagcaagaccctctctctttaaaataataacttaaaatatattaacttttgaggaaaattttacattgaaccagaggagcaactgtgtggtagctgaggttggagatttgaggaaacggtgttattttatatgattatttttgttatatacattttatctgatattatataccagcaagcaattatattaatagctgaaaatttacatattttataaacatgaacattagccattaaaagtgtcacaacagttccagtgtatatgcatacatattaaataataatatatttaagaagtgtaattgcataactcaaatggaaaaaaaatctctatgtacctattacaccaatattttgtttcatgtaaatatgaggtatattaatattaggaaatgatgctttccaatattggtaatactatacaaagtaagattaaaatgccagtgatcctgtggactgagatgtgctttatatctcttgaatgcaaaattaaatgaatccacacatatatgatcaaattattttcagtgggaaaaaaatcttttcaataaatgggctggaacaactggataatccctatgtgaaaaacaggatataacc

SEQ ID NO: 16112 - DNA, 600 bp, Homo sapiens
cgccgtgcatatcacgcccttcccccacgttccccctaccccaggacctccttgggaggtacacggaggcccgaggtcagaaagcacttctggtccaagctgaggcaaggccgccccccatcccccaccccctgcctgcctcgccactcaacaccctggcgttccgaacaccctccatggccaaagtgaccactccctgtctgctgaagtgttttcatccccatgctcacatggacacccagccaccagcgtggtctcaggcacatgccagggctcaccacactgacctcatcgcgtctgggggctgcctgggctgtcggcaccacccgtgggggtggagaggaaatggacactgcccatgggtctccaaaagtggccgtgagcatctgcctccccgggtgccaaacccacgttccctggagccagctctgtgcctgcagctgggcgtggctgacaagagggaacggatcctttactaacatagagggaaagccagtgttgggcatcttcatactccagagagagggacattcaatattacgtagcccctgggatgccaggtgaaccatactcccagggatcccaagtccagcaggaatt

SEQ ID NO: 16113 - DNA, 607 bp, Homo sapiens
ccagccgggtgctgatgcgagtcggtggcagcgaggacattttctgactccctggggcctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtgga

SEQ ID NO: 16114 - DNA, 610 bp, Homo sapiens
tctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagca

SEQ ID NO: 16115 - DNA, 628 bp, Homo sapiens
gcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctg

SEQ ID NO: 16116 - DNA, 593 bp, Homo sapiens
agccgcatgtacttactgggtaatcagtcaattagtgtgtactaagtagatcagttaattgattttctgcttcatccagttatttgaataggtggtaattgtaaggtgataagttaacaattttaacttaactgataacaactctagaatagaatgtggtaatgagtataaaataatagatattctccagtaatatttttttgaaagatcactttatgaacatggaaaattcttccactaatcaagaaaaatagctgtcaaagcatagctgcaggtcaaatacaggttacaaaggtgttctataggttaacccatgacttccttgtcttttgagtacaatgaaattattgtaactaaatgaaactttcatcccctgttatgcatgaatcatttcctttctataacagacataccagtatacacttctcatctgttaaaaaacatacccaacttctaaatgttgtttgccactgttactgagattacaaatgatatctatgcatttttgagttgtttttttaaaaaggcatataatctgaaacttagtccccttggtaatttgacctgagaaaatttatctcactgatagactt

SEQ ID NO: 16117 - DNA, 415 bp, Homo sapiens
tcgaattccgttgctgtcgatccggctggtctggtttcagcttctttgagccttacttgaagccatgttgctataggtgaagcctaaggttttaggaagttctactggaaagaggggtggttgtttaacaaggcatttcaaaaggaatggcagtcattctggagtgcaatcattacagaaggatttggcctctaagggcctctggaattctttggaagaaggcattggctgtgtagctgacactctactcactgtggacatgagtgggtttttggtgacatgagggacgagggcagggacaagtgctgccctgaatgttcctgcctggccggcaagaaaggcttcttggacatttgccttttagacaatggaatgtgttttgctcttgcagaggatggtcttggagactgggatg

SEQ ID NO: 16118 - DNA, 509 bp, Homo sapiens
gtgatggcttgccacataattcttgtcataattgagtgtcctctctttcccttccatgtcctgtatcttctcctttcttactagcttttactccctgggattcttaaggctttgtggtgtaattataataatgctttgtatttgtaccggatttttcagcttttaaaagacagttttatgtttcttatttgagcctcagtaactgtcaggacaggtattatctctctaatgtttacaaataatgaaactaatgctcttgtagtgacagaagtggaactgcaataagtgttctaattcttaatctggtatttattctcctatcttgtgctaccttccttcaggtatttgtgaacacagtaataacaaggatttgtcaaatatggtataagggtcagtcagtggtttacaaaccctaatatcttctttttttcaaacaccatatttagtagctgtgtgtcctattgactgaagatctaaaaacttctgtctggaagttttgtatgtgatgg

SEQ ID NO: 16119 - DNA, 313 bp, Homo sapiens
cttctgcacccaccattatatggcagcctgcacatttttcctcagtttaaatggagccttttcagagaagtcttttctgattaatctatcaaaatacaactctctgtctctctctctctttctgtcactctatcttggtttcttactatcacagtatttttgtaaactgtgttaagaattttaaattgtatcttaagagcattgggaaagccagtgaaaggttttcagcaggtacgtcttatgatggcattacatttttgaaagatcattctggctgctgtgtgagaaatggactgtggattgtgaaggtgag

SEQ ID NO: 16120 - DNA, 524 bp, Homo sapiens
cgtgtgctgtcgaaacatgctaattgattttcaccacattaggagctgcctcttaaaaaaccgaagcagttggtccaaaatccataagaaaatctttgactaccactggtagacttcagcaccttggaatgttttcaataaccacagtgagactagtaagaatacttataatatctcttctgagatcagctctgctgtgcttattcttaaaaatatggggccgggcgtggtggctcatgcctgtaatcccagcactttgggagaccgaggtgggtaggttttctgaggtcaggagtttgaaaccaccctggcccacatggtgaaaccctgtctctactaaaactacaaaaattagtcgggtgtggtggtgggcacctgtaatcctagctactcgggaggccgaggcatgagaatcgcttgaacccaggaggcagaggttgctgcgagctgagatcgcaccgttgtactctagcctaggtgacagagggagactctgcctcaaaaaaaaaaaaaaaaattttttt

SEQ ID NO: 16121 - DNA, 653 bp, Homo sapiens
aaaaaagtcccaagaggtgcccaggattcaccctggcaccaccaaatctcaatctctagagggaaagccttctaagaaagttatttctcaaaagattttgaaacccagtgtcatgaagaacaaaagtgccttgtgctccatattctgtttcctccctgtgaacagaacatgctgggcaggtgggagtccagtcatggtcggatgtagtctctatgcacagaggcagacttaccaaaatgcaatcagtgcaacatatatgtaggtatatattttgagacagggtctggctttgccgcccaggctggagttcagtggcatgatgttatttctgctcactgcaacctccacctcctggcttgagccatcctcccacctcagcctcctaagttgctaggactacaggcgtgcgccaccacgcacagctaatttttgtatttttagtagagacagggtttcactatattggtcaagctggtctcaaactcctgacctcagatgatccacctgcctcagcctcccaaagtgttgggattacaggtgtgagccactgagcccagtctttgtatgtcttttgaatgttgcacaaatgaaagtatctgctatccggaaaaaaatcattccagtcacggtgtctcatgcctgtaatcccagca

SEQ ID NO: 16122 - DNA, 465 bp, Homo sapiens
tcgattcgatgccgttgctgtcgatttttctcctttctggtcttcctttttggtgtagcatctgtaggaaatgcatttcttcatagctaagtgtacctccttgtgaaatatcttcagagtctactggtgcacataagcaattgctggcagcagcttgagggtctccatctcacatttatcatatgccttattgcatgaggctttgcaagaggaggtctagagctacaatatctcatggatatgaatgtcaattcaaatcccagtggcagtttatgagggggaaagcctagaagagaagaaacctagaggaatcaagcaggaggggagagtaataaaagactagagcagcaggtttttcttaactcaaactagaattaaatctctgtgtgtgtgtgcatgtgaatgtgcccgtatgtgcatgcatgcacgtgtgtaaatggatgtgtgtgtgtgtgcatgtgtgtg

SEQ ID NO: 16123 - DNA, 589 bp, Homo sapiens
tcgcggccgctgctttagaacccccatgaagggggacagttaattgtctttccttgagttttcagtcaattcatgacactgtgcaaataggagaaataattatagttttgccaagtggcagaatatgtttgatttaatcttttatgacttataactgtacttagttgtgaagagtccattaatgttaattttgttatgccatgcatttgagagttatgcatagatttccttgtattttctccatattctatgtaaaatagctgtaactgggaacaatcattttttccttatttttgaagccaaaacaaaatatttcaaagtaaataatttcagctgtgtgagctgcaagtaggccaaagaaaacaagacagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaat

SEQ ID NO: 16124 - DNA, 616 bp, Homo sapiens
gtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtgctttgggaggccgaggcaggcggatcatgaggtcaggagattgagaccttcctgactaacatggtgaaaccccgtctctactaaaaatacaaaaaattagccaggcgtggtggcgggcgcctgtggtcccagctactcgggaggctgaggcaggagaatggcgtgaacccgggaggcggagcttgcagtgagctgagatggcaccactgcactccagcctgggcgacagagtgagactctgtct

SEQ ID NO: 16125 - DNA, 262 bp, Homo sapiens
gtctggggatgatataagagtgaatgagtaaatatatgtttggaattattaccaggtcaacattaggaaatctgttgagtcaccctctacattaatagattaaaggagaaatatgtgtgatcacttcaacaagtgccaaaaagcatttgataaaattcaacacccattcctaccttcctaatgggcagtggaggtggggagctaaacatagaagagctaaaaactccatctcaaaaaaaatatatatgtgtgtgtgtgtgtg

SEQ ID NO: 16126 - DNA, 705 bp, Homo sapiens
acttttctctagcatcgtaggaggaagaaaacaaacacatcagatattttcagcactaaaagagatggttttccccacatatatgtaaaagaaatttgcaagactactgggtatcagaatggcaaagcaacttaaccttccagaaaatacagatgattggacaaaagaggatgtaaatcagtggttagaaagtcataagattgaccaaaaacacagggaaattttgactgaacaagacgtgaatggagcagtcttgaagtggttaaaaaaagaacatcttgttgatatgggcatcacacatggaccagctattcaaatagaagaactattcaaagaattgcggaaaacagccattgaagattcgattcagacatctaagatgggaaagcccagtaaaaatgctcctaaagaccaaactgtgtctcaaaaggaacgtagagaaacttcaaagcaaaaacaaaagggtaaagagaacccagatatggctaatccgtctgcaatgagtacaactgctaaaggttctaagtcactaaaagttgagctcatagaagataaaatagattatacaaaggaaaggcaaccatccatagacctgacatgtgtatcatatccatttgatgaattcagtaatccatatcgttacaagttggattttagtctacagcctgaaacaggaccaggcaatctcattgatccgatacatga

SEQ ID NO: 16127 - DNA, 610 bp, Homo sapiens
ctttcctatatgaactgtaacactaggtagccaaatagtaaatgagggaaaatatctctgtataaacatattccaattcatagatgaaaaaagaattaacatatcactgtgttgcagcctctaatgaatgaatacatataggtatttcgcatgaatagttgctaatatcattaaaaagaaagacagccagacattatatacctcttgatggaagcacacaacactacctatagtcatgccaaacggattaaacccaaatcttaattcgctccttgttttcagaaaaacagaagacaagaacaagttgaaatatgcaattgaacatgcaatttgcaaaattcagattgggaaaactcttggatttttcaacagataaactataacaaaaataaattacagatgaaaacacaaaagacataaaaaaatgtacgaaggggcaagaccacactttaatgcctaaggatgcacatgaacacataaagatgcatctcagtgataaagaatgaagaatgcaaggaaataattactgtaaaagccagaataatggttacttatggtgggaggaaaagagaattgcaattggtatgggatatttggaggggtttggctc

SEQ ID NO: 16128 - DNA, 623 bp, Homo sapiens
tccaggtttcagttcaggactaactggatgattagatgactaacttatatctgccccaataacctccatagaattgattttgaaaaagcctccaccagcttcatttaggaagaggaatagacagcagtagtcaaagtagaataagggatttcaaagaaaggtcatttacagaatgtctctattttttaagccctcttcctgaacaaattttctaaatcccaaactggagaacagcttcagaagggcaaagatctttacttactcctacttgccctacagtgcctcactcaaagcaaaacacttgtcaggtactcaataaatatctgttgaataagctgccatgaactcacctttgggaataggtcatgattacagggtttttagattgagaatactctgaaatcaacgctaccagctctggaattccttcttccttggttctctccccttcattcttcccaaaattccaaccagtttcctcaacctaatttatgccaaatacccgaagtgttggacttcaagaccccaaatatctcttttgaagaatgtcccagaagaacgtataggaggaaagaatggataagaattgacctgtctggtaaatcacttatgtacttataaat

SEQ ID NO: 16129 - DNA, 572 bp, Homo sapiens
atccctggcagtcaagagactcttgagaaaaagcatctaagcaagtccttgaatgatgtggcatttcaataaaagagatggagaggaggcatttgagataggaggactagtaggagatggagaaacttggagcatattcagggaaaagcatcaagtccaactgagttagaactggtctatatacaggcatcaaaactggagaacattcagtgccaaatgatacagtcttgaatgccaactaggaattgtgaatgcattaaccaataggtgtcattaaaggtacttgaacaggggagtgttgtggctgtgcttcaggaccaggctcttgtgagtagcttggggggagatcgggaggagaggcagggcagaaactagaggccagaaagccagttaagctactacaacccaccaaggaaaaagaggggcagaaaaggcctgaaatggatgataacaatgaaatgggaaaggaatagatgcaaagggaagaactgacagaatctgatgtctcagtgaaggaacagctaaagctgacactgcgatttccagagcagtggtacccatggaggaaactc

SEQ ID NO: 16130 - DNA, 166 bp, Homo sapiens
ttgaagaggatcaacagtattgctacatagaaaatctaaagcatctatatgacatatatatgacagcatcaaaaaaaggtaaaagacaaatttcaaatttgacaatatatgcaactatatccataagatcagtatctttggtagtcttatgtaactcccacaaatc

SEQ ID NO: 16131 - DNA, 587 bp, Homo sapiens
caccccttctttcaaactgcttttgaaaaacccctaacctatgagctttggacaagatgattggagtatgaactctgtctcccctgtgacatggttgggctcgtgtctattaaactctttctctactgtgatgctgtagtccttcatgcagcagacaggaagaaccccttggacagttataaagatattaaatgaaaaaaagttcccttatcatccccgataccacacctgactgacatagtaataacagtattgacagtagtgttagatagataataagtgtttatactaatcctcacaacaactctcctgatacatggatattattgacactttatagatgaaaatgaaaattcagaaaggttaagtgtattacaaaaatttagatggctgacaagttacaaaaaagggtgaaattcaaatgtatttactccaaatttaagcttctgaacattccatcagagttgccttgcgtgtacaccactggattcaaaatacccaattagattcatgatgagtatgaagtgctcttattattttggttattttttattttgtaaatatcatgcagtgattttctttctctg

SEQ ID NO: 16132 - DNA, 464 bp, Homo sapiens
tttaatattcttattgaagtattattagatagaattttattagaatgcaatggatctcaattcaatcagaaacaccatctctactaaaaacacaaaatatcattatgtttaaaactttatctctgtagttaaatgtaacattatcaccaaacagaacctgaatttgttttctggaagctatttcatcactaaacgagtaatgtaaaatgttaattgcagcctgccccatgttttctgcccctattaccaagggcaatcacctacttcacttctttgaaaagccaaaaatctcaatatagtgaagatagctgtgggtaaactgagcttaacttttaatccacacttacttcttctggtatagaaagccattaaataggagacaatgaggggaccaatgtctcaacttacagattccctggagaccagtcccaacggtctagcgttagcttatgtctgcagggctg

SEQ ID NO: 16133 - DNA, 458 bp, Homo sapiens
atctcaaaaaaataataataataacaattttgtacttttccttaaacagactttccaaattgtgtaagattcaggctccacaaaagctgaatcttttgtgattctgcttttgtgaaaggagaataagaaaattagtaaaacttcacatttattatcaatgtaaagtcccatagatgaatcactgattgtctgaagtgtatttgagacttcagggagctcagggatgaaactgatgatttgttgtctaaagtactcatcatgtcttttgaaatggctgctcttccagagggctgcaaggtaagcaatgtgtgaatagacagttagcaagcatgaggagagatgttggtgctggagatggaacctgggcaccatcagcacagtcatggtatttcaaacaatggagagagaagtgcagtaagacaggacctgaaaatagaccttcacatttacccatcagt

SEQ ID NO: 16134 - DNA, 516 bp, Homo sapiens
ccagacttaccacttggtttcagtgtgtgtgcttacattttttgtaatgatgatgatgcatcaaatgtttaattaaatagatagaactcaacttttaatctagaattagcttaaattccagattttaattcatagattctaatcaggtagaatctatggtgtgaaaccattgaaataatttttggaaatccatgaagtctcaaatttgagaaataatgctataaattaaaatttgttgtcataaaattaaagcacaattaaatattactctggatgtaattgtatagccttaacataaatgttactcactaaacagaccctcaccatgtgtttttttctaccccaactacatgctttggattaagccattatttatatatctgaagttttccacctaccacttctacctttctaaattctatttattgttcatgtcttccctctaatgttatattctctataaaaccttccatgatcacataagtgggagttacctagttctacgatctttgtctt

SEQ ID NO: 16135 - DNA, 545 bp, Homo sapiens
tgaggtccttcttgctgtgtcatccagagagtatgagaaagccagaaaggaaggaagccaaatttatcttttatcagtaaccaactcccaagataactaacccactcctgcaataacaacattaatccattcatgagagcagagccctcgtgacctaattacctcttaaaggttccacctctcaacaccattgcattgggatttaagttttcaacgcatgaacactttaagattcttaaagtggtttcttgagatagaatgtactgctatggcttgaatgtgtctctcacattcaagccatagcagttgtgcacatatactataaggcaacaggaatcatccataaacagggggtatgagtaagagtaaggtaactataaatagaaaacatatgtactgtgtacaaatagaaggtaagcttttaaaatggcattggcaggagcactgaagcagagatttcaggggacaagttatcataatggtgggggaacagcattcctgctgctgagtgggcttagaccagcctcctctgactttttaaaaaa

SEQ ID NO: 16136 - DNA, 544 bp, Homo sapiens
aaagggcaaacaagctctctggcttttcaaaataagggcacaatccattcaccagagctccaccctcataacttaatcacctcccaaaggcctcacctcttactattactacattaggtattgtttcaacatcagttttaggaggacacaaacattcagaccatagcacaatcctacaaggtagatggtattatcctccttttacaaatgaagatactggtgcttgtagaggtcgagtaattttctcaagactgtagaacaaataaatataaagtcaagattcaaaccaaggtctgctgataatacactctctgtggttcctggtacttatttaaacaatactgaatgaggttcttcattaaggtccttacaaagatagtagaaaaaaaatacctgaaaaagaaatagaatggctgggcctggtggctcatgcctgtaatcccagcactttgggaggctgaggtgggcagatcacttgaggtcaggagtttgagaccagcctggccaacatggtggaactccatctctactaaaaatacaaaaa

SEQ ID NO: 16137 - DNA, 394 bp, Homo sapiens
  misc_feature 335: n = A,T,C or G
atgtaaataatattatataatttgggatcgtcagtttgaacagtaggttccataatatctcctaatttctttcccttctatatctcccagttcatgtgtacagaagattttaactttacattatctgtaacaaaactttgtcaagcctttattatgtttcacattaactatcatataattaaattatttacaaggtagtatttaataaagtcattttatgttacacacaaataagagaacattgaaagatcaacaaaagctttacagaagagatggaactggtgtggaggaatgggtagaatttggataggctgaggtgcatgttagaagataangaaatgtgtgtgtgtgtgtgtgtgtgtgtgtgtgtgtgtgtgtgtgtgtgtatgtatgt

SEQ ID NO: 16138 - DNA, 498 bp, Homo sapiens
aaggatacaaataggaaaacattccatgctcatggataggaagaatcagtattgtgaaaatggccctactgccaaagtaataatatgtagattcaatgctattcccatcaagctacccaatgactttcttcacagaatatgaatttcttaatttataagtaagcaactggaattttgatgtttcaaaacactactatgaattctttgaggcagatctttccttttctttttttcctccctgtttgcccccaggtaagcaaacagtaggtgcttgttaaatttgacataagaattgtgtagtcttagtccattccagctgctataacaaaatagcatactctgggtggcttataaataaataaggggaagtccaagatcaaggaaggtgccagtatacttggtgtctggtgaggacccactttctggtcatagatggcgccttctagcttatgtgctcacattgtggaagatgcaaggaagcactaatcccattcatga

SEQ ID NO: 16139 - DNA, 523 bp, Homo sapiens
gccaagtaggcaaccctgaaggagacttgggaggtggaagtgggcagtgaaaagcttcgagacgacattagctcttgtaagcacagtagcagaggtgacatttcaatttttagtcctgagcacctgtggcaggaggcagtagctgtggagttcccctaggagaatcccacgttctggctgaacatttctccagaatggctgcatcattcctgataaagtagaatgcaaacttacttccatgctcccccagaaattctgtaattgccagataccctgaaatcaatcttgttctgttcaaactactgtttaggatggattccattgtttgcaactcatagactaacctcatagggtttgggggaagattaggcatattagaatatgaatatatgtaacttgcatatactgtgcacatggtgagccacattattatttttattagtgcatcacctgttgtaataaaatcaagcatgctgcaatttcttaagaattttctttgagagactgaggtgagcagatcacg

SEQ ID NO: 16140 - DNA, 503 bp, Homo sapiens
ccatgtacaagtcaaggagaaatattataaaaatattgacagtgctctgaggatgggggttttcacaaagctcaaaacaggtcaaacttcttcactggctgccagctcttcacagctaccaccctggtactaggggttgggtacgtgggaatagttccaagttaaagcaccatagaccccactgttcttatgaagctcggcagttatatttgagtgaatgcttttcagtgtgttctgtgcctttggttaattttcatagttttaaaatggttggtttctattggtgttttgccagtatttttgttgcttttgtgggaagaggattcactgaggtcctcaccctgacattctgaaagtgttgtccctaaccttgtttttgaaatatatttatgttggttagacttttaggttgacaagtttgtttcctttcaagctgttgctccttaaaacattggaaggaaacaaataaacaatacagtcttttggcttgcattgcttggatg

SEQ ID NO: 16141 - DNA, 507 bp, Homo sapiens
actgaacgggttcaaatagcctggtatttccaggatcttataaaaactttgcagtaaccaggaatgcagataagttgaggaagactcagccggaactcttagccattgctctcaacccttactgattcatgaagggaatccctcatttctgagtataattgaggacatgatcagctgaaggagcagaaggaagggaaaaatgaactactaaatgctgaatgtgtgcttacgtaccagtcatttccttggtgccagccagcagtgtgtctattgagcaaagcatggtagattttcaaagaaatcagctggataaattccagtttaaaatggcatctggctagctattgctgcccgtgacacagcctctcttgatttccaattaacctctctaatgaagacacagaaacagtgcagccctgccatcgtaaaagtggagacgctctttccctctccctctctttgcattggctcagagacatagcatctgcagcaattaaaaaattggat

SEQ ID NO: 16142 - DNA, 271 bp, Homo sapiens
agttggttggtcttggacactgggcctcctgtgtgcctagccttgggtttatggctgaaggtggacttgccctcaccccactgtcctttctcccactccaaggagggtgaacttcataaaccacaatgtccaggtgcccagggaccacaccttctggagttctggaagtccctcttttagatatgatcactgagaggctggtgctggtgaagggggagatggcaggcacaaaagcaagggagaacctggcttttgtggaaaatatgcgagt

SEQ ID NO: 16143 - DNA, 520 bp, Homo sapiens
ctggtcttgaactcctgacttcaggtgatccacccgtcttggcctcccaaagtgctgggattacaggcgtgagcccaccgcgcctggcttcggaattgcatcttaatctctgtggcggctgctattttgttttctaagttcatgagcacaggtggctgcctctatctttctcctccacttaagcaggaacaattcaggaggcagactccacccaatgctgcaaatcggccctattatcattgaccctgacagaatttcaggagtgtcaggccactccatactgcaaacagtacaggttgcttataatcgccaggaggaaagaaaatatccagcttcttcctggtgcaatcatggccataggaggaaggaatcataggaaacagagcaaaggaacaaagttcaaaacctgactttccacttggaagttctctcactaatcttaaaatcaaatataaagcttaaattgtaaatttagcggcatttccctctcagtaccctttccatattcccacaggtaagc

SEQ ID NO: 16144 - DNA, 244 bp, Homo sapiens
aaattgatgtctgacaaagatcttcttacgtgtagtaaatgaattctgctctccaaatatgaagtgaaactgcatcaattcaagaaatgcctacaatcccttcagcatggtggttccactgaaaggcccttaagaataacggatattttactcacatgttttgagattagtagaaccgtcgtggctttatgtgtctatttagttactacattcagaaaactgagggtataaaacaaactttaac

SEQ ID NO: 16145 - DNA, 624 bp, Homo sapiens
gatttttaaaattactctccattcttaattctcccttttcatgcctaacacccaaagattagtccaatgcatgtgctgttacatttagtgagtgtgagacaggggtcaccttcaggtagctgcgtacaagggggaggggcaaccacatgggaagaagatcaggaaggggtcttttgggtcttgtttccacaaagcaaacagattcatctcagaagttataaagtggaaacctctggattaaaattatcctgataattttagaaaataggaattctctcatcaaccaaattatctcatgtggcctttcacttctggaataggacttcatctcattactaaggactactgacttataaaataaattcgtttttggtactaacactatcaaatgtggttttttgagttcacagtcctcagctaattagaaatgaggccagtgccaagtaaacagaaagcagcaggaagaaatggtaaaagtgggaaaataatcctatagaaacagaaaatgtctaagagcctagcatctgtggtcagttaattcatcatcatttggtgtgctgttcttactatatcggctcatgaaataatcactgctgctgaaaacaatgataccaagtcagcaag

SEQ ID NO: 16146 - DNA, 670 bp, Homo sapiens
ctttccatttaatatttctgaaccttggtcaaccatgggtaactgtaaccatggatagtaaaactgtggataggggtgactagtgtaatgtagtttacattagggcttactcttggtatattgtacattctgtggattctgacaaatgcagaatgacatatatccacaacatatttttaagaaaaaagatatgctaaagtcttggccctgccatttgtcactcatccaatagagacacaatcacattcatagaattcatattcagtctctgctatgtaaactgaaagaagaaatgaaagaaatgcacttttcctgtctatttcctatttctattaatcaagatagctgttgataattttccctacaaatatatggttatagccacagtctgagagctgccttgctatactgggtagagctaatgtcaacaataccaaaggagccaacgggtgcttgaaagaggaaagactgaatacaacaaaagattcaagaactaatcttcaaacatatataagaatcatactacattatgacaaaacaaagtaaactcaatccaccattgtgtttcactgaatctgatactatagactgtaagtgtatggcagacacatctgatagcaataacttcagcataccctgagaatgaccctgcatggtagatgcacctgat

SEQ ID NO: 16147 - DNA, 400 bp, Homo sapiens
cttttattagattatgtctggaatatggagagattgttctgaactctctgtgtttagtctctctgctaaacaggtctctacaatctgtaccatcaatctgcctttctcttcttcagcctgtatttggaatagtatttccttgcctcctgctgttaaaatctgtttttcttcaacatacagttcaaaggaaatttcactcatggtacccagcacatcagaatttcaatcctatttctgttattcatgtgatttaatatatagtcttgtaataactattttaacttctcagatatttttatatgcacttactgattattagtcacatttcaggtaagattgctacataaaactataagcacttaatatatatttaacaatgaatgaatgaatgaatgactca

SEQ ID NO: 16148 - DNA, 317 bp, Homo sapiens
ggttctggagcagctttggcacctgaaggctttggaaccaagggcagaggaccccctgtgctcagtgcaaaaatgagacaaacaaaatcagtctacagaggaatagttccataaatgagaactgacatatagatggagaaattgtgctaagcagtttcttgtgcacaaatttgcggagaaaagggaaacttggaaaaacttcgtaataactaaccattagactgggtcatgagacgtcctctgaaactcccaacagttctccaatacctttccatacacttaaattaattgccaacatctagcagtgacccatacat

SEQ ID NO: 16149 - DNA, 457 bp, Homo sapiens
  misc_feature 148: n = A,T,C or G
aaagatgaatagaggaaagcaggtagttctggaggtggccattaggaacacaatacttatatgaactaagagttgcggcctagccttaaaaacgaagacagtagcagtaacaaacggctgacctctacttccctttatttctctattntacatagcccagtaggggaataagctgaatttggctcttgctcattccatcagtacccaatttttaaggtttattatcagacagggacataacattcaaacttagaggacatcttcatggctattacaatgcacctgacggtggcaaagaggtattattaaacatgactataaggaaataggtttctcaaccctgaaacttaacataataagccaacatttttttactcaaaggttttacgtaaatatacctggtccatcagagattaagctgagtagaatttcattgattctaaaaaaaaagaaaagc

SEQ ID NO: 16150 - DNA, 560 bp, Homo sapiens
  misc_feature 365: n = A,T,C or G
cttaacatttaaattacgagggggaaaccctcacttcagtagtaattttctcaaagaaaagaatagggaatggattacaactaaatttaatttctttttaaattttcatcttgtctaattgcaggcatttttctgggttctttgtattcatatattttcacacatattttctgtagattttattcatctttaatttgagatgcttctcactattagagctcttgaaaaattgtggtatattttacatagaaaattatctcgagacatctatctgatctcaagtaataaagacatggtatagaaaataaaaggaaaatggttttccagatacccataaaaatatttttgacaaaatggcaacattnttcagttggctccactttcaagctttatttatttttttttcagtattaatgttttctctgttttgtcattttctgactggtttttaatgcaaaagttattataagcagcattctctcttcatatttctccaaaggacagtgtcagatccttgattaattttacaaaggtcatttggaaaaaccattaaaaacatg

SEQ ID NO: 16151 - DNA, 593 bp, Homo sapiens
ccaggcatttttctgtatatttatttctaatttctgtttctttcttatgaattgtctggttaagtcctttctcattatctcaaggtgttttagtatgagatttaagaatattagatatataagcccttgagctatcatattagttagaagtagttccccttttttggtcttttcatttttattactatatgtacaaaagtttaacatcctatggagtaccttgttcatggataggaagagtgaatattttaaggacagctctactctccaattggtttatagatgcaatgcaattctaatcaaagtctaaaaaggttctatgtaaaaccttacaggtttactctaaaatttatatggaagaggaaaaggctaaaagcatccaaaatacacttaacgaaaaagagcaaaacagggaggtttgtctcccagaaattaagatttattggaccgggcgcagtggctcagggccgggtgcggtggctcacacctgtaatcccagcactttgggaggccaaggtgggcggatcacctgaggtcaggagctcaagaccagcctgaccaacatggagaaactccatctctactaaaaacac

SEQ ID NO: 16152 - DNA, 577 bp, Homo sapiens
cgcagctcacctgcaaagtccaaaggttgagatgatcaagagggcaggtgaactaacctaccatgttctagaggcacaaaattaaagggagacttatttcttgtctgcaaagtcccgaaaaccttgtctctaccccatcagagaagtgtagcatcatgccggacggaataaaaggagtacctaagaagggaaaagagagtgactctatgtagtaaggtccaatagaaaagtagattttgaggcctggcaccaaaacaatcacttagtctactgtaaacaaaaagtatttcatgcttctaaggaatcacctgacagttaaagacctaacttcatttatagtattttcttgatgccctgaatctttctaaaaatcccctgactcaaaaaatgtatacagactattttcacctattcatcctgagagctcagaaattacagagcctcagagttcccatgacctacctgtggtaagtactggacctaaaacaatgtgcatttagagttcacaactcaaattcaaatataagttcactgcataataaccaaacacgggataataatctaagtgtcagtcgat

SEQ ID NO: 16153 - DNA, 384 bp, Homo sapiens
gctttgactacccaaaacctcagttcttttccatcacaggtaaatatttgtggtttagttttgtcttgatcaaacaacaacaacaccaccaccaacaccaaaaaccgaagaatatagttgggaattcttcattcaagatagcggaagaaggaaggagctcatatcctttggatgtctcttggcacatcatgacaaattcatcctggaggtttatctcttaagaggaccttttaaatacatatacttgaataggtcctgcatgatagcaaattctgtgtaaaaacagggagtgttgcatcaatcaatgtcttttcctgtactccatgtaaggaaaaaactttcttgaaaatcctacataactccataacctctgcagatttctta

SEQ ID NO: 16154 - DNA, 631 bp, Homo sapiens
atttaaattttcttatacttgacatgtggctcttgtcaattttataacttggccaacatcatacagttgtagtgatgaagctgagacttaaatccaggattttaaatctaaaactaatatttctaaccatatcagtgtttgtttttattcaattggcaacactttaatgtttcttttctttttatcagggcaaaatttgatccctataaggataaaatatattcttaataagttgaaaggttgtatattttaaaatttttggttgccgggtacagtggctcatgcctgtaatcccaacactttgggaggccaagatgggaggatcacctgaggtcaggagttcgagaccagcctgaccgacatggtgaaaccccctccctactaaagatacaaaattagccaggcatggtggcacatgcctgtaatcccagctactcgagaggctgaggcagaagaattgcttgaccctattttattttgatagtgaatttatccatgtttattttaattatgaaatatgcaaccagcccaaatgcccatcaattaattagtggataaataaattgtggtatatgtataccatggaatactattcagccataaaaaggaatgaaataatggcattcacagc

SEQ ID NO: 16155 - DNA, 462 bp, Homo sapiens
atccttcctgagtctgggactatatgatgtaaacgcatttcttaaagtggagtttgaggacacctagggtagacgtagtgttgtggatctacaaatttcctttacaatgtaaaattgtgtgctttcatttttgagatatctaaaatatgattgtaaggattgtctggatcgtctacatgaccagcttctaaccaaatattaccaaccaatgttggtgtccctatgtgctgttgtgtttattattgcaactgtcccaagtcaaagggtaacaaacaaagagtagcggcaaacctaataagtttgccaaaatttcacaccagatgacatcatgtgcaccatggaatgaagatttttaagtagataaaagtggtagcaaaactggaccagcacagtagcaaaaaagccaaataaaaagactccaggcagggtgcagtggctcacacctgtaatcccagccccatg

SEQ ID NO: 16156 - DNA, 315 bp, Homo sapiens
taagtgtttataaaaggatccccttgtgtcagggagatccttcaggccatttcaaccattactgtattttatttaatttgcttaattgatatattcttagaaaattgtgtcagtgaatttttttaaataaaatccaatttttaaaaaccagtagacccaattttttaagaaaaaaatccttgtcctatttacttttgataatattttactattcggggtatggtatctgtaaaataaaaacataattataatgtgttacttggaaggattgcatgttcaagataactgaagctgaaaatgttaagttgaaaactt

SEQ ID NO: 16157 - DNA, 345 bp, Homo sapiens
caaactcccatataattgcaatttcattccattctcttttcagatatgcaatgagcagcaggttacagatagaaaacttgggcccaagctgtgagctctaggacttgatgcacgagttttccctctaggaggaattttcagttttgggtttcccttaaagaatttcacatagggccgggtgcagtggctcatgcctgtaatcccagcactttgggaggctgaggcgggcggatcacgaggtcaggagatggagaccatcctggccaacatggtgaaatcccgtctctactaaaagtataaaaagtagcttggcatggtggcatgtgcctgtaatcccagctactc

SEQ ID NO: 16158 - DNA, 274 bp, Homo sapiens
gtacaaaaacaatacaaaacaataccaaaaaacaaaaaacaaaaaacaagcctcagtgactgtgggaaagtggcaggaattatctagaattggggtctcagaagaagagagttgggaaaaggcctaaaaactatatttaaagaaataatgggccgggcgcggtggctcacgcctgtaacgccaacacttgggaagccgaagcaggtggatcacctgaggtcaggagcctgaccgacatggagaaaccctatctctactaaaaaaatacaaaatt

SEQ ID NO: 16159 - DNA, 498 bp, Homo sapiens
tctggttacattattttgtttgaattatacaattacataattttctgtaaccaaaatggtaattttgatggattttttaaatgccaaaatccaatcatcaaggccaaagaaatgcatgattactctgatttcttatgcaccattcagtcaagacttaactcagaggcagttgattcagtgcttacatctagacaaagctttaatgagtgcagacccagcctaacagtatttcatctaatttctttgatggcttaagccaataagcactgaggtagcttttctcagaaggaaacagattttattttccaggggctaattaatatgcaccacctaagtccccaaaggatcacacaggtgcctgtatcatgccatatgtcatgtgctatattcctgcaagctcaagagattaatatacaatcattattatgaattattatgttgcattgaagttaatgtcggtcttttgttctaattaaagtacaaacgtggcatctgaat

SEQ ID NO: 16160 - DNA, 465 bp, Homo sapiens
tctatacgatttcttaagaaggcaaaattgtagagacaaaaagcacatcagtggttccccaaggtttggggttgaatgggaattaacagcaaatgagcaaaaggaaactttttggattgataaaagtattctaaaactagattgtggtgatgactgcacaattttataagtttactaaaattcattaactgtataattaaaatggatgacatttaaggtatgtaaaattctacctaaataaagatgtttaaaaaaaataccctgatctatgaacaaagccacaaaagaaatgtcaactaattctaaaatgagatatcatacaggtgacagtcactgttcatcatgcaatcaatcaatcaataaactacagccaaaaactgggaacaacccaaaaatttgtctgcagtagaatgaataaataatcatattatcagacaaggtaatactgtacacaatgaatataaa

SEQ ID NO: 16161 - DNA, 150 bp, Homo sapiens
agcttgcaaataatggcctcactagtgagccatggaattaattagtgggtagtgaccaatattaaaaattttacttcacagtacatctcgcatagaaatgggttatttatttatttatttatatattttttgagacagagtctcactctg

SEQ ID NO: 16162 - DNA, 281 bp, Homo sapiens
agaattgcttgaacccaagagacggaggttgcagtgagccgagatcgtgccactctactccagcctgggcaacagagtgcagagtgagactccgtttcaaaaaaaaaagtttatgacaacaaaacgttataacgtgattttggattagatgaggaaaacacactacggaggacatttctggggcaagtgtcattaccgaagttgtatgatccacgccatcattgcctgtcaattggataaacagtgtgatactgatgttgcctgattttgatcactgttct

SEQ ID NO: 16163 - DNA, 369 bp, Homo sapiens
ttcttttttttaaatatagctgtctatccccaagcaatatataatattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatca

SEQ ID NO: 16164 - DNA, 279 bp, Homo sapiens
gtacgacgatgtgaatatacttaatgccactaaattgtacacttaaaaacagttaaaatggtggattttatgttacaaatatttttccataatataaaaaatctttattaactgcatctatccttcactgtcctttatatttttgttaaggcataatagcatttttataatgctttagtaatcatttcatatcatctggttgtgaatctttatctttaaatatagcatttatttatcataataaaattggaactagatccaaaacaaaacatcaagctc

SEQ ID NO: 16165 - DNA, 347 bp, Homo sapiens
tgcagcacttacttacccacttcttgttttgttggtgagaagtcctgctcccatgggccatgacttcctagcactccggtctgcctcactcatgtgttgaatatgacttggtggccaggaagtccctgcaaagacaggtagggagcctggggtaagaagacataagtgttcacagggagaaggcatgccaaggggggttgagtggggtgccagcacccctacaatactcattgcaaatctgttgttatatatattttgatgtgtgaggaagtggggggtcctggagaagctaagtaactctcccagggtcacagggataatgagtgcaggagctgggattcgaacat

SEQ ID NO: 16166 - DNA, 334 bp, Homo sapiens
ctcataagggcattctgaagattagatgaatttatacgtaggtagtaattaaaacagtttttagtacacagaaaagtacttagtaatttttagctgttattattactagaagttcattcttttgttcattaattcatgaggcacaggtgcctttctcggtgtttggcatacataaaacaccataataaatgagagtccatattcttatgcagagtgagaagaaagcaagcagtaaacataataaatacatgaattatatcatatgtgcaagatgctaaggtcaatgggagcaacttaagttaaagggtatctggagtgcgatgagcagctagca

SEQ ID NO: 16167 - DNA, 401 bp, Homo sapiens
acgatcattattgctacattcgtgttgtgagtgaagtataaataagcttaaaaactagcaatgccagtgttacagcttttttacgatttatctagcaagttttccagtctttatcagaaaccacctcccaatccccctcaaaacaaacaaacaaataaacaaacaacaacaacaacagcaaaaaactagcaatgccagctgttccatgaagtctgaagtatggttttcctgggtaaatgttaaggaatgctggctctcattgtttgggatggatgttcacatgggctttttagaaatcagctgactgcgtcattatatggatatacagctatcttaatatctataaactatgtttggaaaataaataagttctttagtacttatcagaaaacagataacta

SEQ ID NO: 16168 - DNA, 349 bp, Homo sapiens
gtgaagagaattcgagttttagttattccgaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcat

SEQ ID NO: 16169 - DNA, 513 bp, Homo sapiens
tgtaggggaagctcgacatgaattatgtagttcatttaaaatgcacatcaaagagagaccactttgtttaacataagtgaactctcccttcaattagatacaacagttactgaactattaatatgtatacaagaaaattaatgcggttggattcttaaggaaagcattacagtatattaaaggtgtaaattcaaagagactcatagttattgaatacactaaaatagttaatattttaggttaaaatgtaaacttatcacctaatttaataatgatgttatactaaacacacacatacaagtatattaagattaaattaaaagaatttgctgcttgccccaacaaatatttgcttctggaagctaagactatgaaacaactatttacttacataaatcaagtgaattcttcaagatttctttcaagacattgttctgtgcctcccaatccaagctaggatgtgataaactaaactccacccatagataaacttcaccctacaagtttaatccc

SEQ ID NO: 16170 - DNA, 422 bp, Homo sapiens
acttctccctcagcccaatcccactgtcatcccctgctgtccacagatgctgatctcaaggacacacccagtaaacattctcagcactacgctgtctcaggttctgcttcctggagaacccaaattgtgtcatcaggaatcaatttggcattatcccttgggtatttaatcgatacccagtacaaaaaaaggacacaatgcttctgtcatttttttaactcattgatgaaccacagcagttttctcaaggcaagatagacaggggcaagactagcatctaagaggataaactctggcaggagggtttctgtaaagagacctaaaacccctcatagttcaggcaaataaacagtcaccataaggagccaagaatagaaatatatctaataagctatattcgccagggatgacaagtatggggc

SEQ ID NO: 16171 - DNA, 438 bp, Homo sapiens
ttttctctatattgtacgtcttcatatcatcacaccattgctcattcattttgatggcagtgaaataatttccctaaattgaaaatatatataccacttgacttactgtgaatgaataaaatgagactgatttaaatgatttatttcatatatctgggttttccattaaatgcaagactacatatatgcttgtgacctcacatggccctgctttgaaatgacacaagctctgtaataaatattgagggtgacagaatccatctcctcatctcattgagaaatcttttaaagaactagaacatgacaaacattattctgaatttcagctctgactcttactagcttctaaccttaaagaagttaggaaatgtacctgaaatctctattagcaaataaaattttaaaataccccgttaaagattcttgaaggatgaaaat

SEQ ID NO: 16172 - DNA, 467 bp, Homo sapiens
gtatatattcaagcaactaagactcactctgacagttgtttactacatcagagtaattccattcatagggataaggatcctactgcatagaaaaactttaaccaaaggccaggcacggaggctcacgcctgtaatcccagcactttgggaggctgaggcaggtagatcacctggtcaggagttcgagaccagcctgaccaatatgatgaaaccctgtctctactaaaaatacaaaaattagccagacgtggtggcatgcgcctgtaatcccagctacgtgggaggctgagacaagagaatcacttgaacctggaaggtggaggttacagtgagccaagatggtgccattgcactccagcctgggctacaagaacaaaactctgtctcaaaaaacaaacaaaaactttaactaaacatcatgtctctcaaaacaatgctgcaatactgactcagagaagttttaatgc

SEQ ID NO: 16173 - DNA, 301 bp, Homo sapiens
tgtgctgcatctgtgtggcggtccccagccctggatccttgaagaagaccatatgcttctctgcaccacagcagcctaactagggcacgttcggctttcaatcatcttaaatacgtcctctgtagcccatcactgccctatgtttatgtttatctattattagatacatatttatttggaaacattttatattgaacaatagatgataaaacatagtacaatatttcagatatatttttccaaagtcttatcaattgtcaacactttgcttgggttcattctctctctctctctctcttct

SEQ ID NO: 16174 - DNA, 444 bp, Homo sapiens
atcatgaattctttggagagaacctttgatgcagcaactagagtcatgcagatgaggtcccaaacaggagtgactagccttttgttccccccaaaccaacctcatacagttttgccaaaaagatgactattcagttactttctctgccttccaaggcatcacagagtggttctgcagaatcagttctgaattccagagctgttaaggccaatagggcttccttcctgcctttttgcctctttgaaacttgttcggccgggtgtggtggcgatgcttgtaatcccagcactttgggaggccgaggtggatggaccacttgagctcaggagttcaagaccagcctgggcaacatggcaaaactggctgggcacggtggctcacacctgtaatcccagcactttgggaggctcaggcaggtggatcacttgaggtaaggaattcaag

SEQ ID NO: 16175 - DNA, 388 bp, Homo sapiens
ctactatttgaagatttccaaaggcctagaaatgttagataattttaaaatgttcaatgtggcatttattttcaaaaaataagaatgtatcagaaaattgcagtacacttagagtcatttttatatctataaaccttctgaagttgtgcacttaattattttgtatttatcagcagaacaaaagagcagcatttcattccctttgtggttcctgccatcaaatgtcgaactgatagaattaaaaaaacttttgataatttctgcccctgaataacgctaaatttaaatagactatctttcatttaataaccattcagatagtatttgtttgaagtcagttgaatttaaaggcttattattttgtactgaaagtctaagcatgcatttt

SEQ ID NO: 16176 - DNA, 453 bp, Homo sapiens
accattctgtttttcactttcagtttagtattcaataaactacataagatattgaaaactttgttataaaataggctttgtgttaacataggctttacccatctgtatgttagtgtaagtgttctgagcatgtataagttaggctaagctaagctatgatgttcaattcattaggtatattttatacatttcaacttacaatattttcagccagcaacatgtttattggaacatagccccattgtaaattaagaagtatctgtataggtacataaagtgaattcagaaatcatgggaatgttagttttgtatgtgtgttagtgtgtgcatgcacaatgcatgtgtgggtttaaaagaaaattgagggttctaagataaatataacaaggatttataagacttaacagtgagaaaaaataattacaaaatttccaattttaaaaaaattgggct

SEQ ID NO: 16177 - DNA, 442 bp, Homo sapiens
tttccaggtcagatttccccagtacctatattagattcaggtcttgttttaattatagaaagttttcttggattatagttctaagtattaggctgttcagttattttgattgatttctttaagaaactcttttacttcttgattatattttcactttcctagttgcttttcttgttttcttcattgccttttcacttgattatattcttcctggagcaacttgtaatttagttttcatttctgataggattttgtctcttccttctttcctaagttttatcaactctcatttcactttttcctgatttttttgggggtgatcaatatctattattactattttttaagtttctcatttgagatgtgtttttcatagcccaaatgcttatttgaggaaattcccttgagtatggagtgtgacgttacatttttcttaagtttt

SEQ ID NO: 16178 - DNA, 491 bp, Homo sapiens
cacagatagtctttggatggctttaatccaagcccatttcaatatgcctctttttattgtccacacttctttctactaccactaacttaaataattcatataatcagctagaagagttttcaatgaaaactcatctttgaacacaagaaataaggactgagaagtggtgaacaacttgcaactgaggtattctgaaaatagtcctaacataatgtcccccaggtgtagccatatatggtaatttggtaaatcaacaatgaagtcttatgcaacagtgagaatctaagtatcaagcactagatgaggtactgggcaagagaaatacaaaagggaacactgctttaccccatccccaaggagatctcagggacagaaatgtcagcatctacctcaatacaatgacagctgagtgactatctcaagtgagaactgaagaacgtatcacaggagagctgatcttggagaaggaagaggagttggcttattaaaaa

SEQ ID NO: 16179 - DNA, 364 bp, Homo sapiens
tctgaaggataatagttaactgttgtgggagactgagaggagaatattttaggaagaaagaacagcataagcaaaagtttcatggcaggagggagaaattagctatggccagagtatagagaataagggaagtatgatttgtgaggaggctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttga

SEQ ID NO: 16180 - DNA, 394 bp, Homo sapiens
tgacatctcacatccaagttttaatttgctgatggatgaggtgcatgagccagagataactgaacgggttcaaatagcctggtatttccaggatcttataaaaactttgcagtaaccaggaatgcagataagttgaggaagactcagccggaactcttagccattgctctcaacccttactgattcatgaagggaatccctcatttctgagtataattgaggacatgatcagctgaaggagcagaaggaagggaaaaatgaactactaaatgctgaatgtgtgcttacgtaccagtcatttccttggtgccagccagcagtgtgtctattgagcaaagcatggtagattttcaaagaaatcagctggataaattccagtttaaaatggcatctg

SEQ ID NO: 16181 - DNA, 425 bp, Homo sapiens
atgtgtcaccatctaaacatatgcatgtgttcaatcaggaggcacacctcagctatgtgtctggaggttttattggacaaatattgacctaattgaaacattgggcatgtgaccgaattcaatctccagctccgctcttctctctggagaaatttgaggtgataccacctggctcacacatggtctttctggtaagaccaggcttcatcctgagggatctcataagcataaatgtatgtgcagtggaaaatagcaccataaataacaaagacactcctatcacttagaagattttatgcatttcctacctggaaacctgggaaaaaacagccaattttcttaatatatgatattagcagaagttagctaaatatatgagagaaggctctgaaaagcaagtacacaaaaaataatgttgagatgtg

SEQ ID NO: 16182 - DNA, 451 bp, Homo sapiens
cagcctcccaagtagctgggactacaggcgcccgccactacgcccggctaattttttgtatttttagtagagacggggtttcaccgttttagccgggatggtctcgatctcctgacctcgcccaaagtgctgggattacaggcgtgagccaccgcgcccggccgatatcaaattttttaaatacaggaaaatgcaactcagtttcccttcagagagtctatcgttacacaaatttttatcttcatcatcaagcaaatacaaacataaatttacaggcacactcctgtatacccacagaatgcaccattttaatatttcacaataaaatgcctcagttttactacccaagctgtagagaatgttcatctctcttaacacattttttcagctaatgattttataaagtaaaatttttacatttatttatttcaatcccaaaacataatacaat

SEQ ID NO: 16183 - DNA, 461 bp, Homo sapiens
atgtgagtgtgtgtgtgtgtatagcatcaagtatagccacaaggtagtagccttagtcactaaattgtttgctattgctggctgtattcatcacgggagtccatgttgactcagatatgtaggacagcaagaattcccacgtcttctgagctcaccttacagagctaagagatatggcagccttaatgaaaggggggagcctttactcacataaaccctgtgaattctactgtaaattttcctacatccaaatggaatgtattttggatgttgaggattgttgagggggcggggtctgtttttaaacaagtgagaaattgatatatatttacacgctatcatattgtacagaaactggccattgatcagtagaaatctcaccaaatacagagaaagtcttgattcaaaacttaaaatagcagggagaccaatgtttaaaacatgttgagttaaaaaagaaa

SEQ ID NO: 16184 - DNA, 456 bp, Homo sapiens
gtggcaggagctaatgaggggaggtgaggaatccacactgcagacagatactcactttggaaaagactgaggacacatgaaggccatcaaacagggaaactagaaactatatttcttgagggcaagggggcactgaactcagaagtctaagaggctttggcgcagcctatttacatgatttcagagattaccttatcttgttgacctttctatctttcatccttttccccactttggtccactatctctctatcatcaccatgaccactagtgctaccacctcttaattcatggtttacttcccttttgcctcaccccctactcttttctgccaggcctcttgtataacccctcccaacacctttgggggtatctctgaatcactttcttggtgctcgaatttattgccatccttcttcagtgaaattatgagacggcataaaatgaggacaggga

SEQ ID NO: 16185 - DNA, 515 bp, Homo sapiens
  misc_feature 93: n = A,T,C or G
agtcaaactcccatcatcggggagtgagttactcagaggagatgctggctttagaatgtccactcctgtgagacccagagaagcactgacttntgtgaaagaaaaagctcagtgatgctgagagtcaattggtgtaacttgatgagccgaaatcccccgcaatggggaaaacagagtcctagaaagatgagagggaaggtgagtcagccagcctagtggggctgttattcctaagctgggttgtatgtcagaatcactcacagcattcttaaaaacacaggcctagcctgtgagactctgaggcagctgttggatttgggccaggacacagtggatctacttttaaaaagctcctggttgggctgggagtggtggctcatgcctgtaatcccaggactttgggaggtggaggtgggtggatcatctgaggtcacgagtttgagaccagcctggcctaaatggtgaaaccccatctctattataaatacaaaaactagctggacgtggtggtgggt

SEQ ID NO: 16186 - DNA, 384 bp, Homo sapiens
ttatctctttctgttggctctcgaaagcctagagcaaaatgtgtggcccatctgtacagaatcttattgcttgcatttttagaagtaacctcaaggttcattttaactttcttatatcatttttcccattgtactcatttccttacctacttaaaaaaatgaaaagcaacttgtttttctcttcccaaatataaaatatatttgctatatgaaatgtgttaaatacatataagagaaaagaagaaagtgaaatgatctgtccttttcactgaccacatttagttcttgatagtttggcattttccaatgcatacatatacattttaaaaagtggcttattcggccaggcgtggtggctcatgcctataatcccagcactttggg

SEQ ID NO: 16187 - DNA, 355 bp, Homo sapiens
tcttcttggctccttttaccatctgaaatgacgtgtgaacagggtgcagtggcacatgactataatcccagcacttggggaggccaaggtgggagggttgtttgaggccagaagtttaagaccagcccaggtaacatagcaaggcctccatctctacaaaacaaacaaaattgatcgcgccactgcacttcagctctagcctggatgacagagtgagattctgtgccccaccccccacaaaaaaatagaataagaagtgatccccagagccctaaaatcctgaccgtcccagcgggacaaggctgaaaggtgttcagtggattctgagggacaaagaggtgggctgggctgggct

SEQ ID NO: 16188 - DNA, 388 bp, Homo sapiens
tgtgctcctaattgtttgctctctcctctgtgtcagatactttcttatgagcaccaacatgagacacaaagatccactttgtgttcacatccagaggttcattcagatggccttcttaactggtggcaaaaaatagacttaaaaaaaatagaatttcaggcagacatccctgtgcaaaatattaatattcttgttcctaccagattcctgaccgggcagagccaagagatctcccaccgctcaagcatccaggtatcctgtttatgaccagttgtgctgcttgtagcactgcctaccaagagtattttcaccaagccatgctcctctaggactctcctgagtaaaattttagtgtggtaatagtccaccattggctcataacaacaaa

SEQ ID NO: 16189 - DNA, 426 bp, Homo sapiens
ctgggagctgggctttgtttttcttgatcatccactttacctgtatcagcttctgaacacactgtttgatatattagtttcaggacacctagggaccgcagtgctggactagaaaggaacacttgagcaccactggtcattatcaatggaaaaagattgtatcctgagagaatagtggtcagtaactaaacgtgttagaaaacctctgatagctgaactccagactatttttaccatcatttctttgtctgctgtttttctctgtattgcagtgtaaccccagggtcctggcttagaaagttgtacttacaggcatgagccactgcacccagccactactctctttctttggcagtcttttcacttcttctatttctaagtaaaaactacagagcaaacctaaattcatatttaacatgaagcccc

SEQ ID NO: 16190 - DNA, 457 bp, Homo sapiens
tggctcacacctgtaatcccagcactttgggaggccaacgtgggcagatcacttgaggtcaggatttcgagactagcctggccaacatggtgaaaccctgtccctactaaaaacacaaaaattagccaggcgtggtggtgcacatctgtaatcccagctacttgggaggctgaggcatgagaattgcttgaacccaggagacagaggttgcagtgagccatgatcccaccaccacactccagcctgggtgacagagtgagactctgtctcaaaagagttattaccaaaacaatagactataaaatctgtagtcttaatttgcatatcatggtagacaggaaaatacctttagcatcttaataaaagatgaatcaaactctctaataaataccctagaaaagacaaacaatacactaaatataagattaaagagtagtttctaatacatcattctaag

SEQ ID NO: 16191 - DNA, 415 bp, Homo sapiens
  misc_feature 91, 92: n = A,T,C or G
ttcatctgtttgtttttacttttcaatatagtaactagaaaattttaaattgcgcatgtggttggcattatattcctactagatagcactnntctttaccctctttaaaatgcagccttcagatttttgaaagactgctatcgtttttccctcaaacatttttaaagggtagacttatcaggttcttttcaatgttatttatttaacataatttccttcaccattaaatgtgttctagcttttcagtctctacattgagctgaataccgtaagctgaagattagaattaagatgtaccatgccctgccaggtatcctggctaacacggtgaaacccccgtctctactaaaaatacaaaaaaaaattagctgggcgtggtggcgggctcctgtagtcccagctactcgggaggctg

SEQ ID NO: 16192 - DNA, 487 bp, Homo sapiens
gtagccgaaatacaagtctgtgaattggaatgctgttaagaagatatcaacagagtcacaggagtacaaaggatcaggcaaatatttctgacagatgggaagttaaaaaggcttcatgaggaaattgcttctaagcttggcattgaaggaagagattttattttatttttagtatgtatgtatttatatctcattgccttccagaaagattttgaagtaacttataaaaatacatatatcccaataggacagaataattaattcaggcaatctgactaaaaggggaaaattatgtgtatgaaattaataaaccataggtaagactagatgaaagaaatgcaaaccatgggccgggtgcagtggctcacgcctgtaatcccagcactttgggaggccgaggcttgtggatcacaaggtcaggagatcaagaccaccctggctaacacggtgaaacccagtctctactaaaaattaaaaaaaaaaaaaa

SEQ ID NO: 16193 - DNA, 383 bp, Homo sapiens
cactattgcagtaagtagttaaaggcttgactgttgctttcattttggcttgttaacttaatcagctaccctgacacctgacagctcagctatctccagctcagttaagaccatgacagatccgtctggtctatgcaagagtcagtagagttggttctgcctgtcatttccatggtctagctttcctgtccacccactgatctgaccctagatgagctctgatgaacaggtctgccatggcccccatcaaacccttctttcctgcccatacctgcctgcagcaggtcggttcactggccaaaaattggtagttccaatttaacccgttcctcttcaatatgacagtgatatgaagagtatttgatcatatttttaaataactt

SEQ ID NO: 16194 - DNA, 360 bp, Homo sapiens
agcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattcta

SEQ ID NO: 16195 - DNA, 429 bp, Homo sapiens
cgcctatccatggtcctagtattcttaaggataagcagacagtcattttattcttcaaagaaaacagaacaattttaaacagactggttaatcaaaactagacaaagccccaactcctgcagttaggagtagatcaggacttctgtgggaaagagaccaggggaatctggcacagcttagagatattcaacaagcaaaaaatactgggatggaataaagtggcaggatggataaaagaaattgtattggggaaaaaaaactatgttttactttctttgttccctaactatgagctattcctacttcactatatatgtgaatgatggttctaaagagggaatcagatcattcatgtattcaacattcagcaaatatttgagacttcctgtgcccctagccttttggccaattgctattggctatatatat

SEQ ID NO: 16196 - DNA, 568 bp, Homo sapiens
ggcccggaggccgcacccgcctccggcggggctctcagtgaaaaatgtactctgacctgaatcctgaattttccttgatggtcaaaagattaagtgagcatgctttaacaaaaaacaataacagaaactgtgtcaaagaaaaggacctgtaatcttcaggaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaag

SEQ ID NO: 16197 - DNA, 689 bp, Homo sapiens
aggctggaactcagatctgagtcgaatcctatgactccttaccttgctcatctatttattaccttgtgaattcctgattttaatcaccggaactaattgctggtattaatcacattttttattatcaggaaatacaagaccatttttgagtcacttgttgaattcagcgggtcttcgtaactccagaaagtaagtatgctcatatgctcatcatcaacttctgggatgtaagtttaataggcacgggtcactgcacaggcttggcagggcatggagacaggctagagaggggccagcacccaagtcctacttcttcccagcaaagtgctggccacacaatgactggctagagagagctgcttaatgcgggggtagccaccctcccacatcacagaaacgtgcctattttacaagaccatggactcaaaggaaaaatacattgaaaatctgactcctgcaggagcaatggccaggactcatcttttatacaccaaagtcggagactcagtttcactgcagagattctaatcctgcttctgcattcttgaccacggcatcacataaaaatagatacatcttttcaagaaaactaatgcttttacatctggtctctatcaaagtaaacaagtattgagaaaacaagttacttttaagcattttgaaatgacaataacttgcattttcccaca

SEQ ID NO: 16198 - DNA, 487 bp, Homo sapiens
gggtgatggaatgagaccctgtatcttaaaaaaatgaaataaatacagaatacttatttaaaacatgggccaggtatagtggctcgtgtaatcccagcactttgggaggctgaggtgggcggatcacttgaagttaggagtttgagaccagtctggccaacatggcaaaaccccatctctacaaaaatacaaaaatagaaattaaactggcatggtgatgcgtgcttgagctcccagctcgggaggctgggcacgagaatcgcttgaacccagaaggcagagggtgcagtgagccaagattgcaccactgcactccagcctgggtgacagagtgagacaatacctgaaaaacaaaaaacaaaaacaaaaaaagggaattcgcagaaatctaatgacaatgacagaccctccccatgttttatttctaatgataatcttgtgagggaaacttaacatctcctgggtatccacgtagggaggatgagcc

SEQ ID NO: 16199 - DNA, 381 bp, Homo sapiens
cacgtgcatgtgtatgtacgcaggtgcatgtgtgtgtggccatctgtctcatctataaaagacaatcgatatataaaacataaaactagcaaacatctcattttaaaaactagatcccaagaagccatcaaaatgaattaagagtaaaatgcatccctgaataaatccactgtgtgctgaaagtgactgaatccctacaaaagacataataaattgacttgttgcctgaggatatttaagattgaatgtctaccaaatacaataatgttgtttcgcagaattttatgctgagttgttctttacagacataatatgccaaaagacccatactgcttcctaagtttacgcttagacaatatgacaaggttatcagtataaagt

SEQ ID NO: 16200 - DNA, 199 bp, Homo sapiens
aattatcaacggcataactttcagccaagggacaaccatatttatcttgctgtatagttctttctgattttttttttgcgtatttctcctttttcctgtattttagatatatgtaggtaagtttcttttcaattataactttgatcttctagtctagaaagtgaccactcttcctcccccttttccttgctcctcactg

SEQ ID NO: 16201 - DNA, 569 bp, Homo sapiens
tttcatgttaggagaagttaaatgaaaacaaaattaagcttttgaatccatgacatttcattatgttaactctgcttcttttaaaatcttattggtcccatgactctcaatgaaaacaacttcatataacaaaatcaaactgtaatatatttcctcagttgaccgaaatgatttagtaatagatgatttggctattgtaatagtgtatatcctggaagtttctcagaataccttcttagtttcaacttttgttgacagatctttctgaaagatccatgtacagtgttttaaaatctcctcaggatagacattctgagtaaggattcttatgtggtgtagataaattgtatcttctacatatacaaagtggctgggctcagaaattccttttctttgtttttgagacagggtcttgctctatcgcataggctggagtgcagttgggtaatcactgctcgctgcagcctctaccctcctggcacaatccatctgcccaccttagcctccagagtagctgggactagaggtgcctgcctccatgcccagctgatttttaaaaattttttgca

SEQ ID NO: 16202 - DNA, 651 bp, Homo sapiens
cctgtgtgttacctgattgtaacaaccctatgcccatttcatagactgggaaacgaggtactgagaagtgaaatagctcaaagtgatttcactggaaagagacacagcatgggaacctagttgtgacgcactggagcgccaggtcttaatcactgagcaagattgctgtccaaaaaataaaaccagttccactttgcagggaacccagggtttaaactagtaattcttagatattttagggaggagacgtgtataaaagtgtgtatttggggacagggctggtgaacaatcataaaacagaacaggcatgcatctgtccacaagaacagacttcacgagtctacagatgctgttcccagggaaatacacatcacatgtaatattgcatacattttcagaggatttaaaggtacacttggaatgggccaagcacagtggctcgtgcctgtaatcctaacactttgggaggatcgcttgagcccagaagtttaagaccagcctggccaacatggtgagaccccatctttatttaaaaaataaaaattaaaaaaaagagccgggcatagtagcctgtggtagttccagctaccccacaggctgaaacaggaagatagcttgagcccaggagatagaggtgacaatgagctacag

SEQ ID NO: 16203 - DNA, 452 bp, Homo sapiens
ctgtatcgttctgcattgaaatcaataaaaatagggctcaaaataacagttctgaagaatccttgggcacacctctggatgtaagaaccaaacaagagacaactaaggaaattgttaactcctggtaactaccagagcctcaaggaaaaacgtgttttcagctctcctctggggtcaaatgactatagctcactgggccagacaggatccatgatgagattttctcaagaggggaaggtggtaagggcaaattataaagatacaccttctggctgggtgcagtggctcacacctgtaatcccaacactttgggaggccaagggaggcagatcacttgaggtcaggagttcaaaaccagcctggccaacatggtgaaaccccatctctactaaacaatatataaatataaaaattagccaggcatggtggcatacgcctgtgatcccagctac

SEQ ID NO: 16204 - DNA, 532 bp, Homo sapiens
aacacatgaggaagtatagcaaagtggttaacagcacaagctttgaaatcagaaaggctaggttcatatctcatctccacgacttacttcctgtgaccttggggaagtcacttatcccttaacctcaatttcctcaactacaaactgatgataataataccctatctcatagggctgttgttgtgattgaatgaaatagtggaaagtgctgagcacagtaccctgtacatagcaagtgttcaataactggggactattactttaactgttacctaattgccttaaagatcagcctttgctaaaaacagaagtccttccacagattgacattcaaaaggccaccaccacaaagaatacgcttaaggctgccaggaaggtactagtgaaagtgtaggccaatgaataaatggcatttgattttctattccagcatctttccattttagcattttctaactcagcagccacatagtgctctctgcctgcctggcttccctcacacattttcaaaccaggattactccaaatgtga

SEQ ID NO: 16205 - DNA, 637 bp, Homo sapiens
taagccagtttttccatgggaaatttatccttagactagtttggggccatagtggggcagcctggtatttcataaatggtcaactgcaatattcagatattggttgtcatccttgtaggcagtggctgtggcaactctgattctacaactttggaagaaaactattaactttgaagttaataatttaattataaactttgaagttttaacatcaacttcaaaggctaggaatggcccccaaaagatcccagtttccttgaataatctttatgtttgggaattatacacttatgctaaatgttccaaatacccctctactcttcaacattgataaactcccttctcaaaaagtggccagctctttcaggtcttctgagtgactttcttaatataaagggcaatagcatcgtatcctaaagcttatatgggaggaagctaagtgaatcatggccaatacaagggaagaacgctatcctctgcacataatctcttcagtttatcttttaagacccactttaagttccatcttttccagaaagccttccttaatgacctcaggcataacaacagccaaatagaccatgaaaactcttagaaatggactcagttggccccttattctttactattctattct

SEQ ID NO: 16206 - DNA, 619 bp, Homo sapiens
ggtaaccagatactgcctccatgccccctcctctcactctttccaacctgctcttcacttcacttaaatgtagactggattttctcatgactcggtggcaagatcccacattaagtcaggtgctacttggggaagttgcttcgttttcttgtgctctaagatctctcacccacacgcctggttttggggagaaggataaggacggtgtttctaaacatgctgtgtttcctatgcagagaggcaggtgactgtgtatggctcaacttgcagactctaaagccaactactttagagttcagagttcagacaccagctttgcctcttgtccttgtaacatggcacaggttacttcaactctgtaatgcctcagtttcctcatctgtgaaatgggggtaataactgtgtatacctcataagtgtgcttggaataatgcccactaccacgttcaaagtcagctgctggggccaggcatggtgtctgacccctgtaatcccagcactttgggaggccaaggcaggcagatgaccggaggttgggagttcgagaccagcctgaccaacatgacaaaaccccatctctactaaaaatacaaaaattagcagggtatggtgacaagca

SEQ ID NO: 16207 - DNA, 162 bp, Homo sapiens
actttggaagcctgggataggaaaaattctaaaaacaggtgtatctgtcttaacaaatttggccaaatatatcaatagaacaaaagttaattttgaatttctcagctttaaaatagttaaataaagaataaataaataaaatagttaaataaataaagacat

SEQ ID NO: 16208 - DNA, 605 bp, Homo sapiens
atactcttttgggggttgtgggagagcacttttagttgaatggtgaagatagaaataattaactttgaagatcttaagcaaattacttaatctctatctcattttactcctttaactacaagctggcacatcttttcaacacatatccacacttacccactccaagagaaaatactgagctctgcctggaaaccattctatgcattttggagaccacaacctttattgcagcacaggcactggcagtgaaggaaatgttatgttcctgggatgatcccaggagaaaagtaaaaggtttatggacttcattacagtttccaaatgtttgaatgctttacttttccagagaaactgggcaggcaggaaagagttgcacggactgtgtcttgagtcatgaagctttgccagtgtggaggagtgtaagcctacctcttaccttagctgcagtcattaccttgatttccttagttcttggcttccttgtatgaatttcctcgttgttttcctcttcgctttttataacaccctttgacttctggactcctagctttttaaaatttaaaatggctatcagacttaataatttatgtagatactccaccctc

SEQ ID NO: 16209 - DNA, 704 bp, Homo sapiens
aggttgaagacactcctaattttcaacgtctcccttagcttcttaatacagaatattaacaagcatacaagtataagatgttgatccttagaaacctagttccaaaaggtcattattaatcacaattaattcacagaatttatttatcttgggaatgtttctataaaacattttgtgactaaataggtaaagctaatggcagtatttaactgaaaaaagtaaaggggtacattgactttaataaaaacagttgaaagaactattcaaaacataaatgtattactcaaaatgttttatataggggcacaagagttctttgactgaagcagtttttattttaagttgtttggcctgaaaccattcctggcagcaaaaatctttttaaaagtcttcatgtgtagatttaagctatccttggcataaaataattaatatatctatatttcaaagagcagatggcagaaaggactataccgaaatatattttatttctgagcaccagcataaaaacaagagaaaaaaaaagaacagccagaatacagaggtttttagggctattctaagtgatactatactggtggagacatgtcattatatatttgccaaaactcatagaaagtgcaacaccaagagtgaaccctaacataaactactgactttgggtgataatgtatgtcaatgtaagctcactgattgtaacaaat

SEQ ID NO: 16210 - DNA, 86 bp, Homo sapiens
gtctgtttttaaacaagtgagaaattgatatatatttacacgctatcatattgtacagaaactggccattgatcagtagaaatctc

SEQ ID NO: 16211 - DNA, 97 bp, Homo sapiens
taggaagaattctggaagaactgagaatgtttacctcttctaacagtcttctctcattcacgtttaatttaattagaaatggtctaaattgaacttc

SEQ ID NO: 16212 - DNA, 625 bp, Homo sapiens
caggtctcagatcaaaattaagtgaccttttcacataacatactgccaatgtatttttaatgtaattgtcctgattgagtcatatttctaccaaattaccaaacacttttgtaatattagcttaagatacgttctcattccttgcattagagatggtgtcagcttgacttgaactttaatggcctgaaagtgagagcaatggtgtttcaccagagggaaattgaagtttggtcgtaagaagaggtctgagtggctgctgcaaagtcaacatttgttatccacataggacacaagctgttgtgttataaaataccatcagagatagaataagcattttcttacttcaaacttctaaatcagaagcatctaggaacatagctgtaattggtgaagcacagaaataaaaagacatttctaggtgaatcaaaatcagaggaagtcattgtcattgtgtgcatggttgcacaaaagcatcagggagcccagcagagtggtgcattaaagaaataagaaaagcaacgtctgccagcagtcaagacaggtatctgaagcagcagttgaaacagatgtgaagtagaggcaatgccatgaatgtcagttgtgtgttttagtgggtcccattgac

SEQ ID NO: 16213 - DNA, 599 bp, Homo sapiens
tctcgaactcctgacctcaggtgatcctcccacctcggcctcccaaagtgctgggattataggcatgagccaccacgcctggccttatttttacttctgtgaaatataagtcactccaaatatctgaagcctttttaaattcaactgaatgatgcagggcctttaaggaataatgagatctacactttgagacaggatgctaggtctggagatacgctctaaaatatgatcacgcactgccacaggtcaagatgggtcttacaggatgagcaccatagagaaaaaagggagggtatcatcccatacaaaggaaagagcatgtgcaaaggcagagaggcaggaaagagcatgggtgtatgagagaacatgtctgaaatacaaggtgcaaaaagggaaatcactgagaaggaggtcaggtacatactgtaagcgagctgaaataccacatttattgtcatgccccatgctgccacctgagaaaaagcctcatttttatctctcatctactccctcaaaaaagcatcaaggacaaggacacgggatggggggatgggaaactattcagagttataaaccgggccatgtaagaaaaagataaa

SEQ ID NO: 16214 - DNA, 428 bp, Homo sapiens
cactgcagtccagcctgggcaacagagcaagactcggtcgcgaaaaaaaagatttgaaaaagaaaaaaacaacaatgaatgcttacacttagaaatggtttgtcatcttcgtctaggaatgcctattttccattcattcaatgaacatccagcccaccttgtgccctgtgattggaaggctttaggaataccgagatgaaaagatatgatccctgtcttaaagaatctagtaatctaatgggcacctgaatgaacgtttgtctacagtgttaggttaggaaacagccccaacacatgccatttgccagggggagtcagagcctcacctatttatttggggtgacaatcatacagagtgcaagtgacatatttaccatgctgtatccctgaagtcttttcatctgtcccaacttctctattgccattga

SEQ ID NO: 16215 - DNA, 580 bp, Homo sapiens
gttgctctatgaaaaacacacattagcatttttcagaacattaggaaccaaacacagtatcataaaaacatagaaaaaaaggaactaattttatcttctagtcacagatgatgttcagaatcaaaatgacatgtgactaatagtcagatatcaaattagtggagctctgctcttaaccacatattactccatatctgtttctttatggcagcaaaagacaagactccagcagtggttcagctgtataatgggaatatgaatattccagaactttctgtatgccaggtgattgggaacaacagtctcttaatattacctggcttttaaaagtattggcatacatttgaactaaagatttttttaaaaaataaaatctgtccaggtgcagtggctcacgcctgtaatcccagcactttgggaggccgaggtgggaggatcacgaggtcaggagattgagaccatcctagctaacatggtgaaaccccgtctctactaaaaatacaaaaaattagccaggcgtggtggcacgtgcctgtagtcccagctacttgggaggctgaggcaggagaatggcatgaac

SEQ ID NO: 16216 - DNA, 557 bp, Homo sapiens
accctgtattcttcagcctgactcatcacttcccttttgttcgtttctagtcttcctctccagcctctccatctgtcgttctctaacttcttcctttatttttccttttctcggtttcattgtgattgttttaaaaaccacgtctatggcaaatatacccacaggtactttttagagggcttaatgacagtgtttatcagcagactctagaaatgtgttcatgacagatcaatgcttatttttgtggttcaaaagaaagttgtaaaaatttttagaaattattagtattttcttgcgggaatagtgaaagttagttgtgtgtgatcattttttaagcatcaaagattggaaagtctgaaattgtgtttcaggtgtgttccaacctactgactttgaattcatcacttattgttactgagggtcatttttcctttctgtaaatatgcacattttcaccaactattcccagggaaatctaggaagtcagatgcaaatagaatatggttgatattcaacaatattcagcctgaagcaatatcaaggtagggtatgtactc

SEQ ID NO: 16217 - DNA, 653 bp, Homo sapiens
tactaatccctaggttgagaagtcagaggttctaattgatttgctgtttgctgccttaaggtttgtgttccctagaaatgatgtttcattttgtatgtacttccccccttactgaactgcacccaaaacaaatgttgtaggttttgacatgggaaagctttagctgttcaaacatgcacaccttgctgacattcaaatccacagactgtaccacacatcagtgtttacagagttcttgacaggtctgaaaaaacattaccatatttatcatttccattggtagaacagaataatggcaaatgatatacatgtagtcctccataattaataaaatactttcacatctgtaattattattcacaaagcctaattctcaaagtgtttcattttctttaaaattatattttattacattcttacaaatatagcctgggctctggtttacataaaatgatgttgacagtgtaggaaaaataaacggtgctttgagggaatggaattacaattggctacgcaaagaaaatgaagattgtaatatcttgacatgtgacaacccagaccaaggcagggtggagttggaagtgtactagattgcgagtgcactagattgcgattgcagtacctggattctaattccaagtctaccacctact

SEQ ID NO: 16218 - DNA, 180 bp, Homo sapiens
tggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataact

SEQ ID NO: 16219 - DNA, 559 bp, Homo sapiens
ccatgcatgtcccaccaaatgctgctgagccacggacagagactcacctcgtacagcagacagcccaaggaccagatgtcggacttgaagttgtagccgttctcatggatcctctccggtgacatgtagtagggcgtccccactgcaacacagcaaggggcggggctgcttatgctccatgtagggcaggggcagggcacagaggtgaggttggagggagggcacacgggagctggggagagattgtgcctcggtctctgagcagcccttctccctctctgggcctgggccttcctctgtcagatgagcagttggatcagattagaggttcccatgctagcagggcactaaacacctggggtgccggggacttgaagcagattccctggacccaccgagaccaagaatcaggctgggaggctgggcgccatggctcacgcctgtaatcccaacactctgggaggccaaggtgggtggacaacagggcaaaaccccgcctctactaaaaatgcaaaaattagctgggcatagtggcagacacctataatccaagctactc

SEQ ID NO: 16220 - DNA, 536 bp, Homo sapiens
aaagagagaaggttaatatcaacctaagattattcattaagactctaggaggacataaaaaacaaattaggtccaaaataagtagacagaggatataagaacagaaatcaatgaattagaaaagagacaaaaaacagaaatgttggtttcaagaaaaaattaatagaactgaaaagttatttgccaagaatattaaggaaaagagaaaatacaaaataccaatatgaaaaatggcagaggggggaaggtgtggtggctcacacctgcataacgcagcactttgggaggctgaggcgggtgaatcacgtgagaccaagaattcgagaccaggctggtcaacatggtgaaaccctgtctcaactaaaattacaaaaattagctgggcgtggtggtgggcgcctgtactcccagctacttgggaggctgagacaggagaatcacctgaacttgggaggcagaggtacagtgaggtgagatcatgccccactgcactccaggctgggcaacagagtgaggctacatctcaaaaaacaaaa

SEQ ID NO: 16221 - DNA, 627 bp, Homo sapiens
gtagcaccattcacaatagcaaagacatggaatcaacctaaatgcccatgaaatgatagactggataaagaaaatgtacatataaaccatggaatactatgcagccttaaaaaggaatgagatcatgtcctttgcagggacatggatagaattggaagccattattctcagcaaagtaatgcagcaacagaaaaccaaacaccacatgttgtcacttatcattgggaggcaaatgatgagaacacatggacacatagacatagaggggaagaacacacacaagggcctgttgtgggggacaggggaagggagagcaccagacagaataactaatggatgctggacttaatacctaggtaatggatgatctgtgcagcaacccaacatggcttacgtttacctatgtaacaaacctgcacatcctgcacatgtatccctgaacttaaaataaaagtcaaaataatttgataaattcattcattgagttccctctctgtctcaaataaatattaatagcaataaaaattaaagctaaaaagacaaattgacaaatttaaaaagcatgttcaatctgcaaaacataaaataaaaattgttttgaaagaaaatagtaattatacaagtggt

SEQ ID NO: 16222 - DNA, 617 bp, Homo sapiens
cagtataagcattatggtagtggctagaggtagtctatcaattaatttttagtgctttcaaaaccccgaaaacttagttctttagcaagataatattcattatttctttcagttctgaggtagagtcattattttgttatgggtcagtctatctaatatctgtgttatgctggtagctcagctaaaactgattattctaggatggccacactatgtatctggcatttggcaggttatttgatttagatcttttctaggactgggctatttgttctaggctagaacactttgtttttgtcccatgaagttctctttcccacttatggactaaccccatgctcctccagttggtaacaccaaggatccaaaaagcagcaagagagaaagtcttaatgcacaaagacttttctcaaacagctaattttttcttggacaaaacaaatcataaagccagcccaacatcagtttgagaagctataaccaaagagcctgaatagggagaagggaatacaatactaataatataaaataatatgctgtataatttaatataacatttattctgaagaagctcacagtttggggaaggaaaaagagacataaacatatttttaaaa

SEQ ID NO: 16223 - DNA, 581 bp, Homo sapiens
gctaagatcagatggccatgatgtcctcagtaaggctggaggcatttgctgagagtaaagcttgagaaggaagagaacaaataagcgctgaaatacagtagatgtgttcttcatcctaagtctactggtttgcctgcattttatgcactggaggtatgtgttcttgtagcagtcttttcaatgagttcatgtgcaagcatttgataaaatgctcatataagcctggtattttcacctccctgaaccttctatgatattccaacaacctgttaggttctccttttgggtctagcaatctgtgcactttctgatcttgcatgaattcctctacgagtccctttggaatcaactactctgtctttagtatacaccaacaaatgataattaaatacctgaaactacacataaaagttaaatagcaattttactggaaaattcagccctaaatgctctactccttgtgtttctcaaatactccaaacgtgctcccaccttggggcatttgcacttgctatttcctctggatagcctcccagagagaaatacaaggtactccttcatcttctcttccattaagtatt

SEQ ID NO: 16224 - DNA, 641 bp, Homo sapiens
caattcactttgatggacctgttagttttggtcctatctctgagtaagacaatgcagtgtcatttttcacagctgtaaacacttggtaatcatgtttagtggattctaaatcagcctgtaacttgattcaactttgctgttaacacaattcctctggattactaaaaattttcctagatctaataattccaccttttgttttctcattaatgagtcattagctagagtcatggctggttataaaatatataggcagttttattggtctattttttgtgtttatggcttttctgaaatgcctgatacaagctgatgcatgggctactttctcattgccacatggtttgcattacatacaattctagagttgctgatgggatgattggctctatggttgccatgatgcttatgtttgcaataaataagaatttctaagctgggcatggtggctcacatctgtaatcccagcactttgggaggccactgggggaggattacttgagatcaggagttcgagaccagactggccaacatagtgaaaccccatctctgctaaaaatacaaaaattagtcaggtgtggtggcacgtgcctgtaatcccagctactcaggaggcagaggtaggagaatcacttgaactg

SEQ ID NO: 16225 - DNA, 425 bp, Homo sapiens
ctacagtgtaaagtctcttatgttgctttttgagggcatctccttgggcatgcaaacagtttccctcggatgacagtggttttagcagggcactctttgaatgtctctttccattatttatttgttaaaatgtcttcttttggtatcacaccaacggtcatagagaagtgtgtctaacactgtaaccccaggactaaattcagttgtgtaatctctgttacaaacttgactgatatttttaccatatagagtcaactggtaaccaataaaattactatctgttatattcatcttcttatcacatccatcatctagcccttctgcttttgaaaagctaattttacattgctagttgaaactagagttgaaatattatagaggggaattcataaagacttttgcctatgtaataattcataggcact

SEQ ID NO: 16226 - DNA, 507 bp, Homo sapiens
acctcacccagcctgatgcatatttttaaaaagttgcttttggccgggtgtggtggctcacgcctgtaatcccagcactttgggaggccgaggtgggcagatcatgaggtcaggagagcgagaccatcctggctaacacggtaaaaccccgtctctactaaaaatatatttaaaaaaaaattagctgggtgtggtggcgtgtgcctgtagtcccagctgcttgggaggctgaggcaggagaatggcatgaacccaggaggcagagcttgcagtgagccgagatcgtgccactgcactccagcctgggcgacagagcgagactccatctctaaataaataaataaaagttgcttttgtttatcaacagtgtatcaaacagtgtatcagagagaacaccatttgtcagtgtatttggaagtacatgcttcattcttatctgcaggatagcatttcctggtatggatgttaccgaaattaactcttactctgtttataggcatctttctc

SEQ ID NO: 16227 - DNA, 484 bp, Homo sapiens
ttcttgttaagtagagatgttgagtttgaaaacaattaggaaagagttaaacggctgaatttacaatggcaaattaaaagtaatattagaaacaagatagtaaggtctagaaataagactctacctaattgtgattacacaagacatcctcagagatcgctcttaagtaataccttgttacctaaagcaaactctctagatccatgattgaagaaagataaaaacaaaacaaactgattcagagcacaagaattagaaggtcattatgtgccttctccaccaatagcaatcaggcatattctttgtatctatgcatcatctatctttttatccatccatccattcattatctacctactaataacttgtctctctgtgtatgtctctatctgtctttatatagtagaatcaattattccaaaaagctaaaggacaatatacaagtagattaaagcagaactgctttctttcaagacagagcctc

SEQ ID NO: 16228 - DNA, 340 bp, Homo sapiens
aacactgaatgcatatggctacatgttcttttaagaggtaggaccttccagagggtgtcaagtgaaataagttcatactatggcacctgacatggaacaactggggagcggtggtttggaggtactttatgagtcaggattgcattaagctgcatggaatagagacttgtctgtaaatagggctttgtccttcccaataacaagaagtggatgcagcctggggctggcacagctgctcaagatagtggtcaaagacccagcttctctacctgcctgctgtgcatcctcacgctcctgcatctccaggcatcatgaacacattccaggcaggaagacagaa

SEQ ID NO: 16229 - DNA, 581 bp, Homo sapiens
gaaattctctgctgactgctaaactcacatttccaacagtcctgtggatattctgacatatatgttccttggatatcttaaactcaatatatccaaaattgaagtcattagttttacaacttctgaactagaagaccagatagacgctctcatccagatctctcaggacaatactgtttgcttaatatcacccctgcccttacccctgttgctcttctctcagttactgggttcctcagtcttctggttatctaggatagatcctcagcactgctggccatcctcccaccctactcacactaccacaatcaatcgctcaattacattgggttttcactccaaactatcccctgaaatctgtcccctccctttcatttccacttactttgtctaactcagccctttattacttctcactcaaggttccgtgacctatattctttctcctactgacacaaaaattttttcactacaaaaagatcagatcacagtcacacaactgacatcatcacaaaattcagagctgagaaggaccttcacagtttaattattttataaatgaaactgaggcccatgtgact

SEQ ID NO: 16230 - DNA, 615 bp, Homo sapiens
ttcatttgcatttccctgatgattagtgatgctgaggttttttttcatagacctgttggccatgcatactttaattcttataaatgaaaaccacatatacaatgtaacccagtgagttaggcagggatatgataaccatgagatcaactaaccctgggaagtggcaggacccgacctatgcaaatgccatgtcttcctgaaaccctgttccagaattgctttcatgtgactctctttctactctttcacactatctctttgtttacatacttcccccaacttacatattcccaaccacaccattttaatctcagtgcatgactgatttacagctttgccactctatgtgagcactgaccccaaaagggacttccaatctgtttagttactagattataatacagaagagaaaaataaacgtaacattgaattcctatacccatattagctttttacaaatcagatcaaccatggcagtgaagactcaccattcatcttttcgttcattaatattataaggaaatctattcctgtgggcagacattaaacatgagagaaattaacacagttgcactaatgcaaacacaatgtcaataatttataatctgggaaaag

SEQ ID NO: 16231 - DNA, 655 bp, Homo sapiens
ctctgtactccagtgcagtggtccccaacatttttggaaccaggtacttgtttcttgggagaaaatttttccacagactaggaggaaactcttccacctcagatcgtcaggcattagttagattctcataaggggtgtggaacctacatccctcacatgcacagtttacaatagggtttgcactcctatgagaatctaatgccactgctgatctgacaggaggtggagctcagctggtaatgcttactagtctgttgctcacctcctgttatgtggacccatactggttcacagccaaggagttgggaacccctgctctagtgcaccctctgagtacaggttccctgtgcacaccgctgtggccatggctcctgctggagacaaagtgtgcactccctagaacctgagagatgcctgcatgggactgctgaagacaaccccaccaacacaaatagcaggactgctatgttgtagcctgagccctgaggccagattcttcaaacccaccaccacagaatcccctgttctacctactagagcctaagcccctgcacactacctggggcctgagatcaaacaccatcagtttatcttcaccagtccctccccaccagagcctgagcaaaccttctgaagacctgggaatcactccagc

SEQ ID NO: 16232 - DNA, 568 bp, Homo sapiens
gtcttaaaatgagaggtggctttcaggggctaaagagcctctggttgaaagtgtttagttagtcattagtgtttcagatgcattaaaagcacaggctttagggttagtttgcttcattttttaagctgtgaacttggttgtatgactttaacctttcgcagtctagtttcctcatctgtgaaaaaggtgataatagtaatatttatttcacagagcttttatgaagatcaaatgagatagtctctataaaaatgctggccgggtgcagtggctcacgcctataatcccagcactttgggaggctgaggcgggcagatcacctgaggtcaggagtttgagaccagcctggccaaaatggtgaaaccctgtctctactaaaaatacaaaaaaattagctgagtgtggtggtgggcgcctgtaattccagctactcgggaggctgaagcaggagaatcgcttgaacctgggaggtggaggttgcagtgagctgagatcagcgtgggcaacagagaaagactccatctcaaacaacaacaataaactaggcacgttatgtggcatatgtgtg

SEQ ID NO: 16233 - DNA, 465 bp, Homo sapiens
cggcctcccaaagtgctgggattacaggcgtgacccaccacacttggcccgaagacttattattatcccatcagcctttctctcatggaatttggcctcaaaaattaagtaaacatttaagtcaaaaggagagtgagaatattgccttctagcctcactgtaccaatgcccttatttactggtgagaaaactgaagttcagagatgtaaagttatatggtctagctcacatagcttctgtgtggtgaagctggggttccaactcaggtctaattccattagagtcttgcgtctttcctgcctactcatatgtaccaagactcagctagtacaggagttgggcaaggtactgagactacaagggggaatgggtggtgagtctactttctgggtatagtcaaattcattttcatacctgatcattcattcatccagtatgtattaagcaactactacgtgcagaccc

SEQ ID NO: 16234 - DNA, 576 bp, Homo sapiens
aacactacagtgagccatgtttgtaccactgcaccccagctggggcaacagagtgagaccctgtctcaaaaaaaaaattttatctgtattctgtgtacagttctaatttaaaacaaactgattgacactgttagggaaatttgctctctttaattaaaaatacattaatattttaacacaatacttctgttgaagaggtagatacaagtttaaattttgtaaaatgtatttaattgattttaagtggtaactttttttcaggataattttgcaagtatgtcagaaaactaaataatgtgacaaatttaaacatgttacatttattttatttatgtatttatttatttttggagatggagtttcgctcttgttgcccaggctggagtgcaatggtgcgatctcggctcaccacaacctccgcctcccaggttcaagtgattctcctgcctcagcctctcgagtggctgggattataggcgtgcatcaccatgcccggctaattttgtatttttagtagagatgaggtttctccatgttggtcgggctggtctcgaactcccgacttcaggtgatctg

SEQ ID NO: 16235 - DNA, 605 bp, Homo sapiens
ctgtatcctctcaggccagcaccgagtgtcccatttggggctgctcctgagaattttctagagaacacaggttcacacacgtgcccaaaggagcgtagaatttttgtggaaagattcccaggaggctgagtgcggtagcctcatgcctgtaatcccagcactctgggaggccaaggcgggtggatcacctgaggtcaggagttcgagaccagcctggccaagatggtgaaaccccgtgtctacaaaaaatacaaaaattagctgggcgtggtggcaggcgcctctaatcccagctactcgggaggctgaggcaggagaatcccttgaacccaggaggcagaggttgcagtgagccaagatcgtgccattgtactccagcctgggcgacaagaggaaaaactctgtctcaaaaaaaaagatttcccaggaaatccatctcatggttgttttgaggaggagactggctgttccctgaactttctcactcatgaaaacacaaaggtattttacttttaatccatcaactcttggcttttcccaggtcccagggggctctgaggaggcccctccctgcagcccttgcagagccaggggaagcccccagc

SEQ ID NO: 16236 - DNA, 573 bp, Homo sapiens
gtctccccgcgtccaagatggcggcagaagcagctggtgggaaatacagaagcacagtcagcaaaagcaaagacccctcggggctgctcatctctgtgatcaggactctgtctactagtgacgatgtcgaagacagggaaaatgaaaagggtcgccttgaagaagcctacgagaagtgtgaccgtgacctggatgaattgattgtacagcactacacagaattgacgacagccattcgcacataccagagcatcacagagcgcatcactaactcccgaaataaaataaagcaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcacctatctcagtgccactggcatgttggtgtcagcagttgagtctttggagggccccctgctccaggtggaaggactgagtgaccttcgactagagcttcacagcaagaag

SEQ ID NO: 16237 - DNA, 423 bp, Homo sapiens
aatgaattttcctgtgaaagtaattaaaactaaggcaatgttatttaatgaaatacataaggcattttagtgtttttttactatttacagattaatttgttaataatttgcatagctaaaaaagagagaagtgaataatgatgtcttttgtcttaagcgaaaaattactgaaatacatatgatacttattaaatcactggtagatatcacaattttggaaggagaaacacatacacaaatatacttacctgaagggtattggaaaggaagccacaccaattttaaaatatttagttaaattttaattaaaacaagtttattgttatacattttattccaatatataaactattccattatgtaggtttttctgttttgagcatgtgtaccataaacgctatgccaacggtgactttgaatcct

SEQ ID NO: 16238 - DNA, 443 bp, Homo sapiens
attaataaaagttaagataccaaaacactggtgtctaattctttcaactaacaacttgaattattttccattttatttcttcttactagatcgatctgcaattctacacaattgttgggcagctatgaatgacagtaggtttacatgatatattttaaaaactgatttttctgccacgcaaataattgaactttgtctgaagatagtgtgcctgggaaaccagattttttttatttttatttttatttttatttttttgagatggagtcttgctctgtcaccaggctggagtgcagtggtgcaatctcggctcactgcaatctctgcctcctgggtccaggcggttcccttgcctcagcctcccaagtagctgggactacaggtgcgaaccaccacatctggctatttttttgtattttagtagagacagggtttcaccatgt

SEQ ID NO: 16239 - DNA, 569 bp, Homo sapiens
atgtattagaatactgatgtattaaagtggagtattccatgttatgtatttgtgttaacccagtgatgttctggagtactgctgtattagagtattccatgtgtgtatttgggctaacccactgatatactggagccagtttgcaccagctcatgatgctcattaaattttcaggaacttacatggcagttggctaaacatactaataaaaattacagtagcttagaattaaattatagcaaaacaatgatactcaaaattcataacttatgttacattatactattacttatgcttttgaggttgtctattttagctgtatgatgaaaaatattatacaatgatatgctactgtgctgttctttccagtgatgtcatatcagtggcttgaaattggctgtggtgggagtatttactccacataaatgggcaaatgctacaaatcaggctgtatcttttcctccatagagccaggtaggcttatatcaccatgagaaatgcttcctagtagtctctgctctttcatcctggggcacccgagaaggatcatatatgaagcagatatgagc

SEQ ID NO: 16240 - DNA, 404 bp, Homo sapiens
cggcctcccaaagtgctgggattacaggcgtgacccaccacacttggcccgaagacttattattatcccatcagcctttctctcatggaatttggcctcaaaaattaagtaaacatttaagtcaaaaggagagtgagaatattgccttctagcctcactgtaccaatgcccttatttactggtgagaaaactgaagttcagagatgtaaagttatatggtctagctcacatagcttctgtgtggtgaagctggggttccaactcaggtctaattccattagagtcttgcgtctttcctgcctactcatatgtaccaagactcagctagtacaggagttgggcaaggtactgagactacaagggggaatgggtggtgagtctactttctgggtatagtcaaattc

SEQ ID NO: 16241 - DNA, 512 bp, Homo sapiens
ggattatttagctgttggatgtgttctcttactgaatttcatcttttaaaagaaggaaggaatgcatgaagaaatacctgtaaatgaccaagaaaataatttttttaagtttttttgtcataatttgtggggctttttttcccttgacttctgaagctccaaattcaccctcaacagatgtgctgttgaattctgacattaacaaaaccaaaccattttaaaccactcaccagtaaaataaaaactaaatatttgcttagcattcccagcatttctttcattgtgaaaacaatgaaaatatggacaaattaattcttagtggtactctatacaataatttagtgctaggatttatattagaaatggggttttcccaaactaagtctgtggttgactgaatcaaagataagcaagataatacagtatgttataaaaagtaccctataaatgtgaaaagaccataatagtaaaaatatattagaatgatactaacaataataaatagtgctagc

SEQ ID NO: 16242 - DNA, 501 bp, Homo sapiens
catgttttcttatgtgatataaacctgtgctacagtttttacaatactgagccattaaaactgaagtctaggaaggaaaattgcaggtttacaactatcaaacttaactagttgataagtttaaactgataaatgaaaatttaggagagattatggcaaattgagtatgctggtgtttttctcctaatgttttttattttcctttatctgctaagtgatctcttcctactctgaattctcaaagtgctttgtgtacttcttaatctccccttttagattgtaaactccttgaaggccaggattctcttctttttttgttttttgagatggagtttccgtccttgttgccctgactggagtgcaatggtctgatctcggctcactgcaacctctgcttcccaggttcaagtgattctcctgcctcaacctccagagtagctgggattacaggcacccaccatcacgcccagctaattttttttgtatttttagtacagacag

SEQ ID NO: 16243 - DNA, 488 bp, Homo sapiens
agatttgataacctagagttgctaaatgactgacgggtgggtagtgttgacagcgtgtatacactggacaaagggatgattcacatcctggccaggacacagtgggttggtgtgagattttatcatgatattcagaacaatgcacaatttaaaacttatgagttgtttatttctgcagttttctattgaatatttctagattgcagtcgaccttggggtcactgaaactgtggaaagcaaaaccgtgcataaggcagaactattgtatatggtttttctcttttaatttttgatgaaatgaaatatgttattatatgtctttaagctaggccatctccaggttctgaaatacacacttttcatgccatgttctaatctcttctggatttagatttgtgaatattttgaagttttagcaatattagtgagatctataacttatgctcttagcagatggagagaagaggtggagctgctaaaacttcaga

SEQ ID NO: 16244 - DNA, 512 bp, Homo sapiens
gtccagcatagtaaaaaccgcaaggcagaactctcagagctgctcccagccagcttagcccaacttctctcttggagtgtattatttctctcccattaataaatcttttgcctactttactaattggtctcttggccaaattctttcctccgagaaaactaagaactgaggaccgcacacttccttgtaacacacagaccacagactgtttctgagtctgtgttttttctcccagggattgtccttaaccttagcaaaataaacttctaaattgattgagccctgtctcagatacttttcgatttagagtgcaataaatatccactaatttttatctgatttttccttctttgataattttgaagggacaaaacaaggcatcctttgtgtatgtccaaatctagagtcagtaaatcctcacttgatttaatgagatgtccaatatgtctttccagttaaaatggtgtattgaggccggacgaggtggctcacgcctgtaatcccattgggag

SEQ ID NO: 16245 - DNA, 499 bp, Homo sapiens
cacagtagttcagtggaactccctattctaaccttgtctctttttccaccatacacacacacacacacacacacacacccacacacacacctcccacccacactgctctttcagcctacccctgtgctaagccagctgggcaactgcagttttagaaagagcagagccaagaggtgcacaaaaacacattagtcaccttataaaccggagctgttgaaacaaacatacttgcagtttcactggaactattcatatttaacactagaataaatagtggtgtgtatactaatctcgagtatttcaaaatggatataagtcagaatatgagtgaaattcgaactgtgacataactttctactcagtgtgtatttagttcaattagatatataattctgatcatacttaaaattgagatggagggtaaattatctcccaatttttagcagcaggtgggaagaaagtgcctataccacattactatattataaagaaaatttta

SEQ ID NO: 16246 - DNA, 592 bp, Homo sapiens
tccaaacacagcaccatttagactttaatacacttatccacagtatctcaaacaagcataaaggaaaataagcagtctttgcgatccataactttcctggctgatagacttaaaccaccttaaatggaagacttgggatgcttttctacagttctgagattaaatagaatgcatgtatttaaacaaataaaataaaattgagaattcttgcctaaggcctttcatgaactaacttccatgcattaaatgaactcattcttgtatgcagtcattcatttatcaatattgtattgaggacttgcttgtgctggttagtgtctagaggcaggggatacagcagagatccaggcagacacatttcctcacttatagaaagggagatggaccagaaacaagcaaacaaatacacatggcacttgcagactttctaagtgttatcaagaaataagtgggatggaataagaagaataacctgaaaagggagggaaggggaatagaaggggaagctagaaaagagagagtagccagttaaggcctctgtaagaacatgatgtttcagcatgaaccatgcagagtgacctacacagaggga

SEQ ID NO: 16247 - DNA, 536 bp, Homo sapiens
ttgtgtttaatcccctgttatctgcaggacaaaaatcttggttccttaacaagtctgaggagctctccctactccttctcctaacttattctctgccctttgtccctcataaattagcctttagcaatcctataccacttattggtcatccaaggctccaaactgcttcggattgcttcaaacctctgctggtgcgctcagctagtcactcagcctgggatgcctgcctcttcctacctttccatccagaggtattacttcctccatgaagcttttcctaccctgatgccgtctgcacatcaactgcacaactccagccctgccccatgcactcacattgtattaaacttatatgtagatgcatttatccttcacttgactggaagtcgtttgtgagtgggaacaaatctttgtgaatgacaagattggtctcaatgaaaaacagccataatattcattggtcttggtatatatctctatatataacatttactatattgtacagtatagagagcagtttgtccccctgctagtct

SEQ ID NO: 16248 - DNA, 626 bp, Homo sapiens
gtatccgtatgatccatatgaaaaacaaaagtaaatcttgaccccttcttcacagcgtaaacaaaaatcaattccagatggactgcaatctgatatgaaagactgttacaatagacttttagaaagaaacactgaacactgtcttcacagggagtgtctggaaaggagctgagggtactttcaaggagctgctgatattcctgattttgatcttactaaacaaattataaaatgatttcaatatatgtacccacgtaagcataaattggtactttaagacataatactgaaaaccttttacaaaaagttttgcagaaagaaagggtcctaatagcaaaggaagttcaggccgggagcagtggctcaagcctgtaatcccagcactttgggaggccaaggcgggtggatcatgaggtcaggagatcaagaccatcctggccaacatggtgaaaccctgtctctactaaaatacaaaaaattagccaggcgtggtagtgggcgcctgtaatcccagctacttgggaggctgaggcaagggaatcgcttgaacctgggaggctgaggttgcagtgagctgagatcgcgccattgcactccagcctggctacagagcaagactccgtctc

SEQ ID NO: 16249 - DNA, 409 bp, Homo sapiens
caatgtccacttaactaagaattcccatcaggtatggagatttacatttttgatagttattgagattataagttttatcctctttggattattaatagggtaagttatgttaatgtctttcgtattggcctttctacctttcattcttataataattccttttggggcaattttgtttttgattgtataatgctgaagtggatttgctaacatataatttaggatttttttgtgtgttatttttgttaaggttttaaatctgagttgcggtaacttgctgaaatgattttctatgctctgaaatagactaaatagcatggaaattttcatataaaaccctctgggcctggggcctttttgaaagtagttctttgacaatttctctcacatcttatttgcctattttgag

SEQ ID NO: 16250 - DNA, 627 bp, Homo sapiens
ttgtccattcatttggccacactaccatagggatcctaattcttcttgagaattgattcttttgtttttgtttttgttgttgtttatttattttgagaaagggcctcattatgttgcacaggttggcctcgaaatcttgggcttgaggtatcctcctgcctcagtctcctgagtatctgggacaacaggtggatgccattgtgcccagcaaattattttgacttataattcattctggatgacattttatataataggactacagttaatgttggttttattttgcttatcttggttgttattgtgattgactttttaaaactttttgttcatgtttctttagcatttctaatgtttttcagcatggtaactaaatacttttatataatataaatgctaaggttacatggtaggcattgttcatgggcaccatgctatacacctataaattaaaatcagtacaatcatatccaaatgaatacaattatatcaggtgacagagttgttaatagctcagaagataaacggtttcaccattgctcagtagataaatttcttctttccaaaatgtgatttaaatatcaatacttccccagcactttgggaggccgaggcaggcggatcacg

SEQ ID NO: 16251 - DNA, 556 bp, Homo sapiens
cttaacacacatccacataaatgaatgtgcataaggcatgggggggtagaatgggaaaagaaaggaagtggaggtccacagcacatcctgaggctatagttcaagatgaaaggagacatatattaagtttgtctcaaaagttatatcttgagattgaggagaaaggagaaagaagataaaaagttttaaaacatggtttgaagccaagctagctgtcctgttacaaaatgacaaaaggacacataagatacaatgaatactcctttttattcaataaaaggaagagacaaaataaatctccagaaagccaccctcaagaaacacagatttcttaagtactcgacaaacaatttaaacaactttcttaaagatgttcaataaactaaaggagaacacagatggacaagtcaacaaaatcagcaaaatgaggcaggaacacaattagaatattaaccaataggaactataaagcaaagaaccaaacaacttttagagctgaaaaatacaatacctaaattgaaaaattcagtagaggggttcatctatggtcttcacc

SEQ ID NO: 16252 - DNA, 581 bp, Homo sapiens
tcataatcaaagagtagcaactaaaatgaaaatagtggtattctgatgaaaaacataccaaaaaactaaacatatcaaaaaataaattagagagctttacatttaattagtttagcagtttgataataatattagctaactctacaacactaggtgccatatattatttcattgaatgctcatgtgaggcatgtaggtactattatccttatttttaaaatgaggcaactacaacacttgtccaaaggccactcatctaatatgaagtgaaaatgggattcaaattcaagcattctcaatccagcatctgcacctcaaccacaatgctgtgctgcctctctaaataatttactcagaaattaagattaattccctttcattccattttttaaatctgtggcaaaatcctacttcatttccatttttttgctaaaagccaggaatccattggataaatgaaatctttaaataagatgaaaacaagtgctgtaacttaaaatatagtataacctgactccttttgtgtatatgacaaaatatataccagtgacatggctaaaacattattccaaatagaatta

SEQ ID NO: 16253 - DNA, 529 bp, Homo sapiens
tacagaagtgcaaatgagaggtgatggtagcttacaggagctgtggagacagacagaagtggatggctgggatatgtctttttaaaaatgaggctgggcgtggtggctcacgcctgtaatcccagcactttgagaggccgaggtgggcgaatcacctgaggtcacgagttcgagaccagcctgaccaacatggagaaaccctgtctctactaaaaatacaaaattagccgggcatggtggtgcatgcctgtaatcccagctacttgggaggctgaggcaggagaactgcttgaatccgggaggcagaggttgcagtgagccgagatggcgccactgcactccagcctgggtgacagagcgagactccatctcagacacacacacagaggctgggcgcagtggctcatgtctataatcccagcactttgggaggccggggcaggcggatcacgagatcatgagttcgagacaagactagccaacatggtgaaaccctgtctctactaaaaacacaaaaattagctgggca

SEQ ID NO: 16254 - DNA, 463 bp, Homo sapiens
ccttcttttcacaagatgtgactaattactttaaattgctctggtttattaagtgaaatccaaagtcacttctgtgctcacctgacatttagttaatgagcacagtgctacctccaggagattaatggaactttgataaagaagtagtttaattggtgaaatagcatatttggatttcactggagaaagggtgaaataatccatatatttgaatccaatttaatgtaattacattgtaattttggttattgccaaaagatggtttgtcatttgaactgagaactagaggttaactaatatatgcaattgaaatctatcagggccgggcgcggtggctcacgcctgtaatcccagcactttgggaggccgaggcaggcggatcacgaggtcaggagatcgagaccatcctggctaacacggtgaaaccccgtctctactaaaaatacaaaaaaaattagctggg

SEQ ID NO: 16255 - DNA, 606 bp, Homo sapiens
gatactaatgaggagtgatccagtttgctccacagactcccttgaaatgtccaccatttagatcctcagatcccaaaataggtagggtaaagaacaggacaggtatcccaagtgcctttcctcagccatagcagccatgttagtatcattttcctactccatggcagtgactggaaatggtttattctctgaaaagtttgaaaccaagaggcctcaagttaaaggatactaaatgcagaaggtggcatgggagagatgggacactaaaagggaatataaatgaacctttaaaatctgaattaaaggacctcagctcttagtataccagagaccaggtgtgtttactattcaggagctcagagaaacaaattcagtggctccaaaggagagactttaaggttctaaaatctgtgggtatcctaaagaaaagcctggcttatagtctgatcacttcaagctcagcagtcaacaaaccctgtcaatgtacataataagatcccccctaccccagtaaactttcttaaacctcagccttaaatggaaattgacagacaaggattatcagacatctgagaagagcatcctccatgaaattataaaaataaa

SEQ ID NO: 16256 - DNA, 190 bp, Homo sapiens
aaataaaaagtaaaaaataaagctcatgaagtatctcagatacttagaaaaaaaaggcaaagatatagacaaatagaagggaaatcataagaaaagtaggacaccgatttagcagttccaatattgaaaaatagaggttcttaaagtcaaaacacagaaaacaggagaatgaaaacaatgaaagacatca

SEQ ID NO: 16257 - DNA, 554 bp, Homo sapiens
tccaccctcatggcccagttacctcccaaaggccccgtctccacataccatcacagtggggattaggatttcaacatatggattttgggtaggacacaacattcagtctgtagcaccactgaatccacactcaatggtttgcagtgctaggggtttactcagtaaagtccacatcattactggattccataagaggggacctgatagaggttactggaaacagcacagagtctgagttatgtcattattgacataactttgggcatgtaatttaaccttttcagctctttgttttcctatccaagtaacagctgctctaaatatctcactgaacacagttgcaagggtcaaataagataaactgaaaatgtcaagaagggtcaggcatggtggctcacccctgaaatcccagcactttgggaggctgaggcaggcagatcacctgaggtcagaagttcgagaccagcctggccaacatggtaaaaccccgtctctactaaaaatacaaaaaatagttgggcgtgggtggtgcacacctgtaatcccagctactc

SEQ ID NO: 16258 - DNA, 487 bp, Homo sapiens
gtggaagtacaccggagaaaatataggaaagacaatggttaaataagcaattgccaagagttttctataactgaagacaagttcaattgaaaacagacactgactcatgaacagaataaattaattcaaatttatgaaatgaaatcattctgaatctggaaaacactaaaagtaaagaaacttttaaaagtcccaatggaaaaaaaaagacgtaacactgaaaaaagctttgtagatacgtgttgaatgaactgttgaaagcaaagtggtggaaatttgtaccagaaaaacattgaaaccaaaagtggcataccaaagtcagtatcagacagataacttcgaactattataactcattctttgagttcttagatagaattaaatgtcatttctaaaaggtctgttttgttctttctcaaactcaccttttcaaaaatcatatgatattaactcattttgggcattatccttgcatttatcatctttg

SEQ ID NO: 16259 - DNA, 511 bp, Homo sapiens
cagacatggaatcagttcaggtgacatgccttttctcctaatcctaactctaatcacctagctactctcccatgttacaaatggaaccaaggcgcacagaaggaaacaacttagccaagatgcttccacttctgaattggtcacagttgaacatgtgtgcatggaaagtataagaatagctgtatgtttatttgctcattcactgtctctggagaggggtttactttttcagcagtgaagggtcatggttaaggcctgcctggtaatggaagcctgcttatgttcaaaccttgattctttcctaagtgaaatgttcattctttcggttactagtgtgatcaatggctaataatctgaagtttatttcctcatctgtaaaatgagaataatattaggacggtaggacccaggacactaggtttttgtgatggataaatgtgttaaggtcgggcatggtggctcacgcctgtaatcccagtactttgggaggccaaggcagatggatcacctg

SEQ ID NO: 16260 - DNA, 492 bp, Homo sapiens
ttatgcttaaactactttgagtggattccaagtacttgcaacaaaaacaacaacaaaaaacatagattgaaatagtaacaaggggactataatctaaatcttctatataagaggggatggaaggaggtaataataattctagcgcttattccttataccctgtagagggttctacagtttgtaatgtattttagcttacacaatcttatttgagtcttacaacaacctctgaacacaagtaaggctggcatcattatctgtatttcacagatgaggaagctgagtttcagagacaatacaaattatgctgaattgaaaaaaaatggaggccgggcgaggtggctcactcctgtaatcccagcactttggaaggctgaggcaggtggatcaacctgaggtcggagttcgagaccagcctgaccaacatggagaaaccccatctctactaaaaatacaaaattagctgggcatgggtggtacatgcctgaaatc

SEQ ID NO: 16261 - DNA, 469 bp, Homo sapiens
tggaaaagatgcaatgttttcttagagaaaacacttggcatctaggtgaggggaatacatagaagagtaatacttagggagccaagaacagatgtgaaaaaatgagacaggaacctttcgattctttcaggcttgaggcaaagtaccatctgtcaagcacctctcttggctctcccaaaagaatatgcctccagctctccagattgtcctggcaattaaacttgctcccagatctgtcacatttatcatcgtaaagttccgaaaacagacttccatgggcactctgattttctatgatatctgttatttcatgactggccaatagcctgatggtgacttacccaatccacccagagtttctcctaatgaagttaatgctgtagcagccagaaccaatcccaccctaatcccttcttccagactctagaacctataagaagagatggaaggcacctgtgtctcagataac

SEQ ID NO: 16262 - DNA, 482 bp, Homo sapiens
atggccttcatctcccccaaatcattccttcgttccatctgtcttacagatgagttaagacagtcatgtattccttttgagctgtgagaagtggtactgagaagctggactcatttttcatttaaaagtttctaataattcggtgtctacctctgggtcctcagcatcaatctggtttaggtggatgtctcctgtcgtgagccactggaaaacaacatcctaaattaaaaaaaaaaagtatataattaggacagttggttatttgaaaaagctgaaggtcaggactagagaattaaatcaagaagaatgataaaggaaaaaagattaaaccagtgattcagaaaagggtagccagccttgtcttgatgcaatcatatgagaactcaaaggttttcttcaccctaatgcaccttttatttttgagacagagtctcgctccgtcgccctggttagagtgcggtggcgcaatcttggctcactgc

SEQ ID NO: 16263 - DNA, 541 bp, Homo sapiens
tggttaaaaaaataggacattctttcatttttatatcaggcttaatggaatgcttatggaactgtgtgtttttaaacagacatgactcaaaaatacaccaaaagatatgcaagttatagtgtcataccaccaatgggactatacacattctgaagaggaaatagcccatgctgtgtctaagtattcccctactgaaatgagagagaaacacctataagtgagcatttgtgatcttattaccacctcagaaatcaacatcaactgaccctcaaaaggagtggtttaagcaaagaacttttagagaagagcaatgtactctgcactgaccagaaggaaggtgttttttcagaattccctgttttttatactatgggtagagtatctcttttccaaaatgctggggacacaaaatgttttggatttcgtacttttctgaattttggaatatctacgttataattactagttgagcattcctaatcccataatctaaaatctgaaatacttcaataagcatttcctttgaatatcatgtcaacat

SEQ ID NO: 16264 - DNA, 583 bp, Homo sapiens
gaaggggggataccccgaatttaaataaaatcgagttgtattacagttagggatctctcagttcccctccttccctgttggagcattcacttctctgagtgccgtttttttccaagtgtcaagtggcagtaatcatttctcctcctaaggacagtgtggaggctaaaaacaagttatgtgaaggtttcagctcaggctctcagtcctaaaaaataagacttattatgagagggtatagacgaggtggtctagaacacaggttttgaggtaagagttgggttaaaatcctggctctgctgtccaccagctctgccacctagggcacgttatttagcctctctgagcctacctcatggggtttgtaaagattaagcagtgggccaggcacggtggctcatgcctgtaatcccagcactttgggaggccaaggcgggtggatcacgaggtcaggagttcgcaattagcctgaccaacatggtgaaaccccatctctactaaaaatacaaaaattagccaggcatggtggtacacgcctgaagtcccagctactcaggaggctgaggcaggagaattgcttgaaccc

SEQ ID NO: 16265 - DNA, 550 bp, Homo sapiens
gccaagatcatgccactgcactcctgcctgggtgacagagcgagactccatctcaaaacaaaaacagaaaattattttttaaaatttgtcttgaggcttataatctacaatagctaaacaattatgagatatgcatataattgcagtcaataacaatcatgttttagaaaagtaatgatacaggaaaatgcatatgatacacctttaagtgaaaaaagcaggaaacccccaattttataaaagcaaaaaatatatatgcacacatgtaaaagagttgaggaaaatgcatcaaagcatcaagggtgtctacctctggcctgatggtatcacaaatgatgctttttttcctttattataattatttcccaattttctacaataatcattcaaggccagtcatggtggatcatgcctgttaacccagcagtttggtaggtcgaggcaggagggtcccttgaggccaggagtttgagatcagtctggacagggtagtgaaaccccatctccacaaacaaacaaaattaggtgggcatggtggtgcgtacccata

SEQ ID NO: 16266 - DNA, 480 bp, Homo sapiens
tgttttaattctagggtataactttaatatttacatatttatatttattccaaagatcattttattgttatttgtctaactagtacagtggatcttttgatcattaatttttagttttcctttcttcctaccataagtaattaggattaaaaatgtactttactgttataagtagagaaagctagaagcaagttcaattggattttttaaatttagccaaaagctgcttccttatatatgtttggcctaaagatttctccatacatagtgaactgtaactcaacctaatgtataaaaagactgtaacctactgttgtgtcagtcacagagtttcaggcaatcaaaggtggccaactgttctaactgccaagctgtaaccaatccagctgtttctgcacctcacttccattttctgtgcatcactttcctttttctgtccataaatcaaccctgcagcagggttgcagcctctctgaacct

SEQ ID NO: 16267 - DNA, 525 bp, Homo sapiens
atacatgttttttacatcatatgtcaacattcattataagaatattgctctatgcattgccgtagactcaaagaatttagtcaaatgatcaaagagcccgtaacagaagtataatattgtagctcaggaaaaatatggagataccatatgaagaggtaaaagaagttggcagttctcagtaaagagaaaggaagactgcactaggaaagacacaaagctgtgtttgaaccttcacttctttctagcccatggagatgagcatagctgcagagctattcaaaatctagcgtctgtcaattcccttcctccatttacacctcttcctgcagaagtatgtttgtggtttttacccgtcacgggactgtttactttggagaaacgtcttctgtggactttgtatggggtttgtagttgcaggtgcatcttttgttctctcctcaccctgtttgaacttatatgaactgtcacactccccacctcgcctttttgaaaagtctagtcaagatagtccctttaaaaaataat

SEQ ID NO: 16268 - DNA, 621 bp, Homo sapiens
tccttctttaacccaagaatgctttagtagtgagttttttttagcttccagcaaatgaacagaagggaggatgttattcttttgtgctttaattattttaattattacattatgatcaaagaactatgatctctatgatgtagattctttgaaagtatggcatttttgtggcttaatacaggattgttgcaaatatatatatgtatatatgctacatatatatgcatatattctatacatgctatatatatgtgtctataaataaactacagtttattgggtagtttacatcttcacttttttcatgctttatcaaactctgagaggagcatatagcattttctgattacaactgctgatgtatttatttctcccttcagtcctgttagtagctactttatgtatttgaagctatgttgatatgtttattattatatcttcttgacatattgttcctcttacaaaaatataatatcccaatattctgcttgtccactttgatgttttaaacttctcttttgtctgatattaatactaaatatttctataacctttctaactcaggaatagaaaaccaaacatcgtatgttctcactgatatgtgagagctaagctatgaag

SEQ ID NO: 16269 - DNA, 605 bp, Homo sapiens
aatggtttttatatgtttaaacgactaaaaaaaatttcaatagaaaattattatttagtgacatatgaaaattatatgaaatcaaaatttcagtgtccataccacactacttcattttatatattgcctagggctactttcaagctacaagggcagtgttaagcaggtgtgacataaactatatagccggcacagtctaacagggtgtccaagcgagataatacagtcacaggttcttaggttctgtttctggttgggccagtaaagtctcttcctcaaccctctgtttcgcttattactagagacagactaaaaaccatggcttcaggctgctgaaagcctaaaacaaaacaaaacagacaacaacaaaatacggtgggttggataagcttagtctaaaatattgactcttgtctatttacaaggaaaaaaaagactgttgacctcagctctaaagactggctagcatgctccaggggaataaccttcccgggtagacaaaagttcctttacagcattctgtagctttgatctggggtataaaatgccagatctcattaaatgctgtaattaaagggagatgacagtaatttaactttaaaaca

SEQ ID NO: 16270 - DNA, 592 bp, Homo sapiens
agtcacctcctgtgtgacctccttcccagtttctcccgtcgttagttacatactctgtgatgatcctgaacatctctttcataccacaatgatagaatttgtcatggtctggcttatttggtgctccctctgctctgttcaaccccaaatagaaggtgatgtttttggaagtggaggaggcatgtctcattcatctcagtctccctagtgcctagtttggtgcttcatgcctagtaaacacgaatatgggtttattaaaggtggacgtgggtgccaactctggctgcattccttaccagctatatgaccttgagcacattccttaacctttcgagcttcagtatttgcatctatgaaatggtgatcatgaaacctactcataaggttgatatgagatatgtaaaaacgccatgcacactgcagggcacagaggaagtgtgtgataaatatcttttaagggatagaataaatgagtaagctgacctggtgtaaaagcagatggtaataataaactactacctatagagtctgtaccaggcactatttagggtaaattatgtacgttacctccccatccttcaaatgccaccta

SEQ ID NO: 16271 - DNA, 570 bp, Homo sapiens
tggaaatgataaccattttcttagtaaaactctcaatgacagtttaatgctgttagaaacaaaatattttattctctcataacagagaacaaattatatttagtttattggtaagaatgcttttgatctgctatacacatttatgaagatattagctttttattcagatatggattttaaaacatcttttggcatattcctgcctttgtgctccttgaacttgtgaactcagctaacttatctctctagcatacttttttaggctcttttgtaaacatttcagttttggcatgggaataagacaaaaatccaactgtaatctcagagatgtaatgctctgtggaaaaagaaacaaagcattatggcaaggaaagctttgggattctggttatttctgtatatccacaaaaagcatacaatttcaaatttcaatggccaaattatcatctgtctgtgattttattctgatcatcatgatcctcaacttatcagtataaagactgaactgggaattatacaacaggataactaatggggaaatagtcattgatgggaagttctgaccatatg

SEQ ID NO: 16272 - DNA, 559 bp, Homo sapiens
tacagaggacttgatttttagaaaaacttaaaaattattaaatagataagatcatattcagagctaaatttaaccagaatctaacattgtttcccagatgaagagtttcacaaagccgactaactagtccagctgactccctaggctgctgggtagcagagtggggacatgtctgtgtgctgagacttggtgtgtccctgtcttgaagcccagggcctggccctgcactgccaggttacccagatgcagttatagaagaaaagccaaaacaacttgcagaaaataagtctgccgaaaagataaataatagtattccaatacatgaacagacttgtgacatctcttctctggggacagaacaagaggatacaggtttatatcccagcaagaggaattctgccgagaccagttcggtcagggagaccctaacccagcggcggtagaggaattaaagatacacacacagaaatatagaggtgtgaagggggaaatcaggggtctcacagccttcagaactgagaaccctgaacagagatttacccacgtatttattaacagc

SEQ ID NO: 16273 - DNA, 515 bp, Homo sapiens
atatactactccaaacgattgcttttctcattccccttctgacatttccatgatatattttatatctacaccagttaagtagacttggatgtctgttcaatctacttttcaaatagtttttacattgttcccctaggttaacttatatttactagaaaaactgtatggaaaatatcatacaatatgtgtattccattctacaaagcctcagaaaagaactgtgttgtacctgatccagcctcaatttagagaaaacatatattttattttactgtttattgtaggtaatttttatttcaaatgggatttaagtaagaaaagttcaagctgcacaactggaaatatcttaaaggcttttaaaatgtttctttgaattagaaacctctttcttcacaattttcacatattcccatcttgtcctttttaaagcaattacacaaacaaatctcatttggccagatatctccctctggatactaatcaaattattcctttccttttaatctcaacatctt

SEQ ID NO: 16274 - DNA, 506 bp, Homo sapiens
tatatatgtgtgcatgtatatgtatattttataatacacttactaggttctttttatttctatattcattgctttgcttaatctacaagtcattttttctatataaaagtgtcattatacctgacataaccgtatgtatacagttatgtgtgtgtgtatatatatatatatgttttgtcacctctttctcaacttccattcactgtgaatatatttaaatcacactttcctcgccatcaaggtatacacaccactcttttcgggacactgtcaatttctatgttgccagtttcaatgatcattgtcaattcttacactactgatctttcagcaactttttgatagaactgattgctccctttatcttaaaatcttttctttaagtgactccaaagacccttcttttggatccttcacattactggccaatcattctctgcctttattgctaaatcatcccccactttcttacctttaaatattggattgccctctggatcatttat

SEQ ID NO: 16275 - DNA, 355 bp, Homo sapiens
aatattcacaaggattcattaaacatttcccagtgcggctgaacaaaacagtgttcaaacccccaagccattaacaaaaaaggaagaagaaatattacagggacgatatgcgcaagctaaaaatgccacaagcaagaaatcacttttattttattttttttcaactcaacttcatctccctcatctcactgatgtttagaagggccccagtgtgctgagtctttgtgaagacttggaataggacagccctgattaccattactatgattgtatttttctacttcatatacacaggaagttgtttcaccacagcaataatatttatttatttgtttttcagaaagagtctcactct

SEQ ID NO: 16276 - DNA, 569 bp, Homo sapiens
tgtgctcactcctgccatccatcaggcctttggggcacgtgggcctggcagaatgagtgacctgtgaaactgaatttgtccacaggcctaccctgagcagtgagttattaaacatcagtgaagagcaaggaagggtatgttagtccattttgtgtttctataaaggaatactgaagctgggtaatttatatagaaaagaggtttatttggctcacagttgtgcaagctatacatgaagtatgctcagcttctgatgaggatctcaggaagcttataatcacagcagaggctgggcactgtggctcatgcctgtaataccagcactttgggaggccgaggtgggtggataacctgaggtcaggagtttgagaccagcctgggcaatatggtgaaactccaactgtaataaaattacaaaaattctcctggcatggtggtgggtgcctgtaatcccagctactcgggaggctgaggcacgagaatcacttgaacccgggaggtggaggttgcagtgagccgagatcacaccattgctcttcagcctgggcgacagagtgagactctgtctc

SEQ ID NO: 16277 - DNA, 612 bp, Homo sapiens
tggtcttttggtttttgttgtgttcatttcacagcagatcagtgagcgtgtccttactgcctggccccagttcaagtcctggtgttagtgcttcggctttgaagtcagatgacctggggtcaagcctgtgccttgccactgggtggctgtgtggccttgggcaagctatttgctaaactttctgtttctgcatctatacaaagtgaataagactgaaaccttcccttcgtaaggctgttgaaggccaggcgtggtcactcacgcctataatcccagcactttaggggaccgaggtgggaggatcgcttgaggccaggagtttgaattcagcctggcaaacatagcaagaccccatttctacaaagaaattaaaaattagctgagtgtggtggcatgtgcctgtagtcccagctactcgggaggctgaagtgggaggatctcttatgcccagtagtttggggcaatagtgaaccatgatccactgcactccagcctgcatgacacagtgagatcctgtctccaaagcaaggaaaaaaggctcttctagaggactaaatgaggtaaaggaaacgtgtaactggggtataatgggcatgcagccctgggaagctc

SEQ ID NO: 16278 - DNA, 447 bp, Homo sapiens
gtgtgatgtcggcttactgcaacctccccctcccaggttcaagctattctcatgcctcagcccctgagtagctgggaccacaggggtgcaccaccacacctggctaatttttgtatatttggtagagtcagggttttgccacgttggccatgctggttccaaactcctggccttaagtgatcctcccacctcggcctcccaaaatgctgggattacaggcgtgagccactgtgctcagaggcaaataatttatttacaagtgtggtacatgctacaaaggaaaatttctgaatactatctggaagggtgtggagggtggcagggtgggtggtcagggaaggtcttgccaaagaaggggctcctgagtggaggaagggatggtgaggagcttgctaaagaggaacattcctttccaatggaaaggtatgttcaaaagccctgagacag

SEQ ID NO: 16279 - DNA, 523 bp, Homo sapiens
tacagtttctctctattttctgaagcactagattagctcccccagtttttttagcagtcacattattctcccatacatgtctatttttggtgtcttctatgtagaaaatatgttaacttgcttttcagagataacatcctgagacagttaaagaagcagataatttcataatcaaaatctttactctctgatatagctgaaacaacattgctttgagttgtattctggccccaaataatatttctaggagaaaaacacaagagtcttgggtcatcaaagacagaagagcttacatgtaaaactcctacagttttgctacttaaagataacctaaaccctatccaaccatgtttttatgaaggaggtccttaacctgaaggtttaaataaccgaatgaataatcatctaagtgttagattcttaaaaggtattttattgatgaattatatatataataccttttactatttatagtttatattcaatacctcttttaaaaagaaatgcatgagccggatcacga

SEQ ID NO: 16280 - DNA, 600 bp, Homo sapiens
tgtcttcttccactactcagaaataaacatcatgttttgctctgtgtccttccagacgtttctgtcatataaacacactatgattagatttgaggttttgtaaaatggcatgacaatcataatccgtctgtaatcttctctattcatttaatgtgagcacctttcctcaccagcgcagataacaaatgccttacattctgtttttaacaactacttaagtttctgtagaatagagaaactaccatttttataactactgtcctctagatagatgtttagaatgcatacaactttttgctattattaacaatgctgcaactatggccgggcgcggtggctcatgcctgtaatcccagcactttgggaggctgaggcgggcagatcacgaggtcaggagatcgagaccatcctggctaacacggtgaaaccctgtctctactaaaaatacaaaaaattagcccgggcgtggtggcagataccctgtagtcccagctactcgggaggctgaggcaggagaatggcgtgaacccaggaggcggagcttgcagtgagcggagattgagccactgcactccagcttgggcaacagagcaagactct

SEQ ID NO: 16281 - DNA, 594 bp, Homo sapiens
gagttgccaacctaccttcagaactaaattgttttcttgtgctaaggacactgagcactaaactgtataaaggcctttgtctttaaaaagactgtagcttctgaagttaggaaatgcagacactttctaagtagttttcagatatgtaaagcagaacagcttccttaacaaaacattgccatttaacataccagtaatttatcaacctttgttccttacagaactataaaaaactattctaaaattcatactgaaccaaagaagagcccaaatagccaaaacaattctaagcaaacacaacaaagctgcaggcatcacactaccctacttaaaactatactatagggctaccaaaaaccaaaacagcatggtactggtacaaaaatagacacatagaccaattgcagaatagagagcccagaaataaagccctacacctacaaccatctgatctttgataaagtcaacaatacataatggggaaagggctccctattcaataaatggtgctgggataactggctatccaaatgcaaaagaatgaaagtgaaccactacctttcacctcaaattaactcacgattaattaacgac

SEQ ID NO: 16282 - DNA, 521 bp, Homo sapiens
agtaccacagtcttttaaattaccataatgagaatgtgcttattaccatggggatgggaccaagccattcataaggaatccactgccattacccaaacacctcccactaggccctatctccaacattaagggtcacatgttaacatgagacttggaggggcaacatatccaaagcatatcagaattgtatttcccagttccttccagaggcatgggcttctcacacctagagagcatggaagcagtaaaagaaaagctattccatgtccctcactcttcagtggtaggagcttttgcctacaaggcccttccagcatcaaaggcagaggcagtgtaggaagcaaagcatggcccaagtccctcttggggcttttattattctggcctctttttagaggaaaaaaaatgattttttgtgctgcagacaccatgtccaattaggtttgtatactcatttaaaacatcaaaatttaggccaggctctgtggcttacacctgtaatcccagctctttgggagact

SEQ ID NO: 16283 - DNA, 475 bp, Homo sapiens
aagtactgaagatacatctccctgtgaagtgaaatggaatatttgatggctgatatttttaatagcacaatgtaaaggaaagagcttctataagcaggtaggcactttttttttcactaatcctagctctgctgttaccttgttgtaacataattttaaaaaatattatgaagtatcataaatatttaataaccttaaacatgttaataagtgtaatgcttattacaaacaagaggccttattgttattatttattggtagaattaatagactccaggcatgaaataaaaccaaaattatagtcttcctctaaacctcaaatggtaataaaccaagcccttaaagtaattgtttgaggattatgaaccatttatatttctaacatatatactgcttatttaaactgagcccttgctaaagccatatggatttttaaattttttttaagtaaaaataagatgagcagatcatgaag

SEQ ID NO: 16284 - DNA, 532 bp, Homo sapiens
agaaatacatatattgcattacaataaaagtgtttgtatttacaatgtattttgaacaactatatgcccaggctgcaagtttcccaaagaaagatgtaatcgttggtttttttgtttccaaggataaccaggtatagatgtggtagaagctgtgttgtctaagtggcccgtagcctaaaaggtttgaagatactgctctaaacaagcagaacattaatttatttgtcggccctttgagttttcttactaatcctcttctggcctgaccatgtgcccctcccaagtttcgcacattcccaggtatctagtgtgttcagttgtctccctgcgctactcagcagctacctttttcagcattggccctagcttgcttctgtgcccaggaacaggaacagaagttttcttctcaggggtcccctgtctctcttagaccaagtccacaggcttttactacattaggccttggagtacatttcctgtagaatcaaagggccaacttacaaatgaatgtttggaacacaacccattcata

SEQ ID NO: 16285 - DNA, 601 bp, Homo sapiens
attacctatccaatttcaacgtctttcaagtccgctttccccggacaactctgaaatgaaaaggaaatgggtttgatttccatttgctgagcatatttgttttaagatgtttaaccatttaagcctttgtgcatgaacagaagtacatgggcattaacaggcgtgttcactacgcaaacatggtgtgggacaacagagtccatgggtaattatgaagcagaagggacacacttcagtcctgatactttgcaaagcagagcaggtacactgtcacctacgaggggtgagctcacaccccaagtcaggggaattagaaataggaggttttggccaggcgcggtggctcacacctgtaatcccagcactttgggaggccgaggtcggtggatcaccctaggtcaggagttcgagaccagcccgaccaatatggtgaaaccctatctctactaaaaatacaaaaattatcttgggtgtgatgccgggcacctgtagtcccagcttctcaggaggctgagacaggaaaattgcttgaacccaggaggcagaggttgcaatgagctgagattatgccactgccctctagcctgggcacgagagtgag

SEQ ID NO: 16286 - DNA, 567 bp, Homo sapiens
tatttagaagaattaaaatgtaaataatgaaattttaaaaaactactgcaagaaaatctataaatctatatctatagattaaggatatagagactcttcttaacaaagaatggaaaaccagaatccataaatatagatatatttgaagatataaaaagaaaatacatttaagtggaaaagacaccataaacagtcaatagataggcaacacactggggaaaaattattaaaatacgaaggacagaatattactatttttaatacacaaagaacactttaaaatgacaatctggaagtaagtaacggaaacactgacaaagactatgaagaggcaggctgggcgcggtggctcacgcctgtaatcccagcactttgggaggctgaggcgggtggatcacgaggtcaggagatccagaccatcctggctaacacggtgaaaccccgtctctactaaaaatacaaaacattagctgggcatggtggcaggcgcctgtagtcccagctacttgtgaagctgaggcatgagaatgacacgaaccaggggggcagagcttgcagtgagccgag

SEQ ID NO: 16287 - DNA, 573 bp, Homo sapiens
actacctttaaatatcttatgcaatcgtataaccatttcttacttatggaaaaggaaaatacaagatgacaagatatggtcattgtactcactatttttgctattgattctttagataaaattgctattaagtacttgtttccatcatcttatctggcttagtcatttgtgttaaaagggagttcagatgcccatccaatcagtttttcatgatgaaattctgtttgttattccatagttatttttccatcagtggctgtgtttgcaaacgtgggcctggcttctgaaaatggttcaagcttcctaataaatcttctgtggtaatttttacaaactttctcttaaaggtcctgctttttcctctctaaacacttgtctcattctcctgctttttatttaaccatttggctgtattatctaaagtgactacaaaacagctaatatccttactttctacccttgaacagacagaacatacatacggagtgttgagctgtaccatcatctttacgaataatagcatcttataattcctggcataatatggggaaaatatatgctaaagtaagtcat

SEQ ID NO: 16288 - DNA, 600 bp, Homo sapiens
ttgtgaggtaagttgtattactaccccttatttaaatatgggaaaaccgagtactagggagaataagtaaatgacccaaggacacatggctctaagacggctcagctaggattcaagcccagatgacctgggtttaaagtctacccacttaaacactataccatgttgtttggatgaagaaaaatagcatctaatgattgaagctactgtcagcaatgattattgtgtcattgtcattaaaattcttacatgccccagtctgaattcttttttgatccaggtaatttcttttactctctgagactctagtttttgcccaattgtttgcacatttgacatgcaagttttctaacaattctctgtttatcatttgaaaaggaatgatatgacatgttccctctgatgtgcataggttcatttatggagtgtccttctacttggaagaaacatcctttttctgccacactctttagaggtgtgatcaaatggttgacctttctagtaaaatcattcctcagagatactttctgactttccaaaaatcaactaaatatctcaaggtaagacagagtctctgagaaggagagaaattatctaaaa

SEQ ID NO: 16289 - DNA, 575 bp, Homo sapiens
acaacatgcaagaacagatgaatatgtaagcagagagatataaacttgatgaaagcatcagaaaaatgtactagaaatcaaattcactgtaattgaaataaagaatgccttggaggagtttaaccagtaaactggacacagcccaggaaaaaaatcagtgagcctcaagatttatcaataaaaacatcccaaactgaaatggagagaataaaagagtgagggaagaactcacagaactgcaaacatgaacttacaaatatattattcttggagaattaaacataactctaccagtaattgtcagattaagcatgcagaaaatcagtaaagacatagttgaactgaatagcaccattaataaagtaggtctcattgacatttatagaatataccaactaggttataaaacagacattaataaatttaaaaaaaaggaaagcatacgaaatatgctcttagactacagtggaatttattgaaaattaataacaaattatagctgtaaaaacccccaaaatatttggagattagaagtcttaagagaaatttttaaaattttgaatttaatgaaaata

SEQ ID NO: 16290 - DNA, 520 bp, Homo sapiens
atccaagactgccattgggttgtcacacatcatgtcagctggagatgccaaaaatttactggacacaaaattgcccacttcagaactaaaaatatatgccaaggatataataattaacatcctagaaacaattgtgaaggaatttggaaaggtaaagcaaaccaaagctttaccatctgatcaaatcatagcagcaggtaaaatagttaatacagttttgcaagaattatatgttaccaataactgcaatttggcttacccgatgaaatcctcacatctcagactttcacaggggaatataggcacaggatcccttcctaaacaacaagcatgtttttacttggagaatgtttcttcacagctagagcacatttttcctagagaaggtatatttaaaaaattgtttgacaagtggcaaacagaatcaaatgacaaggaaaatgaaaaatgtaagctattgatgatagctgaaaatgttttgactgaaatttcaataaaagcaaaagaattagaatattct

SEQ ID NO: 16291 - DNA, 75 bp, Homo sapiens
aacaaacaaataaacaaaacaaaacaacaacaacaaaataggaacagaccctgtactgattcaactaatacattt

SEQ ID NO: 16292 - DNA, 486 bp, Homo sapiens
ctattgaaaacattaacacttattcaagtaaaataattcaacaaaattgccaggacttgtattaggcatggagacacaaaaataagtagagacatggtgttttgcccttaagaaattagtaagaataagaagtgacaacatttttgaagtaggagacagaagaactataaaatttaggaataaagactgtaacagcttagtgatctatgcttttagtgcagggttgtttaaaagtagatgaaggtgcttctcctttctactatagcattctatgtataggacagattattgatgaccctatttccctgtctttgctattagattgcttagcaccctcatactagtatcagtgctggtatgtaacaggtatttggtaaaacaaacagtaaatgtttactgttctttgcatactgaacgagtattcttattggtatctaggtgcagttgagttatagatttcatcctgagaagcttagttattatcat

SEQ ID NO: 16293 - DNA, 440 bp, Homo sapiens
ttcactcttgttggccaggctggagtatggtggcgcgatctaggctcactgcagcctccgcctcctgggttcaagcgattctcctgcctcagcctcccgagtagctgggattacaggcatctgccaccacgctgggctgtttttttgttgttgttgttgttgttgttgttgttgttttgtatttttagtagagatggagtttcaccatgttggccagggtggtctcaaactcctggcctcaggtaatccacctacctcggcctcccaaagagttgagattacaggtgtgagtcactgcacttggctgaaattagggctatttatcaaacataaatatatctgtctatattaagctatttgagttttatttttaagcttttcaatacatgtagttttccctttatttgaatggtcttataacctacaatgaggtctaactg

SEQ ID NO: 16294 - DNA, 567 bp, Homo sapiens
tagtattacttccaagaataaatgtgcatatttatagggaaaaatcaaaacataatttttcattctgattctaaagctttcacaagaaagacatttatcatatccagttccattaaaatattcacttcttttaatccacttcaatggtgaaaagaaaaagtaaattacatttttcacatttccaaacaccatccatttccatgacacacacaggtatctccttgccaagaaaagtcagtggttgtctgttttggaagggaagtaagaaagtggcattttttatttcctgaagaaaaaaaaattaaataggtcaaatacataaaacttccatgaaaagagccacacttcatttcagccattaaagaaaaatgtgtttaaattccccaaaggaaccctatgctctacactgggaaaggcttattcactgctgactttcaagaaccagacatgacttatcacaccgtgtaaccaaggcactgaatggaactgaaaccccaaggagtcttcttatctttctgctttctagataccaggaaaaaaaagaagcagttgagattattcactctt

SEQ ID NO: 16295 - DNA, 374 bp, Homo sapiens
catggtttttggcctggaatacctcctgtgagatatgcacttcccagttctctacattccccacggttcattctacatttttattgggaacctatggtgtgccagctctgttccaggtgctgggataaagcagtgaacaagagggatgtagttcctgccctcacgcatgcctttggccctaccccgtccacttgtcacgttgacttactgtcttggcccctgaaggcatttgcatcttcccttaagtcagagtgaggaggcccaggcagctggtctgaggagagcgccacagcttcacctggaacacctgaggtctgcttaaagacctggaccatttcagaagggaaccagcttccagctggcagaagtgactg

SEQ ID NO: 16296 - DNA, 541 bp, Homo sapiens
aaggggacatcaatgaagctggaaaccatcattctcagcaaactaacacaagaacagaaaaccaaacactgcatgttctcataactgggagctgaacaatgagaacacatggacacagggaggggaacatcacacaccagggcctgttagggggtagtgggttaggggagggatagcattaggagaaatacctaatgtagatgatgggtggatgggtacagcaaaccatcatggcacatgtacacctatgtaacaaacccgcacgttctgtacatgtaccccagaacttaaagtataataaaaaaagattatatgggaaaagatgcttagaacagtatatacacatagcacacacccacggatgttagttattattatataccagcaataaccaagtgttattatataccagcaataaccaagtgttattatataccagcaataaccaagtgttattatatatcagcaataacaaactgttattatatactagcaataaccaattgcaaccaaaatgtaattaaaaatccaggctgggcgt

SEQ ID NO: 16297 - DNA, 477 bp, Homo sapiens
gttgagactgcaatgagccgagatcatgccattccactctaacccgggtgacagaatgagaacttgtctcaaaaaaataaaaaaataaaaaaaaaatgtatcaaccaaagtcatggagaaccaaaccaagttttgtctacaaccatgattcttacagtttttggtttcaggactctttgcattttgaaaaataactgaacacccagaagcttttgtttatatgaattttatctatcagtatttactatattagaaattcaagtgaggaaaaatttaaatatgtatcaattcatttaacagaacatgagtaaactcattacatgtaaacataaatgtatataccaaaggaagtctacctgatgaactaatcttataatgcaatcaaaacaaaacagctgaccaaaaaacaggctggggcggtggctcatgcctgtaatcccagcactttgggaggccagggcaggcagatcacctgag

SEQ ID NO: 16298 - DNA, 520 bp, Homo sapiens
atggaagtactaggcgataaatgtgctctgagcggattaatgggatttaggaatagcccagcgaactgggaaagggctgagcagctggtgatgagtgaatcacagggaccaggagggtcatggcccagagatagcgagtgccaggactctcgccgtgaggatccctgagggggaaattactgtgttccctcattttcgaaaagagatactttttccttaaaagatgaagggagttaggtattagatgtagacagagatctgactggctaccttttctaaaagaaatcatagtcattcactgaatcaaagccatcacctaagaggagttaaaaagaatcaccagcattttgaaacatgggcattagaaatgccagtttgcctaaaatgtagtgctttaataagtgtggaaggtgaaacagatcacaagcagttcacagtgtaatgttaaaggcattgctaacattagggcatattataggctgtaactttggaagcaggactttgactctggagggagatg

SEQ ID NO: 16299 - DNA, 595 bp, Homo sapiens
agttttcatattccttagtgttatcacactggtgcacttactgttttaccattttcccttccgatttcatttttctgttagcatttactactatctaacatatattttactcatttgtctgtgttccccatcagaatataacttcatgaggggagggattttctattacacttagtgaaaagtaaatccctcaagtaggaacactacaagtatgcacagttttttttttacagtaagtttgcttaatggctagtaaactatctcagccagtacctgagtgactattctgacttgtatcatttaacaagaaaaaaggcctggcgcgctgtctcacgcctgtattcctagcactttgggaggccgagacgggtggatcacttgaggtcaggagttccagaccagcctggccaacatggtgaaaccttgtctctactaaaagtacaacaattagctgggcgtggtggcacatacctatagtcctagttacttgggaggctgaggcaggagaatcgcttgaacctgggaggtggaggttgcaatgagccgagactgcgccagtgcactacagtctgggtgacagagtaagactccatct

SEQ ID NO: 16300 - DNA, 555 bp, Homo sapiens
tacaatagatctgtgctagaaagtcagaccaaacatgagaccaattaagatgaagcatgactttaaacatataatggatgataaatctaaaaacccattttcacaggaaacagtttgatgcagggctggaatggagtcattgtgtccagttttatgtcttggatccatagggggaaagttacgtaatcatattaacctaaatgctagttatttattttacttttcttatttattttacttttctgaatcagcacacaaagcatgaaaagcttaattgtatttacagaaaatataaaaataaaaccatttaaacaagctagagttgacagaatttggacaataggtgggaaaaggccatgtaaagttatcagcggggtcttcgctcataccagcctgaacgcacccgatcttgtcggatacagctgtcagaggctatgggacttaggagtggtacgcagatgtcatttccccgtgatagctcccgaaatagagctgagaagacaggtacagagttataaaggtgacctctaaatgaagtttgctacaggagatgag

SEQ ID NO: 16301 - DNA, 574 bp, Homo sapiens
tagtatacatttagtatacatttatttctctctgctcgtttttgctaaggacataatacaatagaaaatagtaagaaggttacgaaagatggagctataaagttgggtggtctagggactttaggactcaggaacaaacaccacagatgatgacccctccacccatcgtgtcagtgggaggagtggcatcaaatgacccaggacagcattgccctcaccctctggtgtggtggcagtagagactgcagggactgtagtcttacaattacagcccaatgatggcaagttgaatccattctcaccccaagtaggaattggagacagaatctaagaaagtagggagctagagaaaatcacctgaataggggccgggcacagtgcctcatacctgtaatcccaacactttgggaggctgagatgggcagatcaccggaggtcaggagttcgagaccagcctggccaacatggagaaaccccatctctaataaaaatataaaaattagccgggcatggtggcatgtgcctgtaatcctagctactcgggaggctgaggcaagagaatcgcttgaaatgc

SEQ ID NO: 16302 - DNA, 528 bp, Homo sapiens
tcctaccaaaatacctctctgtggatcaatgatttatataaagatgttcattgaaacattgtttataataataaaataatggaaacaacctaaatgcccatgaagagtacactggttaaataaatgtggcacatcatgtatgtagcaacattgaaaggagtctcatatttaacacacagaatggttcatagcaggtaatgggcttacaatagatataaatgaatgaataagccgttaaaagtaacttacgatatggttggttctgttcatccattcgttcattcattcagccagtattctgtggggaaataatggtgagacaacagatccaggcacttcccttaccaaacatatagcctattagaaaagatagtcattaatgccgggcatgctggctgaagcctgtaattccagcactttgggaggtcaaggtgggcagatcacttgagatcaggagttcgagaccagcctggccaacatgatgaaaccctgtctctaaaaatacaaaaattagccgggcatgatgat

SEQ ID NO: 16303 - DNA, 440 bp, Homo sapiens
ccttggccgtgaaagaacaaccatagaaattaactatggatgaagatcttcaagcccacaatttctttgaagccaaatgcaaggtatgattattggcctactgctatcttggctttcttgaccctacttttttttttttcctttcattccccccttctactttgggcttttacagtacctgattaaaaattgtgcttttggggattcgcctgcaaaaaaaaaggctgcaggaaagctcattaccccagcaaacgctctatccctgaacgaattatacaatgaaaagctgcttctgaggcccaccaaaaaaacccaggcctttgtggaaatggccacccctgcagtgcaataaaggctttttatttgttaaaaaggaattttgtactaaaaacatttctctttgtttgttctcgtaaaaaaaggaccctcctgaaggctgc

SEQ ID NO: 16304 - DNA, 408 bp, Homo sapiens
acttatacttgatttgtaaataccatatttttttaaatcagaagatcatacttcccccactcctttttctcgccgtctttttcctctggatgtattttgctggaaacatacactgtattctaaaccctttctactcctagtgtccaaagtatggctgggcatgggcggctttggtatctatcaggggtttattagaaatgcagaccctcaagctccacccttcgtctgctgaaccagactttgcattttaacaagaatcccaggggattccttttgcaccttaggtgtgaggagcactgatctaatgcaatttaattgtcaggtttgaatcatcatttgttacataacccagtggcagagagaagaataaatactgaaaacaggccgggcatggtggctcagatcacg

SEQ ID NO: 16305 - DNA, 141 bp, Homo sapiens
agtgctgggattacaggcgtgggccaccgcacccggcccttgggtggctactttcatagaaaggcagctatgctatattgatatggaacagaggcttatttattaaataaattcactttagcaataataaactcattacat

SEQ ID NO: 16306 - DNA, 433 bp, Homo sapiens
gatatagagcttacgatccctaccctcaagaatagtctagtgcgggaggataataggttatcttatgtgtaccatttagtgtgatgataggatctattacttcaaagtatatattatagactaaaagtttttatatgaactgtgtattgtatgatagtgtggggttcattgtcttagatgtgattgtgagattatggctatataggagaatgtcattagaaaatgcatgctgaagtgtacgaatgcctacaacttactttgagatggcgtgatcaaaagtctcactctattgtccaggctggagtttactgatgcagacttggctcactgcaacctctgcctcccaggctcaagcaattctcctgcctcagcctacacagtagctgggattacagtcaagtgccaccgtctctactaaaaatacaaaaattag

SEQ ID NO: 16307 - DNA, 624 bp, Homo sapiens
cacagcccccacattccagacacacaaaacgatttactcttccccaaatccggcaggttccatgcctccaaactttgcttatgccggtccttcttcctgaaatatcctttcctccttgtctagctagtgaaacccatctaggcctagttcaaatgctgcatcctctaaaaggcctcctgaaccactcctctgcctgtctgcctgtccctcctcccatagcatcaccccatactgaggaataaatcattgtcacttctgtactctcatagaaacttaaatgtcattatactacatatagctctagattacaaatgtctagaggtcatctgtttccccaaacatctggtaaataactatttgtggcatgcaagttgtttataatgttttagtacacaggatcactttcagtgcagcctcatcttctgcctttaactattcccaccccaggttctgatctcctgaagagacctaggttttctaattaagtctttatctgggatcacattaatttgcccagacaccatggccagagcagcccaagccactccttcctgataattaggagcggggtggtactggagctgagactggattccagcttcaaccctcctggacccactggac

SEQ ID NO: 16308 - DNA, 468 bp, Homo sapiens
tccattatataacacacacacacacacacacacacacacacaggcagtgtgatgaagaataccaaatagaaagacacaaaatcaattctggtaagtaaaagtgcacatttcttttgagattcttttctttttgagattagaagaggtgaatgcggggagggataagacattttctacttaagaacgaagaagtactaaacatgggggatttatttaacaagaaaagtcacatgattgagattagacatctctttctcaaggtgctcctgagagataatggctctcatacctatcattcagtgaaggcattggttttgtctggtaacataaaaatgaatctgaggacagacgttaactccttcatctctatctagccatgatgattttaagaataactctagaatatatgtgttcttttacattattggcatttctaaattttttaagtagtagagtctgtacgagtca

SEQ ID NO: 16309 - DNA, 211 bp, Homo sapiens
agtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctact

SEQ ID NO: 16310 - DNA, 611 bp, Homo sapiens
agataaatccatcaatgcttgttactgactatatccttttctcaagctctgccttaatagctgagcaaaagttagctcctctcttcgagagcttgccctactggggagcggtaaccaacagaagaccatcgcgccatcacggcagcttcctgctctgcctctgtctggtgcggtgtcagcaccttgtagatgccccagggattatttgcttcataaatgaatggactgtattcaactacctgaagttttaggtttacatatagtatcgtttgcattatctgggattatttgaatttcaaaacaaatacaagaacaaaagttgaagatagccagccagtttaaaatggaataatgttttaaactttccagctcttaaggataaagtagcttgggccgggcacggtggctcacacctgtaatcccagcactttgggaggccgaggtgggcggatcacgaggatttgtgagatcaggagatcgagaccatcctggctaacatggtgaaaccccatctctactaaaaatacaaaaaattagccgggcgtggtggcgggcgcctgtagtcccagctactcaggaggctgaggcaggagaatggcgtgaacccggga

SEQ ID NO: 16311 - DNA, 517 bp, Homo sapiens
acttatacttgatttgtaaataccatatttttttaaatcagaagatcatacttcccccactcctttttctcgccgtctttttcctctggatgtattttgctggaaacatacactgtattctaaaccctttctactcctagtgtccaaagtatggctgggcatgggcggctttggtatctatcaggggtttattagaaatgcagaccctcaagctccacccttcgtctgctgaaccagactttgcattttaacaagaatcccaggggattccttttgcaccttaggtgtgaggagcactgatctaatgcaatttaattgtcaggtttgaatcatcatttgttacataacccagtggcagagagaagaataaatactgaaaacaggccgggcatggtggctcagatcacgaggtcaggagatcgagaccatcctggctaacacggtgaaaccccgtctctactaaaaatacaaaaattagccgggcgtggtggcgggcgcctgtagtcccagctactcg

SEQ ID NO: 16312 - DNA, 578 bp, Homo sapiens
ttactaaattaaggattattatagcagatacaattctatatcaacatgtccctagagaaacagtggaagtaactatagcagaaaattttaaagcactgtaaattatactgtgccagttatgaagaatttattttcaattgtataatacataaatgatttaacaaaatatatcatttaattgttttaatttttgttatccctaaattattataaaaaatcttccaatcttaataatagaattttgtctttttaaattcaaaatcctattttaagcaatttggaaatctgtaaaagaagcattcactaaatatgctctatgctttctacttgtaaatgcattgcttgtaaaatattgctcattttagttgctgatctctagtgactcacacttgtccttctttgtaggagttcctatgtagtccagatttactgagtgcgaaaagggagcagctacattctgttctcatcaacaagctaacttagtataggtggctaatgttcagactatagcatttcagagtgagggaagatcttcagagaagaggccagctggaaccatttgttgcttatcacacatc

SEQ ID NO: 16313 - DNA, 480 bp, Homo sapiens
aactgctacacaccagattaacatcagctctgtgctcatttgaccttctccactccaggcacataactgtggctgcaaccattacataaaatgtgtatctatcctaataaacaaatgaaagtaatattaattcacacacccctcatttattatgccaaataatggctgagattgatgtctgtggagtcacagtggacgtagtaagcagcttcaattcagagaaccaaaaatcttaggctgctgacatgttcaggaaaataaaattagttctatcttcctgtagtagaaggatgtgagcacaggatatgaggcccagagtagcaaaagctgagtccaacatgacatgcaggagttgcatgggaaatctcccatgccgtaagaaggatttgaaatttattctatgtggagccacagatgtaacagaaactgattggtggtggacagattgatctggtaatagtgtggagaatgatttgggtg

SEQ ID NO: 16314 - DNA, 636 bp, Homo sapiens
gaattatttgcatctcatcactggaagtcccattgaacagcactactctggtttttgcccttgcttcacatagcgtggtgcagaaaatagcaattctgaatcacttattagaactggagtcttagatctcacccagaccaactgaatcggaatctgcgttatatataacaagattgccagggcactcagtgcatgttaggatttgagaagcgccgctgcatagtacacatccaccatgtttagtaacccagtccttcagtgatggacacctaggttcccttcactttgagcgtgccacttatgtatctatacaagactcctcttgaccattcacacaggagtgggaccaaggggcctaaaggcctattcttaatcaatttcaccgaatactggcaagtttttgtctaacaaagaagggttcgaccaggtgcggtggctcacgcctgtaatcccagcactttgggaggccaaggcgggcagatcatgaggtcaggagaccgagaccatcctggctaacacggtgaaaccccgtctctactaaaaatacaaaaaattagccgggtgtggtggtgggtgcctgtagtcccagctactcaggaggctgaggcaggagaattgcttgaacccgggaggctg

SEQ ID NO: 16315 - DNA, 576 bp, Homo sapiens
gtttcttcaaggaaaaacattttatgagtaatgtattatttataccaataaataaatgaaaaatggaataaatacatgtccctgagcccattttctcaaatgtaatttatgtctgcattcaatttgcatggccattatagttcagcaaaaaggggagcataattttcatcaataagttttcatcttcttgtttttttatttgaacaatgaagagtgccatgcattaataaaattaattgtattgaccaatcaaaagatgggaaatgttgatgattgatgaaatgttaataatttcttgtagtaaaatagatgttatattgtgagaatttggtaagcatagccggaatttttttctttttttatttttacaagacgagattttattctgtttcctagactagtgtgtagtggcacgatcatagctcctgcagcctcaaattcaagccatcctcctgcttcagtctcccaaagctctggaattacaggcatgttccaccactccaagcatcaaattttttttaatcacatttctctatcctgcactgccacattttctctctccttaagagcctactt

SEQ ID NO: 16316 - DNA, 603 bp, Homo sapiens
atagtctgtcacttaccattgtttctgcaagccaagggcattttttatgattttacagttacctaatttatagtttataatataggaaagttcatttattctctaactatatgagccttaaatatcttggagatttttcctatgatttgccccagaaattaaaagcaattcagggggaatgaagaatgaaatagagaaataaaggaagtctgaaaattcagaaaataaaagtatagtttgggcaaagcaactctaacaatattatcatgagctatctatctttttcaataacaataataactcatggtaaagctctatttttttctcataaggctactttgaaatgcaaacacaagcggaaatagtattagaaataagcagtaatggattgtacctattttactaaatgctaatgacaaatatgctcacaacgggcagatgtgtgccttaaaaaagtggtcattttctaagattattaaagtttctgaaagccatccttaggctttcataggctataactgcattaaatattaaattttaagatttttcttgactatggaaaaatcgtggccgggcgcagtggctcacgcttgtaatcccagc

SEQ ID NO: 16317 - DNA, 632 bp, Homo sapiens
ctactttttttaccttagtaatgatccagttttcccagggcacagctacatttcctacagttgaatacataaaccttaagtcaacttgtgaatattggtgttagtactcatttcttccaaataatccctaagaatgtccaccattccattagtgtcatgattccaaaatacatgtgagcctggtaattgaagtcatcagtgtggcttcagtgtgcaaagccaattcctgattttttaaaaacagagatgatgtacagaaggcataaagagtaatcttttgaagaggtccttcacatcctttctaagttgtattcctaggtattttattctctttgtagccattgtgaatgggagttcattcatgatttggctctctctctataattggtggataggaatgcttgtgatttttgcacattgattttgtatactcagactttgctgaagttgcttatcagcttaaggagatttgaggctgagacgatggggttttctaaatatacaatcatgtcatctgcaaacagagacaatttatcttcctctctttctatttgaataccgtttattttataaaccactgctcaaggaaataagagaggaggcaaacaaatggaaaaacattccatgctcat

SEQ ID NO: 16318 - DNA, 564 bp, Homo sapiens
ggatgagttcatgtcctttgcggggacatggataaaggtggaaaccatcattctcagcaaactaacacagaacagaaaaccaaacgccacatattctcactcataagtgggagttgaacaatgagaacacatggacacagggaagggaacatcacacaccggggcctgttggggctggggaactaggggagggatagcattaggagaaatacctaacatagataacaggttgatgggtgcagcaaaccaccatggcacatgtatacctatgtaaaagacctgcacgttctggacatgtatccctgaacttaaagtataataaaaaaaaagatatttttagaccatacgttctgggaacttagcattatacttaagagataacctgtacaattagaacattggtatagtacaaggtaatatccaataaaatcccgactgaatatattctagcgatgaattgtctagcaagaggatgacttgttacacatgctcggaaggaaacacttggattattggcaatggctctatgatgaaatcccattccaaataatcttagtatacctg

SEQ ID NO: 16319 - DNA, 270 bp, Homo sapiens
gcatataggaaaataatgtccacatggtaggagacaagatctcaacaaagactgcaactcctagccttttacatatgagtcctatgtgaataaaagaattgaggccgggcacagtggctcacacctgtaatcccagcactttgggaggctgagacaggcagatcacgaggtcctgagtttgagagcagcttggcaacatagtgaaaccccgtctctactaaaaattagctgggcatggtggcgggcgcctgtaatcccaggtacttggga

SEQ ID NO: 16320 - DNA, 618 bp, Homo sapiens
gtatccgtatgatccatatgaaaaacaaaagtaaatcttgaccccttcttcacagcgtaaacaaaaatcaattccagatggactgcaatctgatatgaaagactgttacaatagacttttagaaagaaacactgaacactgtcttcacagggagtgtctggaaaggagctgagggtactttcaaggagctgctgatattcctgattttgatcttactaaacaaattataaaatgatttcaatatatgtacccacgtaagcataaattggtactttaagacataatactgaaaaccttttacaaaaagttttgcagaaagaaagggtcctaatagcaaaggaagttcaggccgggagcagtggctcaagcctgtaatcccagcactttgggaggccaaggcgggtggatcatgaggtcaggagatcaagaccatcctggccaacatggtgaaaccctgtctctactaaaatacaaaaaattagccaggcgtggtagtgggcgcctgtaatcccagctacttgggaggctgaggcaagggaatcgcttgaacctgggaggctgaggttgcagtgagctgagatcgcgccattgcactccagcctggctacagagcaagac

SEQ ID NO: 16321 - DNA, 107 bp, Homo sapiens
ttaataaaatttttcttcaagtatagctggagaaatatttatgctgtaagtcaagataaaactataatgcacttaatagttttgatctttggaaaatattttgaagc

SEQ ID NO: 16322 - DNA, 456 bp, Homo sapiens
gtatattgtcactactttttcttcttttgagaagtgatttggcaagtaatttcaagatcgattttaaaaaaatcatgtttgtaacccaaacattagcttctggagatttatcttaagtaaataaaaagaataaaagttgcattcaagaattaaaaaaaagagacattacaaaaagaggaaaaacctcatttaaaatctccagcctttcagaaaaatccaaattctacttaaatggtagtccccattagttaatattaggcatataacagaattggtacatggtattaaatgctaattaaagaccaaattcaaaaaggaggggaaatgtatatcggaatggaaattagatagtcattgttctttggtacagtagtttcaattaagtgctgaaaccaaaggatattatttaaggtagagtaatggcaattgctttgttttagattccctgtctcctct

SEQ ID NO: 16323 - DNA, 560 bp, Homo sapiens
agaacagacaagaagagataatcttcaataaatgaacaaaactgatagggcacattaaaagttaaaactttgctttattaaatgacaacattgataaggtaaaaatgcaagctacaatgtgggaaaatatacctgcagtacatacatttaacaaagcatgtgtatccataacatataaattattaatgtatacattaataatgagaaaaaaaattcttataaaaaatacatttataatgagaaaatacttattttgtgaataataaaaagactgtcaactcactaaaaacatgagaaaaagactaagtaggcaaatcacaaaatagtaaatctgaatagccaataaatatttttaaaaaggcattcatcataattagaaatgatggtgccaggagtggtggctcacgcctgtaatcccagcactttgagaggccgaggtgggtggatcacttgaagtcaggagttcgagaccagcctggccaaagtcgtgaaaccccatctctactaaaaatacaaaaattacccaggcgtggtggcacacgcctgtagtcctagctaca

SEQ ID NO: 16324 - DNA, 614 bp, Homo sapiens
ggttgaaagtaaggatttaatgtttatttttccaaatggatagacacttgtcaacaatcctttattacacaacccatcttttgcccactgtttggaaatgcatgcttaagtttgtatataaattagtttgtttcttgacttattattttgtttcactaattaatctatttctaagtgtattcatttttgattgctgctgtaacaaattgtcaatagctaagacaacactgggcccggtggctcacacctgtattcccagcactttgggaggctgagacgggcagatcgcttgaggtcaggagtttgaaaccagcctggccaacatggcgaaaccctgtctctactaaaaatacaaaaattagccggtgtagtggcgtgcacctgatatcccagctactcgggaagctgagacaggagaaccgcttgaacacggtagacagagattgcagtgagccgaggtcaccccactgccctccagcttggacgacaaaagtgagactccatctcaaaaaatatttatatagctaagacaatttttgaaaaagaagaataaggtgggaggaattgctctaccatatttcaatacttcttatatagctacaggaatcaagact

SEQ ID NO: 16325 - DNA, 622 bp, Homo sapiens
gaacttcagttaaattcagagagaagctagtaattatttctaagactcaaatgtatagaacagatctctgatattaaggataagaccctcaaaggtgacccaaaatgggtaattgtgggattattttaggaggaatcatcatatattcttactgctataaatacagtcaaatgtcagataaatatactccactgaaatgttttctaggaatgatgttggaaccaatgttggtaattttgaaagtcatggagaggatttcagatgatagaagtcgggcaaatatcccaggtttaacaaataagcaaatgctgagttccaaagctgctgtatcaatgagcctcatattgatcctgagcacaatttcagaaaggtccattaaatgggtctttggagagcacttaggataaaaggctggcagcagagattcactaagaacaatggtgccaagcttgcctctttgacattgttatctgactgataaaggtagtctatagcggtacacaatacagatatttccagggtaaagctgttgagctgctgtaattttccttgcctcttcactatcttctcctatagttgactcccaaggaaaagatagttgacttttaatctagaaatatat

SEQ ID NO: 16326 - DNA, 561 bp, Homo sapiens
ctggctgggccctccacctgcccctcctggaccagcctgtcaccccttcttaaggggtctgcaaggccctttgtgactgatggctccacttcctttcttcccaacactaaccacccccaccccgccacgcagcagtttaccttcctgcttcctaactcctcctataaaccacatgctctcctacccctgggcctttgcacatgcttttccctatacctacagagcccttcacacatgcctcccctgagccttgactgctcgctcctccaaggacttggctgaggcacaacttgggcaggaagcattccaggccccctggctgcagagggcactgcctctgtcctcggagtcccttggactcttctatcccaccaccaacccccctgttgtaactcctgctactgcagtgtagatgcagcttaaatgcatctaaataactcacatctaataacttagcaacatcccccaagcaaggaaaaaccacctctattcatctccgaggaccttctccttgcccctgcccttcccactggaggtcaggctccgcatataaggaggctg

SEQ ID NO: 16327 - DNA, 514 bp, Homo sapiens
aagacttcctctaaagtggaactagcccaacctcggtgtacccacctcgaagtctcttttatatgttgagtttctaattattgatgctagtaccataaaatgaggatacaattatcatggcagccatgagtgaaatttttgtagaacaggatttattaatcatctgttttactgttcaaaaatctattagctaggactttctgccatgtgtataagcctgatttgtggaataagagaagtttggaagagtcactatataggaatcttccttttaagagggcatatgtttctaatacagggattttagctgtattattttggtctatatcgtaagtgtgctttttgtttaagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaaggtaaaagagtga

SEQ ID NO: 16328 - DNA, 604 bp, Homo sapiens
tcctaacctcaggtgatccacccacctcggcctcccaaagtgctgggattataggcatgagccaccacgcccagccaaaaggcatacttcctaactactacatttggtatgtaatagaaaatgaaaacgcacagacacacacaatctcacacagaaacataagggaatcagttaaaatactcagacagtcactctgtacagatcacatagctcacagagcacaataccacagtcctggaatgtttgtcactaatccaagacaagacaaagaacatcacactaccaacagaagtcagcctcttatttcacactgattatggagaagtacaggagtgtcaattacaatgaagaaagtcaacagaaacagatgagacaggacgtcctcaagcaaatgtctttttcatcatagcagcctaacagccttatgcatccaagaatggttaaactactttgcccaaacaataattaagcagccaaccatgctaacccttcactaaaataaattatctatctagtatcagtcactgatacccctactcaggcaacatgttttatccatttcacaaagattccctgtggactaataataaagagagaacctcat

SEQ ID NO: 16329 - DNA, 532 bp, Homo sapiens
gataaatgcttacatgtgcctcagagaatagatgtttttattcccgggaagaaagataaactttttcaaaaaacataaagattaagtaggatgcagtttccagctttggattctgacattcaggacatggggagggtgatgagcttctcctggaggactgaatttaggacacaatcaagttcatgatggaagcccttatgaggtagagagggagtgcatctcagctctttcgattaattaaatgattgtttgaattagagaaggtgtgggtattttgtgttgtttgggtgagtacattggaatggttttctagcattcctttgagattttccacagtataagttaaggtaaaagaacatttttacttgtttcagaaagcatactgaggaagctttaatgttactattaagtaggtagggaaatgaccaatattataaacgcagatttccagcctctccttttaatgctttcagaatgattccacaagaaccttgaaaatgttgagtatttatatttattttatgccctttta

SEQ ID NO: 16330 - DNA, 543 bp, Homo sapiens
agaaaggtataaattacagggaaatccagattacatcaatgaggctttcactgttgttgaaaaacttctcatagaggaaacaaaaaagacccaaataaaaatcacaaaggctctttttggctgtcacacagatgcgtacaaggatttatattcctgcacaatgaaagcattcacttacaaacttgcaataaaagtgccgatcaaaacaaatcctaaaaaacacttttagttttgtttatcacagttgatcaaaggctggctggagtccatggaagtttcacagaaataaattacatcaaatgaattttcccaatgaattctagcattgggcactatgtagtatctattacttctgaccttgatgaccatttcagggaaatactgtctttaactgagctttataattcaacattatccatttaacttaattcttcaggatcatttgaattaatgttagccagtttgtcctaatatctgtaagtaacatttcatgatatgccaagtaacatattgtttagcaaaactagtacagtttgtggactt

SEQ ID NO: 16331 - DNA, 547 bp, Homo sapiens
gtatcactgaaaggagtgatgagcagctaaaatctggtttatcataggtatttcatgcaacaaaatgacaagtatcaactcattttgcaacattgggtaaaacattgcccttctataaagggacaatgttttacatggggcaatgttttacattttcatggtttccaaatgtaaagaaaatatgtaaagatctatagaattgatcagaaatcatagccagtgttccataaaagtatatatgccatgtacaaatagcagtatagtaatggattatatgtatgatatgagaatgttaattaatcataatcaaccctagggcagtcccctccttcttgacagcaacaaaataaatttgaacacagagtgtcaaagaaggcattctaagaaggctaatgacctgaaattatcttctttcttttatatgaaaatcacttatacaatctgcctctgccaagtcaaatgacaatttgagcttaggcaaatgaagtcttgagttctggggaagtaagagctggtattgtattctctacaattgatattctctact

SEQ ID NO: 16332 - DNA, 278 bp, Homo sapiens
cttctcccatcactcttctctaaaactgaatggggaaaggagggactggagtgtgctaccctcaaacccataccttctgattctaaacccagtgaactggcataaaccagacaggagactcactgccaagtcacttctttggagaaagaatatgggcttcactcttgctttcccttatattagctgcgttgcctggagtgtttaacctctcaaagcctcattttcctcacatgcaaaatgcagggcttttttttttttccattggctcttttattttc

SEQ ID NO: 16333 - DNA, 529 bp, Homo sapiens
atataccgaagtgttcatgaaataaagcgtagaagttagtgcacgaatttgttctgggcgtttgttttagtattccagcattttgtttctattgctaactgatgagaaatgctttaaacacataaacatgttctgatgtgtatgtgtgagacttgcgtttcccaacgttgcataaaataagcacaaataagtgtaaaatagtgtaaaataactgcaaatagctttatcttacacagaaagacaggtgaacagctcgtctttaatcttaagcataacatttgttttggtaatcttataaagattgcttcttgcacatttttaaagaaaaaatgtgaaattaaacagattattaacgctatactagtcaatataccatatagtaacttcttgaaggacccttagcacagaactaagaaatgcaaaatcgttcttatttccgtcaagataaattttgacagaaatgtagcatttgaatctactcaaattgtatttccaagtccagtgaacggtagcaatgcacagttttatt

SEQ ID NO: 16334 - DNA, 547 bp, Homo sapiens
actgaccaaagggacaagtccccaggccagctctctacccttctttgttcagagctagagccagagatcaatatgggcttccccagtccctgccccttctaccttacccaaaactaaaaggaagaatcaacactgtgtgtctctctgagaagtctccctcaggagataaaagacccaaagggctgacccctaagctaacagcttacatttaaggaagaaaaacaatctgcctgcacttttcttagaatttagggaaaaaatgagaatttaaaattcaatttcatgtatcagagttctccagaatacagccaagtggaaagaacttagtcccaaatgaaaaagttgagcagaaattcttctctcactcgttttgccggcttggaggtcagactggaggtgtcctgaactagaaccagagcataggttctgacccaagaaggacactgtctacttcccaggcatccctccttggctgggaggagaggggaggatgagtccattggaagctgagaattgtggaagctggggatgggagttttgagatgga

SEQ ID NO: 16335 - DNA, 603 bp, Homo sapiens
tacatataaaatgcctcacaaatcttgggttaagaacttctcctctaaaaagagtaggaagtcgaaattgaaaacaggagcctatttactcaatcatttggcttgaagttgaggcaaatgccttatatataggattgtcgctgaggtctccatcttcccaagcaaaggtgccctctgcactcttcttgccaaccaaaccaaaccaaaccaaacaaaaacaaaaaactcaagaaacaagcacaagcactccaattcttgtgcccacatcacagtacattcaaccttaacaccttagaggtttacttatccttatccttaaatgttttctttcttgtaggccactaaggttgggtatgcttctagtaatgggaatacatggggctgagcctctacttgcctgcctcagagcacatattggaaatttcctagtaccaaaatctgatccctagtttaggaagaagtcaagagaccatgttggaagataaaaataaacgtatataaaccagaacaagattggaggggagaggaggcaactgggagacagaacaacttgtgaagagacaaatacattacagaaattcataaagtgtgaaagtaatacat

SEQ ID NO: 16336 - DNA, 625 bp, Homo sapiens
taattctttgttcttccccaaggaagggtgaggcaaaaactgacgctatttctactatcccaggaaaagagatggccaacctgccttttaggaaagaattaattgacatgcttatcctaagtcagttctatctccatctccttgctaaagacagctggtacaactggtagttaaggcagaggccatgagtgtttgcgaagggctgttgtgatttcttttgggcgggaatgcctccttaatgtggtaggaaagaatgacaaatgagccagctttggggtacatttagaattgctggcatcttgcttttgtaaatgtcaaattgaaacacatcaaaaatttcatatcaactctgttgatcaaattcttcctaaagctgggtgcagtggctcacgcctgtaatcccagcactttgagaggccaaggcgggtgaattgattgagtccaggagttcgaggccagcctgggcaacatgaagagagcctgtctctacaaaaaatacaaaaattagcttgggcacggtggcacgaacctatagtcccagctacttgggaggctgaggtgggagaattccttgagcccgggaggtcaaggctgcagtgaaccacgatcacaccactgtactcca

SEQ ID NO: 16337 - DNA, 360 bp, Homo sapiens
  misc_feature 161: n = A,T,C or G
ctggctcctgggaggtggaggctgcagtgagccgagatcgcaccatgcagccgttccaggaaagtgtctaccaagcccgccttctatgctaatgattcccccaaaatccattctaattctgggaagacacaaaaatatctttgtgtcctgctcttcctcanagagagaagagaaaatagccactcagcaaccaacagccaatgtttagaaaagaggagagctggctccctacatagctggtgaagtcacacccactttctaaacaattccacatcagtgctggatggttcctccacccatgcatgaaactagaagaaacagagttctaacccctgaatgttcctcattaactcacacaat

SEQ ID NO: 16338 - DNA, 629 bp, Homo sapiens
gggggagtttcctgcgagctcggcttcctcaacatggctgcgcccttgtcagtggaggtggagttcgggtgagtcacagagctggggcgccgtggggatggattgaagtcgtcgggcccagaattcctttccttctgccgtggggcctgacacggccgaatcactgggtgtcccagtgcccgctgtgagctacgctacccgcctaggagagtctgagaggccagtctctcttggcagtgaggccgtctgtccggaaatagaggcgcacattgggagggaaatgctctctgtgtaccactcggtgccctgtgctccgccggagtcggaggtcgtgactgttagcaggcagcctctctctcctcttttccattcctatctcggaccaatcccatctgtttggcatctgagctcctagaacctagaaggaccaccctccacccgctgatttcattctttgggcagcagtttctttttacactgttattaaggtcttgtttctcgtgggatgtagtggccagggcgggacttttttctttttctttcctaagacttggggatggtaaacagacctgagcctccttcaggacagtcagtaaacttgctgattgccttctgcagaactggagtca

SEQ ID NO: 16339 - DNA, 320 bp, Homo sapiens
gcataagcaaaagtttcatggcaggagggagaaattagctatggccagagtatagagaataagggaagtatgatttgtgaggaggctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagattatttgatttagggaataaacctgacgggtcctattactaagtgagagagtgaaagatgtccagagtaactcctgag

SEQ ID NO: 16340 - DNA, 572 bp, Homo sapiens
ctccatttacagttaagtaaactgaggccctggaaaatgaggcactttagttttaaaagctgctaaagtctattgctacatcatgcaggtaagtctttttacttatatttgtcatatcactcttaacctttcacaaagctttaaaattaaaataataatgaatatacctagtacttttatgactatgttaacaattcatacctgttcttcctaatattctacctaggtgatgtaatttaaagttaaacagatacagataaactttgctgaccctaaaattcccttcctattgttagatatgagttctaaattttctcttcaaagaatcaatatgtcagtatgtttaattctttgccttctacttttaaacttaacttcctcataaagcaacctttttcaattacctactccaccctgactcattccaattacctgctctgtcataaccatttttcccgccaaaccactcaccccgtcactctctttaaattagccaatcggaattagtttagcccatgcggtctaaccctagccaataggggaacaacacagcagcacgtgcgtcagggata

SEQ ID NO: 16341 - DNA, 549 bp, Homo sapiens
gctcatcctccagagtagctgggattacaggtgcccaccaccatgtccagctaatttttgtatttttagtagagatagaattacactgtgttggccaggcttgtctcgaactttagacttcaagagatctgcctgccttggcctcccaaagtgctgggattacaggcatgagtcactgagcctggccagcctctgtgttttctagtgaaatttgaggattggaatttgcttcatgtttaattaagaaaactcttataatcccattgaaaacataagattatcataatgttgggtaaaggctgataatatagccagataaagaaataaaagggtgaaacagtaatgaggaaatgagccccttggtcttaaattttggaacgtattgagtaattgtttaaagagaaccagattggctgggcgcagtggctcatgcctgtaatccaagcactttgggagaccaaggtgggtggatcacctgaggtcaggagtttgaaatgagtctggccaacatggtgaaacccccgtctctactaaaaatacaaaaattag

SEQ ID NO: 16342 - DNA, 552 bp, Homo sapiens
ccctccctctcccagtagattagttcatcatatgctcatttcttcaaacctaggcattgaaataaccttctgttctctctccttttaatcctttcttcctggtatccattctgcagttttcaatggcacctcaaccaccaggaatgttaagaactgatctacagtacttcccttaacacagacctaattatgtcacttcctccaaccccaaagatgtagtctaatgggggagacaggcatatagatacataaaaatgtgtgtgtacatatatgagtacatattcacatgggcacatgtaaagtattaatactaagggaggataaatcagaagccaattcattttgcctgccataagccaaagaaagtttcacatagctgatgatagctaggtgaaataatgcctagaaaacaaatttaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaa

SEQ ID NO: 16343 - DNA, 532 bp, Homo sapiens
tctgatctgagaactgatctgttgtctacacacaaagccaatttcaaaagagtttcagagtaagcacgtcagagccaagcacaagggtcaagtattaggtgtaaaaaagaattatgaatatttttatagctttgtacatttgctcctaaatgtacacttccagataatttgaaacgatgatgttggcactgctcttaatcaagtttcatgtccagaaagccattttgaactccccagaagggcaggacgtcctgccactgtggttgcagggccacccacaaccttgtccatttctccaacaccataacagcctcaaggatagagttttccacatattattcacccaacacctgctacagtccctggaacataagtggaaatcaatacttgcacactgaataatgcagataagggagactggtaaataataaaaagcagattttgagtctaaaggaatgcattgctcacagtcaagtagcaagaggtaaaggaagctgccattaaacatttctcttctgctatgagacctcat

SEQ ID NO: 16344 - DNA, 436 bp, Homo sapiens
ggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatca

SEQ ID NO: 16345 - DNA, 484 bp, Homo sapiens
gcatgacagtgattgagacaaattcaccccctctggtgggcgacttagagctcctattttcatgggggtagagcaatggctcatacactcagactggactacatcctccaaaagactgcatttccaaagaatcctaaccctggcccagattctgttcttgaggacctctcattggagaaaagtggtgggaaaagagagtcttgaaatgggctagaaatagctcaaaacatctgaagccaaagcaatcctttcaatagagattactgagggccaggcagggtatatgatccttgaaataaaaaacgacaataaaactacagtacctaggagttggtctccttttcataatcaccatacactggcaactaaagaatgttaatgaaaaaattatccgtaaaacaaaaacaacaaaaaactttcattggtgcaagtctaaataatcgtggttactctgttcagtttcaataatacatatatgtaagct

SEQ ID NO: 16346 - DNA, 635 bp, Homo sapiens
ctaggacactatatgaacttttaaatattccttacaaatcagttcgttcttcttcttttgcagagcagaaagatatcgagggtaaattaagacaattacaagaacttacaaaatatcagggtttcacatctattgaaaagccacataaatgtagaatattttctgggtatattggaagggaaatgaaaccaaatcttcttctttgttacagttatttttattacttcttgtcatttagtagttttgtgtatttttgcacaatgtaaggtaattcaaaaatagaatatgaaatgaaagtatatactttccatacaagtctatgtaaaatttctatatattaaagcactgagaaattattaaaacatgtttgcatttaacctgtacttaatattcaactctgtaactgaaagttaagttagtaaaaattttattttcacatataaagcataattgtaaatttttcctcccatgtttctccttttatgatatgtttttcaaaatgagtacttgaggaataaagatatagaccacataggcatttctctctgcttagaagagacacatttaggaaatgagaaagaaatgaaccaaataaggagttttcacaagtgctctgaataaagcataggatgctt

SEQ ID NO: 16347 - DNA, 601 bp, Homo sapiens
tcatcaaactaaacacttaagatcagtgtgttttattatatgttaattagccctcaacttaaaaaaaaagccacacttgttatgggagtccctaaaatctggaagcatagacatatgtatgtcatcaaagatatcttcaatctgatgttataatgtctacaagtcccacacttgacgatgccctagattgagttacattattggagactgaatgtatataatattgtcagtctacagcatgagttcaatctatttcaacaatagggattacctgggccagacagacccaggtgaacagcccctagtacaatgccagtatgacaatgtacataggttttgcactatggttggggggaaattctggtgtttttaaaaactggattggaagagaaagacctaagctgtgttactcatccactcggctcccttgagcaagtttatttccccttcctgggcattagatatccagatgtaagaggagtaaggtgaacaagatgatagctacatcttaaactttatgactctatgttgaatatctccagaaaaactccgggtgactttcattataaatcatataagtgagacatcctataaatgaaca

SEQ ID NO: 16348 - DNA, 546 bp, Homo sapiens
ctgaacgtacatatgaaaaacaattagaaaagaaatggaatgcttcatgaatttgcatgtcatccttgtgcaggggccatgctcattttctctgtattgttccaagtttatcatatatgttgctgaagcaagcatgccagttatctattggtaaaaagttttggaataagttttctagtaatggcagtggtctaacctatgattaatttattttttaaatactaagacccattgcgccccatttagtgataagaaacatgacggtatctcctcagatactttgtttttaaagagcaggctaaagagattattgtattctgttttttctgtaaattgcgacatggtgcattcaaattagaactggaggcaggtatggttactcacacctgtcatccctgcactttggaaggccaaggtgggaggatcccttgagcctaggggttcgagaccagccaggacagtgtaacaagatcccatctacaggcgggacacggtagctcacgcctgtaatcccagcacttttggaggctgaagcaggcagatcac

SEQ ID NO: 16349 - DNA, 399 bp, Homo sapiens
aagttacttctaataatgttttgataaacactcttataaatactgtatatcttttcaaacttgtgtgaatttttgagggtaaaagaccaattcattggcatactgcttattttataattcgggtaacacagtgttatcaacatttacatattctgctatttaattccccaaatattcactcagcagtgaaagcgcagcgttagatgttatggggatttcaaggtggggcaatgcatcctccttacctacaagaggtcactctctgatagggggattaggcatgcacattgactatagtatctttagttttatttatattcccctttgtttcaaacaggatttgggattttttacaaagatgcatatgatatgacaagataaagtatatttagtataaag

SEQ ID NO: 16350 - DNA, 611 bp, Homo sapiens
gattttacacagccacaagagccagttaagaactcacaggtacttttccagccacccagataggagagatcattaaaacagtgcattctgtgctacctgacacctattgggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcaccta

SEQ ID NO: 16351 - DNA, 457 bp, Homo sapiens
cgtcccccaggctggagtgcagcggcgcgatctcggctcactgcaagctccgcctcccaggttcatgccattctcctgcctcagcctccctagtagctgggactacaggcgcccgccagacgcctggctaattttttgtatttttagtagagatggggtttcaccgtgttagcgaggatggtctcgatctcctgacctcgtgatccgcccaccttggcctcccaaagtgctgggattacaggcgtgagccactgtgcccggccaatcctgacaatcttaaatgtggacttaattcttcaggtggtctgttgcgttctatgatcttgttgctttctagttaccattttttatatttattttcatttgcttctcttctctttctgctggtttggaaattagatgttttacttctggtctaaggttaagaaggacatctatttaaagtccaaagttggcc

SEQ ID NO: 16352 - DNA, 600 bp, Homo sapiens
attactggacttgtcaattatacagtcaataccaatcaatgaaaattaatcacttaagataccatggcataaataaaaattctctttttacaaataattatcacaattttaagattattcttccatatgtggaaataaatcctgcagatactgaaataatttggaatattaaagaaactaagatttgctagattaaaattaaggggtaagaaggatgattattactattattaaaagtacattaaattatatgtaaatatactctaacacaacatcccaacactcaaccatgatccctaacatacagaactgactcagtgctttctgagtaaatactagagtatccagtaaataataaaaccttacaataatattctgaaataagtattaggttaaatgagatgctacttttatcttgaacttattttgattcatttgaataaattcttatagaaaaaaacatttgggaactgtttctagaaaactacagagtgaaaatattcagtatttaaagacaagcctactgtttaaaatttttcctggtattatttttattataataactgcaaactattgttctatgtcatgtcaataagcact

SEQ ID NO: 16353 - DNA, 520 bp, Homo sapiens
gtctcctggttggacatcatctggatgttgttcctcaactgagtaggttgtttcaatctctcctgacaccatcttcttggttcctgctttcattcttatttagtctatgatcctgataccggtctcctggtcccatccctcgggttgttctaacaaactagaagcgagaatttcaaatatgtgcaagtaagtctgcaggacatcttcccaccaagtaaaaactagtgtccatctgacttctccattgtttcttgataacaatatctccctcgactatcttttgccattcaatataccattataaatcactgttaatccagaaatcaagtcagacatgaaagatgtgtcattttaaaaagaagcaaatgcatgttatataaaagcgatttggtaaactctaagacatacgtgttccagttgattttaagaaaggcacactagccgggcgcggtggctcacgcctgtcatcccagcactttgggaggccgaggcaggcggatcacgaggtcaggagatcgag

SEQ ID NO: 16354 - DNA, 613 bp, Homo sapiens
atgtgttgcctgcattatgccactttcactcataaactcagtatggtgctagctgatctacagagagaggaaggaatatacatatctctgctaagggaggagctcatacaccctacaatctaaattgattaagagcctggtaatttatatattgcaacattgaaaaagtcagttgcttctgcctccaaccaaagcagtagagaaatagctacaaagcatcaaccttgacatcaaagaagactaacacacttgctgtgggaagtctgtgaaatttgagggcacagacaagactaagggtattgcccttccaaccaaccacagcagttcagatttcctcaatgtagctgctgtttggttgagagaaaacaaagaggatagtaagtgaggcattggagctatcagcattcaaagccttttctacttaaaaatctttcccagttgggcacggtggctcatgcctgtaatcccagtactttgggaggccgaggtgggtggatcacgaggtcaggagattgagaccaccctggctaacatggtgaaaccccgtctctactaaaaatacaaaaaattagctgggcatggtggcgggtgcctgtagtctcagctactcggg

SEQ ID NO: 16355 - DNA, 578 bp, Homo sapiens
gattacaggcgtgagccaccgcgccaggccaaaaatggtgacttgtatctcctttccttctggttcttttctggttctgccacttaaccctgagggaccgtgagcacgttacttagcctctctgcgccttggtttcctcccttaggaaacggggataatggtacctgtcttgtaggctgttgtgaaagttaaaagaggcctaaaggcaaatgctccattactgctaccaccaccgtcatctctcatgtctagtgactgcgcgtccgagtgcagcaacgggattcccttgcgccctccaggggcagctctccagaattgcaggctgccaagcacaactcaggcgtccctgaaggctgaaagtgaccaccgccctgccctgaaataaaaaaaattaatccagctggtttaagtcagaaaagaattgcttgaccacagcagccacatgctgtgctctcccctgggggcttctcaagtggacggctccttcggaagccttcaaactgccatggcactgccacctcctgagacccctggctacttatttattcaatactgaacacccgttctatgccagactc

SEQ ID NO: 16356 - DNA, 649 bp, Homo sapiens
caagatcctgtttctaaaagcaacaacaagaacaacaacaaatacctagaaagtgttagctaaaaatgttaacatggatggtgggctgaatggtattaaagtaaaattttgggcaatactgagcaaaaggcagggggccaagagtaaaagatgaactgggcagcccaaagagacatttaaggaagaaagggcctccatcctgggaagaggtgtcacagttgagcttcacggcccaagtcaatggctattacgtcctatatcatgagtgtactcaatcactagataaaaatgtcagaaaacccaagatggaacagctcaaaggacaaaatgcacctcaaaatattacaataagtatattatatatttttacatatttttactcaaaatatccagaactgtctagacattcatccttttctttcctagccttttaaataatatcaaagaaagactgtctcttctttcttttctcacttcttacctgtcttttgttcttcagatttacagggtgagaagaaagtgggagaagtaaaaacaattcagacaagaatcaaactggcctctaattagtcttaaggtaaaactggtaaaccaaataaagtatgtttagagatctgaaatccaacaccaaaacactataacacatgct

SEQ ID NO: 16357 - DNA, 108 bp, Homo sapiens
tagtagagttcaccctgttttatggattccagtttcccttttacaccctaacagtatgagtatctgcgaccaagtgcagagggggagctttagaatacttttgctact

SEQ ID NO: 16358 - DNA, 342 bp, Homo sapiens
attcttcatatcattcaattttaattccttaattagctcatgctatttacttcataattgtttgctccccactccagacataaaacacatcagagtaggatctttatcttgctcatcactctatcccagagtgctcgataaatatttgttgattgaagtaccatcttctgattcagtcacagagaggtaggccatgagggaaataaggaaaaaagtagaaacaagaaataaagaaaaatcagaaacaatttaagaccctattgtgtgcaaaagggaagtggaaagaagagacaagaaaatacataaaggggttaaaagagaggaaaataattagatagtatt

SEQ ID NO: 16359 - DNA, 292 bp, Homo sapiens
ctggatcaactttggatctgtttctgtcattcgatgttttgtctttttgtttgggtatatctcttgttatgccaaaatttgattaaatatctgacaactataaaaggcttcagatgatatcagttatctctgtccagagaggtcttaccgtgcctgctaatgtggtgatagaggaaggggagggaatagagagagagagagagagagagagagaatgtgagtgactgagagagagagagagagagagagagagagagagagtgtgtgtgtgtgtgtgtgtgtgtgtgtgtgg

SEQ ID NO: 16360 - DNA, 653 bp, Homo sapiens
tacataaatatgaaggataagaagaggccctgcaaaggtgataatacaattctcttttcaatgataagatatttctaagcatgcatctgctaatcatattgatgtgcatttagtgttcttttacctacccctgtcaaagtggctaaagtaatccttcataaggagataattttttcttgtaggtgatttttttccacataatactctaacatttccaattcaatttttctcgaaaaagtttacatgatatgcatatacagttactaaaactttggctgcataaataatttaaatggactttacttcaaagataatatttacttttaaagttgtaaacctttgaatcatcaattaattagaattatcttatatctttctttatgaataaagttttttgtccctacatatttatgatttggaaattttcacctggaaaatttcattttcatttggatgccttgtctttagtataaaattcaatatttcaatttcaatataatttttttattgatttttacctgaaattatgataaaataagaaaaatgaaaaatagagataaactttaaatacaatgttatttgtgcttaataataaaatcaagaaagtaaaatatctaaaataataactatttaaataaacaaagtatcatata

SEQ ID NO: 16361 - DNA, 527 bp, Homo sapiens
aggcagtcacaaaaaaactaacactgtgatttcacttatatgaggcatccaaaattcatagaatttgcaagatgaaaaaggggtggagatttattacaatgtgtgtgcaattaatttgcagacctttttaatcttgcaaaaccaaagccctgttctctttctagattgacacatttagagaaggtaagcttaggtcaggacagcacaactattggcagagaaagcccagttctcatgagcccacttctggcttgtcaatcatggcctgtccttgccctctaggaaacttggacctctcttctgggacccctcttcttgggcccctttcctttttattgttaattatgtgctttgatgcacgaagtgtcccggccccatcactctgcaaggtcactgcatctgaacagatccaggtggaaaaccttgcctgcaagtccctccttgcagctcaggcatggggctcctggtctgcgtggggccccattctctgcttctcggtgttccccagttctgggactctcatgatg

SEQ ID NO: 16362 - DNA, 321 bp, Homo sapiens
tgtccagcccttccccttctgttgtaagagtgcggtaccaggaagatactcttgaccagatttcagattctttccaacccatttttagactcaagctttctttctttctctctctctctctctttccttccttctttctttcttttcctttccttttttgacagtctcgctctgtcacccaagctggagtgcggtggcatgatctcggctcactgcaacctccgcctcctgggttcaagtgattctcctgcctcagtctcccgagttgctgagattacaggcatgcaccaccacgcctggctaatttttgtatttttagta

SEQ ID NO: 16363 - DNA, 559 bp, Homo sapiens
gggcgctggtgcgcgcactcgtgtgctgcctgctgactgcctggcactgccgctccggcctcgggctgcccgtggcgcccgcaggcggcaggaatcctcctccggcgataggacagttttggcatgtgactgacttacacttagaccctacttaccacatcacagatgaccacacagaagtgtgtgcttcatctaaaggtgcaaatgcctccaaccctggcccttttggagatgttctgtgtgattctccatatcaacttattttgtcagcatttgattttattaaaaattctggacaagaagcatctttcatgatatggacaggggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccttggctagatgaagaagctattagtacttt

SEQ ID NO: 16364 - DNA, 184 bp, Homo sapiens
gggaggttcagcaaggtgtctagtccagctcccatggagggtggggaagaagaagaagaacttctaggtcctaaactagaagaggaagaagaagaggaagtagttgaaaaaaaaaaaaaaaaaaaaaaaaaaagggggggcgtttttttcggtaaccccaaattgaaaaaaacccttggggggt

SEQ ID NO: 16365 - DNA, 611 bp, Homo sapiens
actgaatgtagaagaccaacagaaatttaatggcacactaccactaccctttcctatatcattattcccctgggggtcatactgctattaaatcatctatttggtgtatgaattttggatcctaacattgatggagctgtctgaatctcctttgtatttacttgaatcagtgttgcctatctgttgtgcagccaatccaggatcagctccaggtaagccacttccaaaagctgcttggtataaatgatgatgatgaaaattatttattaaagtccagctttcttatcatctagaattttgttctgtagggaggtaaatctattttctcttgaagatacagagctaatttatttgactgaagcacttcatgacagcaatcatggaacacaaaaagaagctatcaatgtgcacacagaagcaagaacacaggccgtgcacacaggacaagcacagcaactgactcaaaagatgagcccttcccccagcagtcagtgggattcttctggtcttcctggaaaggataaagaacttatgagcactgtcactctaaaagggacagaatctaacgcaccttcatacaggccatctgaagcaaaaataatttggataaa

SEQ ID NO: 16366 - DNA, 376 bp, Homo sapiens
atccttcttccagctttgcactttgtgcctaagcataaaacaaacttagaattaacagttatcttacttaaatgaaagtaactgtttggaaaacacacagataccaggaggcttccaggccctgagggtccctgcctttggatactctcttagagaaaaggtatccaggtgctttggaagccaattaggcaagtccaaatcctggctctgccccttctaagcaaagtgaatacagcagttattaccccactacgggtctcagtgtctcagctgcttcatgtgtaaaagagattcagtttttttcatatggatggaatgggctaatacatgtgaaacacaatagcgcctcgcacatggagaggcctacagaggatct

SEQ ID NO: 16367 - DNA, 519 bp, Homo sapiens
tcttgaactctgaactgaacatgaggactcgagaggacttgtgagctatcttccttgggatatatatgggaacaaaggggtatttggcagccataaaaatgggttgcaacagtgatggaattttcaccaaacgttttccatgtactcctagactgcactgtgagtccctgcagggaggttatccattggatgtcatttctcaggctaaggtagaagagtggctgtgagctcccatgcctggccctccctcttggtgtagagtggggaagccatgtcaacatggcctgtgtgcgcaatccatcaaagcccccaggattggctggggcacagcaggcagggcagctgccttggggaattgcccaatctacagtggaatttatgtgaataatgaataaagtgcacatggaggctagagattgtggatttgactgtcactcagccttacctctccaatacacaattctatttttattgtgttagaggctactcttaaaatggaaacatgcacacagttcatac

SEQ ID NO: 16368 - DNA, 613 bp, Homo sapiens
aacttttttataaggttgtggtgagatgcatataaaataattcatgcaaacagtgtctagcactctaaggacctcataaaacattagttatacataaaaataataaatactgtatgctgtgaactattctaactactttctactgactatttcatttcatcttcacaatcagtcagggaggtagatactctcattattattattaatatcactgtattactcatttttacagataaggggactgaggcactgagagtttaaatggcttacctaaagctaaataccttgtaagtggtgaagttgtaattagaatacaggcagcctggctaaaaagtcagaaatattaatcccagcacagatatatggaaagtaagcaacacactccaaaatgaccaatgggtcaaagaagaaatccaaagagaaatcaaaagtatcttgagacaaatgaaaataacaatacaacacaccaaaacttctgggatgcagcaaaagacgttctaagagagaagtttacattgataaatgcctatattaaaaaaaaagatctaaaatgaacaacttaactttatacctcaaggaaataggaaaaaaaaactaagacaaagatagaaaa

SEQ ID NO: 16369 - DNA, 559 bp, Homo sapiens
aagaaacctgggaggaatagaagaggagaaaaacaaacaacttaaccccaacttgctggcctcaaacatgccaggccatcttcagctctatctcccaccctttttgtgcctagagggagccttaggcccactcaccaggcatgccacaggccctcttctctttcccattgatgtagccgcagcccttggcctgttcccagaattcagtccagcacccaccttggagacctctgcctttacctcttagggggtctggcacctgatgtcactccagctcaatgttgctttgttagcatcaccaaggagacattcttctccagccagcccctttacaagcatatgcacatgtgcacatgtgcacacacacatgcacgcatgcacgtgcacagacaacagtgatgttcccaccctgctgtcatgatgcccactcctcaggaaccacacacagcaagagctgggatgaatgagcactaacatagtgactgattttacaaacatcatagcatagcatctgattttacttaatccacaaattatagtacaagatggacctcattcc

SEQ ID NO: 16370 - DNA, 420 bp, Homo sapiens
ttacttaatgaacaacaaagcaattataaaggcattgagtaaattaaccctcatttcattcgttttctttagtttctcaggcaggatcacaactcattctcaacttcttcagtcccttcaataattctgatgactgacaaaatttgggaatttgtgacctaacgtcattacaatattgctccacccacttttttgtgcatgtttccttttataacaaagtacacgagcaccaagttctaagttcttcatacccccacactcaaaacatcttcatatgaaactatgaataaacaataacttcctatgtgtaacaataaatgtcaaggagccaattttttaaaatctatcattttgtttctatgactccttttcaaaaggacagtacttccggtccagtgcagtggctcacgcctgtaatcc

SEQ ID NO: 16371 - DNA, 524 bp, Homo sapiens
ataataaaataacacttgctaatattcaaagtttggtcagattctagtcccagggatttatgtgttttacctcccctcgcatacactatttctatgagggaagcactggtatgactttaactttatatttgaggacactgaggttgaaagagtttatgcaacttttgaaagttctcacttagactaatctaaagctcaggattataatcatgatcccatcgtgattcccttggcttaaattttaaatttaaacaataatacttccatcatcttggtttactcacaaatttcttcttgtgttcaggcttttacttgttcactcactaagtttagcatgattagttattggggcacctctgctcttcacccagcatccattcttgcaggttttcagcagtatccactgctcacgagcaatctaccaggaataattgtcatgtggagagccagaggggcacaaatatgaagaaacacagattctgcccttcgtttctcagagggagacacacgcaaaactcataacg

SEQ ID NO: 16372 - DNA, 306 bp, Homo sapiens
atccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggattt

SEQ ID NO: 16373 - DNA, 362 bp, Homo sapiens
aatctaacgcatttattctttgacaccttttcatggccaattgagaagtggtacccagaaagacagtaatgcaacttagaaatgtatggaaaattgataatgttgagatcttaattgaggtgaaaataaccaaataacgtgtggagggacattaggaccattttgtagtattgacaaaagatacatgacacatagccttccatccaacaactctgctctaggattctagctcacagaaatacaccagggagcaaaggcataagagtaacattgtttattgaattataactgtagaatcatatgaaatgacataaaaagatatgtattgtaatgtggaaaaagtaaaatgcagaacaatatta

SEQ ID NO: 16374 - DNA, 512 bp, Homo sapiens
gatttatcatggcttttctgcaggaatgacacatcatgggatcagtagttgataagggaaaaatcttctttaggagaagaattctacccaataaataagtaaaatgatagaattagaatatcaccatttagcaacctgtaatgaaagtatagatctgagcagttaccatcaatacctgctaaaaaccagcaggtgaaaagttgatgaggaactgcctgataaatcttaatgtcatgaaaaatagaatcacaagttctgtgccttctctgggataccatagaatgtctacaccaccacctatgaagcagtcttgcaaaataaataaataaatgtcatatctcaccaagtctcctctagatctatgaccattttacaggtaatggagagggtggcggaacatattaaaccacatcaaggaggaaaaccaaaactgtacaaccgttttcttaacaaataaaacaaggggagaaattcaaaaacattctatatatttgataattttgagaagtagt

SEQ ID NO: 16375 - DNA, 432 bp, Homo sapiens
attgcaagttcatcaaggtctgttcagttggttgcagcatgctcctaacaaaacttaagtcatagatttcattctatggggcaatcttatctgcaatacacaggataggcaaagacatactgcatttctaactccaatcaattaaacctaagtactggattcagtgtatcactgttgctacaaaattactcaagctctatgttctaacaataagatcagaggtatcataaggtatcacagtttctagagactctgagtttagaagaagaaacctactgaaggaggatttatcaatgaaatcatcttggataaaggcctaatgggatcaagaaaaaattgttaagtgaataaaaaattacagtagccacatgcattgaaaaagacaatgaataggttgggcacggtggctcatgcctataatcctagcatttt

SEQ ID NO: 16376 - DNA, 484 bp, Homo sapiens
tgcatgctgttgataagtccagataggtttgatgggaagcatgactttataaatattttagctgtcacagctaagtcttgttctacttgcttgagattttcttttgtctgataggtatacatagcgtgcactgtgaccaacacactgttgtaggatcttgagatatttttgtgttcttgtttgagcagttactcctgggaaatgagaagctgagatgaaaatggctggaaaaggccataaaagacacgtgaagattatgacaagtagctttaaagagtttgccaaaatttaacttggatgggaatgttaatgtcctacacacgatattatttatggaagaataatgtcaaactataattttttgatgtcattgttatatttaatcagcatgggaggacatgacttgtgatgaaggttttccctggggaaagaaaaaaaatacttccagcataaatatactgaaatgatgcttaattttggaagt

SEQ ID NO: 16377 - DNA, 491 bp, Homo sapiens
ctggctgctttccctggtgacagctcctgtcaaggaagccctcttgatagctctctccttctagagtccagcaactgctcccttcctcacactgtcattactatctgtgtagggaaaaactctctcaaactttgcttttcttctgctttcacaccaccacaacaatcatcaacacagaagacttttgtaacaaagatgtggagattcgtccccacacaccaagcagcagacaccagttgggcatcctccaattcaattccaacactatctacctggagatagggtcagtccccaagactccctttctctcctgcaccaagacaccagtcacaagtctggacttctagaagttctgaccaagtggcttcaagttggggttcccacgacccctgttttgggtttaattaatttgttaaggcagccagaactcagggaaataacttaagttgactggtttattataaaggatattgcaaaggatacagatgaag

SEQ ID NO: 16378 - DNA, 356 bp, Homo sapiens
gcacataggagatacttgtatttggtcactatttatatttattcagtatttataaaatgaaagaatgaatgcctacctgtctggctagatcattgatagaaacaaaattttgacttatggatttaatataattttatttattgggtctatatgaatttaatataattttatttattttaaattttatttaaagctgaataaagatatgtctggttttgctcagacacagcttctgctttcattcagctttgcatacatacacctttattaacaaatatttaaatattatcttagaatatatgttttcttttaagaacagtagagctgagattttaattgagtttttaaatgtaatt

SEQ ID NO: 16379 - DNA, 427 bp, Homo sapiens
gaaaccacctcccccagcaaagctgtgtgggggcggcatcccaggtcctggggccatggggccaagagtgcagctgggtagggtgctttgagttccccatctcccaagagctccccatctcccaagaagttccccatctcccaagagtccccatgtcccaagaagctccctatctcccaagaaggacccaggagtccctctcctaggaggaagggagcacccacaccagtccagccctggccagcgggacggtggccttcagggctagtgagagctgggccgggggtgggcagggagagctgggccccacccagactaggaggacagctcctgctccccagggcagaccccagcaggggtgaccggcaggagcctcggtactcggaccggctgggggctggaacaccctgaggggctgaggatgcac

SEQ ID NO: 16380 - DNA, 441 bp, Homo sapiens
tcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaaccc

SEQ ID NO: 16381 - DNA, 373 bp, Homo sapiens
gcagatttaaaataaggccaagagctttagaattattttctggcttttccttctttgcattagtttgtttcttagtttgttttttaattgagacaaggtcttgctctgtcatccaggctggagtgcagtggtgtgatcatagctcactgcagcctcaaactcctgggctcaagtgatccttccatgttagcctccttagtagctgggactacaggtgtgcatcaccacacccagctaattttgcatcggttttacagcacggagtttaccatcaacatcacactccttggaaacaattatttatatagctttaagtaaactaaagtattatgggtatgacactcttaaatggtgagtgatatccttgtatttc

SEQ ID NO: 16382 - DNA, 593 bp, Homo sapiens
cagaagggtacaactgtaacagctacaatcccttgagcaattcctatatgctgaatgctttaaacacatgaaatagaacggcgtggaatgagggcctgccccctagtttgggttgggtgtgtaccatcattagatctttattgtcatcactatattttattaacaataaaaaataagtggtaaggtgaatttacgaattatacaagcattaaattttggtttataatctaagcaggactttgcaaatcgtgtgttttctcaagttaaaatacaaaagtatgggctaggcatggtggcttatgcctgtaatcccagcactttgggaggccaaggcaggcagattgcttgaggtcaggagttcaagaccagcctggccaacatggtgaaactccgtctctactaaaaatacaaaaattagctaggcattggtggtgcacacctgtaaactcagctactcgagaggctgaggcacgagaatcacttgaacctgggaggcagaggttgcagtgagccgagattgcaccactgcgctccagtgtgggcaacacagcaagattctgtctaaaaaaaaaaaaaaaaaaaaaaaaaaaaag

SEQ ID NO: 16383 - DNA, 557 bp, Homo sapiens
gaggggagtgtaacctgctgagtggccttgagtctcggatggcatagagccagctgaaaactaggggattaaagttcttttgtaagtgccttagatgtcttcctctttttttgtatattcataaggtaagattctctacattttaacattttgatatataacatatattcagaaaagtgaacgtaatcctatacatacagatcaatcaaatatcacaaagcaaacacgtgtgaaactgtcactccagctcatgaaacagaacattgttggtctccagaagcccccgtgtggactcccagtaactactccttccctccttcccgaaggtaaccactaacccgccctgttacatccccctttttcttttatacatttcccaagtgagaattcaaacaatatcaaagctaaaacgaaggattgaccgtgtgtgggtatttctcattagtaatttctctctctgttaaatttattatgaaacaaataaaaaataatagtgtacatgataatataagaggcggctactgcccaccaggttgcttaagaagtaaaacataatt

SEQ ID NO: 16384 - DNA, 542 bp, Homo sapiens
cggcgcgagaagacagacagaagggggttggaggcggaatactgggttttgctgcgaccggtttattgtacttctgtcctcacccattctggacaatctggcgccatagtccttcttgcgaggccaggcctgattatgcgaagcagagaggcaggaccaaaactgtagcgaatccaggaacctgccactgtgtctccgggtgcggtctctgacactgcaggatatcggcaggagagggatggaagatgcctcagtggagatgactgataaatgtaccagggctgaaagaaaagagatggtaaatataaggaaacttaagaatagtgaagactagtcatatttaacattaatttacgaagagttccagtagaagggaatttgggcaatggaaggaaaagaaaatccaagaaataaaaaaaggaaaatttacctgggcaaaataaatttaaaaatccataaaacaatgtaaatattcacatggaaatgaatcactgagtgccaaacaggacaaatacagagaaaactgatatatttttgaagag

SEQ ID NO: 16385 - DNA, 444 bp, Homo sapiens
aactaacctgcccagggtaaccgagttcaagagtggtggaggcaagacgtgaatgcaggtgtgttggtgaaaacacacacttcagggcagtctggcacatctacagccgcatcaggtggagtaagagggctgtgtttataacactctcaaagacagagctggggaaggaggagtcaattgtgctgggtcaagatgtgaaggatggcatcaagggaagcccaaaaggatagagtgagacattgtaggcacaacattgagccacaccctgaaggagaagaaagtttctccaggcacagaaagagtattcctggcagaaggaacaggttgcaaagtagacaggttcagaagaacataaagaaaaagggccttgtgtttgcaaaggtgtgacaaggacttagggtgtaagggagagctgaggagagggacaaaaggcagaggcaggag

SEQ ID NO: 16386 - DNA, 474 bp, Homo sapiens
gtcatttgttttgctttgtttgacttttacatttcaagaatataagaaacagaaagccaaattcctgcacacgaagtgctgcttaaactgtacaaggtactattacatatgttcatcctcccctctccaacctaaaaagaactaagaacgcaggacaaataataatttttaaagtagggggcatctttgacagataagtggtggaacattaaaaataaacttggtcagtctacagttgtatccattctctttagacctgggtcagtccaatttagacaagggtcagtgtcattcaagaattttgctgaggtggcccattcctcattttccttttgcaatcaccttgagtctaagtaaacaaaaactatcaaaccatcctagttgctagcaaaacttagttgctaaaattcctcaagggacacttccaaatctggaattggaggggactttagcctggaaaattagtatgctatc

SEQ ID NO: 16387 - DNA, 501 bp, Homo sapiens
gaccatggctcacagcttcaccctgctctgctgaattgcccttgtctgatgggaaccactttgctggagatacctggatgaaattgcattctaaaagcttaaagcttgtaacttaccatattttttgaaactctactttattctcagccttataatttatcctctattcaaagctatctacagattcaatgcaatccctatcaaaatcccaatgacactttttttttacaaaaatagaaataattttataattcatatcaaagcacaaaagaccccaaatggtaacatgcatttatggccaagtgttcttcaacaaggctgccaagaatgcaaaatggagaaagaatagtctctttaaaaaatggtgctgggaaaactgttataccacacacaaaaatcaacccaaaatggactaaagactcaaacataaagcttgaaatggaaaaactcccgaaagaaaacatgaggagaaaactctttgacattggtcttggcaatgat

SEQ ID NO: 16388 - DNA, 375 bp, Homo sapiens
gacactgctgaaataaagtctgaaaatcatggattgaaagcaatcatacagaactcagaacatttcaaaataaacaaaaaatgtccttagagaaatgaagtctcaaagtaagtgttaaacctcctaaatccactcctggctatgacaaccggggccagaggtgaagctttatgttaatctcaacgaactttttcatggccttcaaaaagtccagaatttaagacctcctgtggtattgttaaatacagaatcatggaccaggtgaaccatgctagaatcttagagccacgatttctagtgcctaacatgggcacagctaaaaaatctcctaacggccggtgcagtggctcatgcctgtaatcccaacactttgag

SEQ ID NO: 16389 - DNA, 478 bp, Homo sapiens
agaacccactctcaagaagaactgtgttccttacttgacaattccagcaaaaatcttttgggaactctgattggtcaactaaagccaaatgccaatttcttgaccaatcactatggtgtaggggatggataattctgtcctaggcacatgcccacctctgatgccagcaggtggaatgacctcatccaaactgcatggactaagaacatgaaaggtgagatactgaaaaggaaatttaggtgccgtgacctaaagaagggatgagggatgccaggcaagcaagaacaacagatgtccctaacagagtcctttttctgtgacagcacactacagcaaaacaaattggcacctctttttacaggtcaacctttacaaccatctgctcaaagaaattaatgttcccatcttggctgacttatttggccataacagcaagttcacataacgttcaaacagagcagtagggagtaggtagcat

SEQ ID NO: 16390 - DNA, 143 bp, Homo sapiens
ctataaaaggaagaggttgagaagggaaagttagaaaagtgcaggaaagaggagctcataaaagtagtgtttcatgctggaagagaacgtataatacatcagtggttatgcaatggaggtccctctggacaggagctggggag

SEQ ID NO: 16391 - DNA, 113 bp, Homo sapiens
tggcggaacatattaaaccacatcaaggaggaaaaccaaaactgtacaaccgttttcttaacaaataaaacaaggggagaaattcaaaaacattctatatatttgataatttt

SEQ ID NO: 16392 - DNA, 442 bp, Homo sapiens
cctctagctgttccccaatctgaaatttgtttttcgttttccttcacttaaaaaaacttgttggccgggctcggtggctcacacctgtcatctcagcactttgaaaggccaatgagggaggactgcttgagcccaggagtttgagaccagcctgggcaacatagagagaccctgtctctactaaaagataaaaataaaacaattaatttcctggtaaaggccctatctccaaagaaggtcacatcctgagattctggttaggacttcagtcttggaattttgggtaacacaattcagctggtgacactgacacagcctggggctgcccagttttcccagaaggggcagcaggaatgggtcaaaaacccatcactcatcaagaaaaaccagttcatgtgttgaggaaccgtcttgtctgctgtccttcagaatgagtgcgcag

SEQ ID NO: 16393 - DNA, 459 bp, Homo sapiens
ataaggtttcgtattaaattctctttcagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttagtaagtctttgctttttatctttttcaaaaatggagaaaacgttaagattcatagataaagaaaaaacattttctttatctgtcttttaaaacctgtatgtgattttcataattgggtgagaaaattgatctttttgctactccgtaaattttcctaaaggaacattgctcacaacttggctgaagtagcttataaactaatgtactacttgttaatcttgaagcaagaacctatattattatacttact

SEQ ID NO: 16394 - DNA, 305 bp, Homo sapiens
taacagtctgaagtctggataaaccagaaaacattcactcatccctcctaataagctcgcttccagcactcacataaacttctaagcatataaactgtgttgtgtggttcactgctgcagacctcaacatttttttttgagacagagtcttgctgtgtctcccaggctggggtgcagtagcacaatcttggctcaccccagcctctgcctctcgggttcaagcaattctcacgcctcagcctcccaagtagctaggattacaggcgcacaacaccacacccagctgatttttgtatatttagtaa

SEQ ID NO: 16395 - DNA, 501 bp, Homo sapiens
cgatcttggctcactgcaacctctgcctcccaggttcaagcgattctcctgcctcaccctcctgagtagctgggattacaggcatctgccaccacacccagctaatttttgtatttttaatagagacagatttcatcatgttggccaggctggtctccaactcctgacctcaagtgatctgcccatctcagcttcccaaagttcaggaattacaagcatgagctactgcaccgggccaatcacattcattattaatcagcaagagtttatttttcatctgtggttacatggtagacacttcctaaagaaattaagatatgatgcttactataaatgttctaattatatacctggggacacaacttcactgatatgaagcaacaaataatacaagatagaatttcaattaggaggcaaaagatatgattgaggcaaccctcatttgttacagctaatgatctgggctagagaatgtgtaagagtaaagtctagaaaatgtct

SEQ ID NO: 16396 - DNA, 505 bp, Homo sapiens
gaaacggtttcaccgtgttagccaggatggtcttgatctcctgacctcgtgatccgcccatctcggcctcccaaagtgctgggattacaggcatgagccactgtgcctggcctgtttttcctctttttgaagacttcgtagacttggaacatacatattaactctgtgattttttaaaagctattattgttcaacttgagtttttgagattcaggcatgctgatacatgtaattaatgtccttaattttcactgctatatgatattccactgaatgcatctgccacattttattcatccattttttggtttttaggcatcttagttgtttatttttccttttttggctttcataaaaaaatgtttctatgaatattttagtttataacatcttttcccagtgacttttggattttcctattcacaacctatttaactgagtttactggtttgaatagagaactttgggaggcaaccaatgtgacttattttagcagacgggatgg

SEQ ID NO: 16397 - DNA, 494 bp, Homo sapiens
gtatttccaaaagtaaaagaacagaataagaaaatggagccaataggccaggcacagtggctcacacctgtaatcccaggactttgggaggccaaggtgggcggatcacgaggtcaggagattgagaccatcctggttaacacggtgaaaccccgtctctactaaaaatacaaaaaattagccaggcgtggtggcaggagcctgtagtcccagctactctggaggctgaggtaggaaaatggtgtgaaactgggaggtagagcttgcagtgagccgaggagccgagatggcgccactgcactccagcatgggcgacagcgtgagactccctctcatggagccaatataaaagatatgtttcaagtaaacatccctgatataacatttgaagagttcaccatgtgccaaagaatattggcccaaaacactgagacatatcctacccagtaaagttactaaaccttgatgtaaaaaaaaaggaatacttggaaagc

SEQ ID NO: 16398 - DNA, 629 bp, Homo sapiens
aagatttgggtgggaacacagagccaaaccatatcatggggtttcagcatgttgcttaggatggtctcgaactcctgggctcaaaagatctgcccacctcagcctctcagtgctaggattacaggcatgcaccatcactctcagccaagttcatacttttgagttcttgctacttgcccagcactatccaggccctatccacatgtcattccactaatgcaagcccacaccaaatcctgccagctccaccttcaaaacacatccagatatctcccacccccagtgattcctttcctgcattgcccctgcagcctaaccaacctccctgctcttccttttctctcctctacagactattcatccagcagccagaataattcttttaaacatccaagtcatcataatttcacttctgttcaaaatccttcaaaactttccagtcactgaaagcaaaaaggccaaaatatttaaaaggccctaaaaactttatctacaggatccaaccctgactacttttataacttcattttctaccactctccaccacaatggtatcccttgaagtttcttaaacgcttgaagcctatctcagggtcctgagtagtagacctggaatatcgctcccccag

SEQ ID NO: 16399 - DNA, 431 bp, Homo sapiens
taaatgcatgtcttcataaactggcccaatcctgtagaatgtacaacaccaagagtgaaccataatgtaaattatggactttgggtgaatatgatgtgtcaatgtaggtccatcaattgtaacaaacgtaccactctagttggggatgttgataatgggagaggctatgcatgttggggacaggaagtatatgggaaatctctgtaccatcctctcaattttactttgtacctaaaactgctctttttttaaaaagtcattaaatatgaaaaaatggaaggtcattcagaatgatgtgcaagtcaaaaagtcccatatagtctctgactagaaactgttgggtccagtaaatgcctacagatggaataccagaatctcactcttctttgtaacatttatatttagtgtgttttgagttcattttatttgag

SEQ ID NO: 16400 - DNA, 426 bp, Homo sapiens
ttcctggtgagttaccttgcattcaggtgttctgactcttttttgtagagatggggtctcgctatgctgcgttggctggtttggaactcctggcctcaagggatccaaccattttagtctcccaaagtgctaggattatagacatgtgccatgatgcctggcccaaagacatctttaatctgaattgcacttcattaactattagacacatttatgtttattatgtaatgctttcttcacatccatactgaagaagatccagtaggtattatatctattttatagatgaagaaaaacaaagcttacatgttacagtctttgtagaacatagactgtagtgggggacacaacttttaagtaaatccacacctggataaatatattattgtaaactttcattcgtgtgagggaggtaaagagcaaggt

SEQ ID NO: 16401 - DNA, 534 bp, Homo sapiens
acccttatttctgtgtgacagatgatatagctaaggcacaaataatttgtttgcccatgttgatagctggtaagcaatggagctgggctttgaatccagacagggttcaagttcagatgaatttgtaagtacaactttgataaataatctctttgattcttttgatgagggattaaaaaaaaaaactttgtgtctgaaataaactcttcatgactctatggactctttacattaaaaaattatttatttatttattttcagaaattgatgtctcactgtgttgcttaggctcatctcaaactctggcctcaagcaatcctcccaccttggcctctcaaagtactgggatataggggttagccagcacacccagcctgtatgggctcttttagctaatattttattcacatagagtgcgtggatcgtcacatgttgagggattagtcacttgccaagcagatcaggcaggtacttgtttctaatttgtatatattctgccccaatacattcatagcttcctcctcagctttaaaa

SEQ ID NO: 16402 - DNA, 569 bp, Homo sapiens
ggaaaataaaaatcttccaggagaggcacagtaacagcagatgcaactcgaaaataaaaatcttccaggagaggcacagtaacagcagatgcaactcatgtccttattccagacttctttgcattttgaagattaaaaagaagaaaactactaaaagctttaagaactatccaccagataattatgatacaagagtataaacacggtcagtttcaatagccatttcctcaagtgcaacttggcagccaaattcttccctccaaggaaatactttatgaatagtagataatgaattgtttagaaaaacagtctctaaggaccccgcgatataagtcagtagtacttaagttctcactctcccgagataagttgactgagaaattccggctttagggaatttccaggctccagagggccaataagaaagatagaaattgatgacatctgtgcaccctgctgtgcagtggaggaataccttaggaaggtaatcgtgaaaggctccctagacttccatttccagcattatgtcagacttcacactctgaaaaccccacctgattgaaacagct

SEQ ID NO: 16403 - DNA, 488 bp, Homo sapiens
gaatattaattgtcagaaaacaaaaatgaaatacagaaatagcttgattatttacagcttggctcagcatttgccacatttgcacatggtctgaccagttaacagactatgattggcttaagcttagctactatgattggctaagactaagccacaagttacaaaatatactcttaatttagattgcagtctgtttacacactatgttaggttaaggatgtaagtacagaggcagctttaacaatctaatttaacaatattatctaatttaacaatattatccagtggcatagaaagaataatgtgactttaggtttttactaaataaataaatgtagaaatatcctaatagaggacacagtggccaaagtatactccaaaaacatacaagtcataataagatttaagtgagattttaatgacaggtttttaaaaaattgtcttaagaataaatcattcaaaccatggtaaaatagttgacaatcggg

SEQ ID NO: 16404 - DNA, 191 bp, Homo sapiens
gtgtctttgtatgtttgtacttgaaggtctttgtcatggcatgcgcttttgtttcctatggaatgttaatgcagtctgtgaatggaacttctgaggaccgaaaggttccatatgccaacacctatagaattcctgctttaaataatttagttgttatatatctctctggcgaatcctggttgtgtgtgtgt

SEQ ID NO: 16405 - DNA, 458 bp, Homo sapiens
ggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgat

SEQ ID NO: 16406 - DNA, 516 bp, Homo sapiens
ctcctggctgttattttccagaagattttgaggtgagctctctatatgagttagaaaatatgcttcccaaatcaccatatccttaacaaagggtggtaaaaacctatctgatgataagactttatggagagaggctccctaaagcaccttcacttacttgtaataattctaaagttgggaaaacaattttgtttttttctttacttttcctaaattttttactttttctaaagctgcttccaattatcatttgccccatacattggtataacaggatttaataccagcctcttttagtatttgacaatttttaaaaactttttattaaagtcttcttctccccatatttaaatagtatgtaaagtaaaaagaaattgcaaggtgcattgagcactaattgtcagaccaattattcaatacacacacacataattatgtaaggaaaacataagctatctcagcaaaattaagcatttttaattattaatgtgatgtaccaaagacgggaatgaaaaa

SEQ ID NO: 16407 - DNA, 515 bp, Homo sapiens
tcactgcagctctatactcagagcacagctattttcaccaagagcactccgacagagtaccagtgagagcctcagagtgatgctggcatcatttaattggattactgtccattgcttcctgaagagatagtgaagtgttatctttatttatttattctttgagacaggatctcactctgttgcctcagctgggctgcaatagcacgatcatggctcactgcagcttcatcctcacacctcagcttccagagcagctgggactacaggcataagccaccatgtctggcttatatttttttaatttttattttttgtagagacagggtcttgctatgttgcccaggctggtcttgaactcttggactcaagtgattctcctgccctggcctcccaaagtgttgggattacaggtatgagccaccatgtctggtgttactcatttttgttgatataggtagtcactttctatctaaaaggacagaatacatcctggagttgggcttttacaaacacac

SEQ ID NO: 16408 - DNA, 359 bp, Homo sapiens
aatctaacgcatttattctttgacaccttttcatggccaattgagaagtggtacccagaaagacagtaatgcaacttagaaatgtatggaaaattgataatgttgagatcttaattgaggtgaaaataaccaaataacgtgtggagggacattaggaccattttgtagtattgacaaaagatacatgacacatagccttccatccaacaactctgctctaggattctagctcacagaaatacaccagggagcaaaggcataagagtaacattgtttattgaattataactgtagaatcatatgaaatgacataaaaagatatgtattgtaatgtggaaaaagtaaaatgcagaacaata

SEQ ID NO: 16409 - DNA, 213 bp, Homo sapiens
cgtggcaatctctggttttaaactggcacctggtctagtcaggtttgtttttagattgattactctggtagctgaatgaactatgattttggggaggataagactggaaagagggacactaattttctggaaccttctaaaggataaccaggataattgaggtggagatacaaaataggtgacaaattcgagaagtatatatgaagtaaaata

SEQ ID NO: 16410 - DNA, 372 bp, Homo sapiens
taagctagaatttgaatgatgaatagaagctacctggttttagggaagggaaatttgtattccattataaggaattccttattcatttaccaatttatttattcatttattcatcacttttagatgtagagattcagcagtgaataaaaagacaaaaatacattcatttttggagcctactttctagctaagggaagatggacaattaagatagcaatgtactatgtgtactatattttaaaaaacaaggcaaagaatgttggagaattaaaattttaaacaatatgtgcaaaaatcttgagtttgaagtactaggggttgagaaaaggtcactgtcgctggcgcttggagacagaagaggagagtaggaga

SEQ ID NO: 16411 - DNA, 345 bp, Homo sapiens
ttgcatcattgatgttaattccaaatgaggctgaatattcatgcggagacaccgacggggttgaccggagctgctcctcccacctcattgaacttgattgccatttctggaaggcttcatctgtcagtgcccctgacccccaggaggagggttgggagggcttcctagaagaagagctgtctaatctgaggcttgcacaaggatctgggagggtttgcaccggctgttgcctctgaacttccctcttgggaggaggttaaaggcaacaaggcacatttcggggatcatcaggagggggatgcccttgagtaaggagttttctgccaggaaagggtacgaagaggc

SEQ ID NO: 16412 - DNA, 571 bp, Homo sapiens
tttgaccaggtggggcacctcagttcacccagccggggaatcagcaagtccatctacgcttcccatggtcgttgtgaggaaccagtaatccgtgctgtcacggctcaactaggcagttgtagtggaccaggaagcaagacccttctttgctctgggcctctgtaaaataggacatccctctgtcctgattcatgcctcttgccacagcataattcctcgtagcacccacttttactttcagagctgccctggtttttggatgacaaaatatacgaataccttcagtaccccagagattgcttatgagaattaaatcaaataactcatctcacttctgctgattcacggggtacctcaggcaagttgctttttccatctcagcttcagttcgcccatctggaaaatggcaataataccaagcatctggcagcctgaggatgaaataaaaatcacagaaccttagagagttcagatcaggcaatcctgaggttcagatcccaattcggcctcttgatggctgtgtggcttgggcaaattgctcaacctctctgtgctttattttattcattta

SEQ ID NO: 16413 - DNA, 612 bp, Homo sapiens
accttaaaattatctagtcccaggttccacccaattcaaggaccctttgttgaagcagtcatccagtctctggccaacgagggcacgcacagctgatttcataaagaagtctacagaaagtctaggtgtatatcattttttcttacgtgcttcaaatagtaacatatctattccctcaccctatgacaaatctcaatacaatgctgatgtcaatctttagtcttctcctctccaggccaaacaatcctagttttctcatggcagtgtcttgatcattcactaccctaagtctcctctgggtgctttctaatttactcctaatgttctttctaaaatgctcacctaaattctgtataatctggacaacacatggtacagtagaactattttttgcccatgctcttactgctgtatattactcttactgctggatattaccataaaacctaacattgtattaggcttcaattagagttcacatcagagtgttgcttcatatatttaaaagcacagattttatagcaattaattaaatgaacataatttaaaagagttgctgttaactataaacttagaaaagtctatacataaaaatctttatgaagaaattca

SEQ ID NO: 16414 - DNA, 160 bp, Homo sapiens
gtttgaggctcaaagctcagggaagaccatcactagctcccagttcaccactaggctcagagaatgaggtacttgttatacctggccaggttaattgctccagaaactgctctgttacaaatgcttacaatatcttactgaagttcaaaagggaggtgga

SEQ ID NO: 16415 - DNA, 273 bp, Homo sapiens
gcatttctgtgcagaaaagagaggctaaatgctttgttaaagtttgggagtgaaatgaggggcaagaaggacaatagtgttgtgatttaattgtcagtggttttaataattttaataatctgaagtgctaaagaggctgtcaaataatgcattaaacctcagtagagaacagacacagaatgctgctctataaagatgtgagactcctctaacagggcagaattcttctcctaaggagctgggagggttgaggcagatttttttgtgtttttg

SEQ ID NO: 16416 - DNA, 484 bp, Homo sapiens
gcacactttgtcatccagacataaccatcgttatcaaccggtgaacgtcagtcttacagaggttactcttaaaatttgcttcttctctcctctgctttcccaaattggcaaatattaccagaattgattcaattgcttgggccaaaacctgggactcatccacaatctttctctttatctcactccctgcatcagccacttatactgactctgcttggaaatacattggaatcttaccttgactactgtcattatggtccaggttatcatctatttcttgcttagattagccttctgaatattctctccacttccatttttgcctcatcagttgtattctctacacagtagccagagtgttttaaaaaacataatcccctttcccatcaaaattatttcagtgacttcccaccatatttagaattaaaaattcttggccaggtgcagtggctcacacctgtaatcccagtactttgggaagctg

SEQ ID NO: 16417 - DNA, 459 bp, Homo sapiens
aaatcttgtccctgccacatgatggtcgtgtgacattagggaagtcccttaacttctttgtgtctctgtatatccttatctgtaaaatggagatgataattgtctctagttctctctagagattaaatgagttcatatatgaaaatgcttagaataaacctgcatataataaatgctatacaaatgttagccactattattgttgctgttgctgttaacttgttttagcaaatgaagcatctctcttacaatgcaaagccggcctctttcccagttcatcctcctacttacctacaaaatgagggatggagatgaacatgaacatgaactctaaggatttttttgttaggcttgcctttctgggttctactctaagccacattcagctcaccccaactctaaggctgcaaagctgattcggcatttagtagaccattttcctgctcatggtccatggag

SEQ ID NO: 16418 - DNA, 637 bp, Homo sapiens
tatttacatatcaattgagtggccactctgaatatgaagaaatatgagagaggaagtggctggcactgaatatttcatggccatgagccccacaggaagcgaatgtccccagcccagagttaggtctggccatgtgtgtaagagagaactggcattaatagtccaggagacgaggcaagaataatcccccaagccaggaggggagccactaactggaattgatgagccccctatcatctggacacagcctgctggtgctttttcaagtcagcaaaatatctgcttcctgcctgtaccttctggttcccagaaacttctgcagagaagggagtttgttcaagccatcacacgctgactttccaagtcatgtggatggaacagaagttagtatgcagtggaaaacagcatagtccatcgagaaagggccccatcctttctgagaatttgctggaagatgaatcaggaatcccagcccagccccttctcccttcaaagggactgacaggagtcattcacttaataattattttcccactggatgaggtggctcatgcctgtaatcccagcattttggaaggctgaggcagaggatcctagcattttgggaggcttggagccaggagttcaagcccattct

SEQ ID NO: 16419 - DNA, 503 bp, Homo sapiens
atgactctgtatctaattattttataacatcaatatatccatgatatagtatcacataagacactgatacattggctattatatttgtaagccgaacttttaattttaaacagggcttgtactttgattatttatcaaagtatcaaattccacaaataaaatattcttttactttgaaatctctgtcttcactttatggctttttattatgaaactttatcttggtattactgatgtaccttgacttcattatactaaacaacactcatattagtacttcagtactggcaatacagctaagccttaaactgagccaaatatctgttaaagtgaattgctttttatgctgaaatcaatttattgaataaaagtcccttgccacaatggaataaagaatataattccacgtttgaaggaacccctaaaactacaattttcaaatttttaaaaagtataatccagccgggcgtggtggctcacacctgtaatcccagcactttgga

SEQ ID NO: 16420 - DNA, 638 bp, Homo sapiens
gcattaaatcagtccctttttgtcaaattacatttttgcatgactgtctacgctttgtcgcatctaagaattaaaatggacagtttttccttgagtctttgcatcttcaatttgaagcctctcatgtcttgcaaaactttgattaaatattttatgcttttctcctattaatctgtctttgttttctttcagacctagccaggaaccctaaaagggttatggaaacttttctttccttacagtttgcacaactacaactaaacctggaacaaattatcctttaatccgttattaggacacaccaatatataggtgctttcctttgcctagacacagaggcagttataacagaggtccttgtgaggccacaatttagcaaaatactatgtcaaacatttatagcttatatgaaaatttcacatccccatattggccacctaaagatgaaaacatataactccctaaatcttaattggccctattctaatgtaaaacataaaaaccatataggaaaaaacagaaattcaaatagaagtaacctatacctttttaaaaaaattatattcaggacatatggatgacaaatggtccactgtgttttagaatgaagtagacaaatttgagaagtcagttaattt

SEQ ID NO: 16421 - DNA, 593 bp, Homo sapiens
tgccctgaaggagaaattaatttttattgtaaacagaaatacttaaaaacatagttaaatgtttaaacatcagtttaaagaacagattaaaggaagtgatagttaaaccaaaacattatatagtccagcaaagtaatgtgaaaagagaaaatatcctcccaccattctaagcacattaagagtttttcaaagaatttcgttcactttcatttcaagaaccaaatatgaatgttgccaatatctcacttcacttccttgcagcctaaccacggatagcatcaagaaagcattgcttccagctcatcattctccctcccttagatacattaagacaattttgatacatcaacaaccagagacaatgtaaaataatgtcagagttaaaaatcacaaggctttgggaggccaaggcgggcggatcacgaggtcaggagatcgagaccatcctggctaacaccgtgaaaccccgtctctactaaaaaatatatacaaaaaattagccgggcgtggtggcgggttcctgtagtcccagctactggggaggctgaggcagaagaatggcatgaacccaggagacgaagcttgcagtgagc

SEQ ID NO: 16422 - DNA, 619 bp, Homo sapiens
atttacaataagtttacaatttacaataaagctttaaaagaacaacaaaaaattaaatatacctctattgcttgtacgtttttctacttttgatagaaacatggacatattaaatatttcacttttaactctagtataagaaagtcaataatgcaagagtgatgataaagagcaactctcacttggcatcatgatcagggagcaatagggagtgggtgactgcggtgacctaaagcatacaagccttgtctaaagtgaacagctgctctcagccctagctcataagtgccacagagtctacaggcctagacctgctgatccccagcatttgcaagagactcttggtaaccaggattttaaagtaacatttcctggttaagggtagcggccgggcgtggtggctcacacctataatctcagcactttgggaggccgaagtgggcagataacttgaggtcaagagtttgagatcagcctggccaacatggtgaaaccctgtctctactaaaaatacaaaaattagccaggcattggtggtgcacacctgtattcccagctgcttgggaggctgacgcatgagaatcgcttgagccctggaggtggaggttgtggtgagccg

SEQ ID NO: 16423 - DNA, 612 bp, Homo sapiens
aagaaagagcattaaactagaaacgaaaaggctgaacaccattcctggtttaggtggacacacaagtggcctcaggcaaatcactggacttcttcgggccttagcttaccttgctgactgcatcttggctaaaactaaatgggaattattctaacaacccttcaagttgatgctattattaacccaattttacaaagtactttctccaaagtcacaaacaagaagtggagccaggtatgcagatctgacctctgggctcggttctcaatccttcgagttaccatctccaagtcccctgtggttctggttgtgaccatctctgcattcattcaaataggaaggggctgggactgccagcatctgcgggcatctaattagtacccaagtgtcacaggagaccctgctaaatggtatgagagagctgcatcctcctcagttgcctagagtaacagtacaaaatcctaaagccttttccatagctatccccaaattacgtctgggtcctgttctgataaggtgtttgggaataaagcagcagcacagtgacctttaacatagacccatttcgggccaggtgcggtggctcacgcctgtaatcccagcactttggga

SEQ ID NO: 16424 - DNA, 581 bp, Homo sapiens
atatttgacaaatttgaatgttgttggaatggatctgacaggtaattaagtcaaacctctcaaatatgaattttattaaagaaaagaaacaactatttcattccaggtcctaacttcgtctctagggattccttgaaataaatttagtaattttagatatagcacagcagtactggtagataaaaaattaaagcattgtatttcactagtaaatattttttcttttatgaaccagatcacatttctgacatgctaaccattaaaacggtgaagcttcagcttggttgttattcttccattaaactgtttcagaaacattcaggcggcagataactcatttggattgttagaaacaccaggttttccagatgctacattaacacctcatagaagtggtctttcatatgtatgttatgtatgatgttaaccataatatatatggttaaaattttagtagtagttatcctttgctttttataatttccagttttgccgtagtgtaattcctttttcgtattcatttttagtaaaatgttacccattatttaaagataaaataagtcttactttgagtcttttag

SEQ ID NO: 16425 - DNA, 531 bp, Homo sapiens
agtacctttatgtgtatctggtaagaatgctgcctctaccttttcttcctatttgtactatgtgaatgtggtgcatgaatgtgtggaatgtgtggaatgtgtagtattgggatgccagtatctttcagcgtgtttgggtatatgtccactgtgcataatatttgagatgtaaaaccattttgtgcggtatatgtgttattagttgtaagtcggtgaaatgtacatctgaattctgtgtgcatattgttggtactgatgctattttcgtgcatatgtctagtgtatatgttttaaggcaaactttctttgtgtgttgggtgtgtatgtgacacgaatggggacagcatctgtttttctgagcatggattgatgtgtggtgtctgtatgtatcttggaatggaggagggagattgaagaagtctggctgtgagcagcagaaataatttccaaagttgagtgacatgactctaagatgcccagtttctcggcctggggtcagcctgggtgatagctcagtctgtcagaatgaaa

SEQ ID NO: 16426 - DNA, 630 bp, Homo sapiens
ttcttcactgcagttttcccaagtgtatcctccttcccagttcccaggccagtcccagcacagcggtgagggtcagaatccccaccttgacccaaatcccttaaaaagggctggccacatccccaggaggccagttctcaggaatacaggcggcagctctgcttgctcttgaccttggagaactcggccatgctgtagaaatctttctacttggccctggccaccttcctctctgctgttcgtgggctcatgggagaggggccatttgtcaggtggattttagtgcacctctggggctgctgtcccagtgcccactgctttttatttgcctccgaaggctggtgctggcaggggcaggagtaggctttgcactccattttttcccaataaagagtccctcgagtcctctttcagctcaactgagagtgggtcgatggagccacttcctaaagaatcctgaggggcacggagcaggggacacagcacctgccaaatatgagagaaggcggtggggcctgcccttgtggctcattcctagaggccccaccccagtcggcccaggaacgcaccctctacccggtgactctgaccctccatccctccttcactgtttcctgcataccacgctat

SEQ ID NO: 16427 - DNA, 390 bp, Homo sapiens
agatccattaaatctctagtcatatgcatgaaattattagaggtatatgtatactgaaaaaatgaatttagtgctgaattttcatttgcctttcctatatatagtcctctgtattaatgtcagcaatcagattaaaactgaaaatttgacttcctctgcttcctctaataaaatctcatttttaattccttattagagaattatttcagcaatgaaggataatcatattttaaataaaaaactgtctcttatcagaaagccttattgctttaaatcattcttaaagatgtatttgaatgccttgttcaccagcgagaataggtactacaaggaaattcagaagaccaacaagtgggtcgggcacagtggctcacatctgtaatcccaaca

SEQ ID NO: 16428 - DNA, 595 bp, Homo sapiens
ttccagaaatttcctgtaaaacattttttcaaagatctttggaatcctggcatatccacataatgaccgttacttttctttaaagcttattagataactaaatatgtataatcaaaacatgatggctttagcctttttccattatgaaggctggtctattaatcctaaaatggaccaatagctaaagtgtcatagtcatctcccaataaaaaaaacctgtactttaataactgtttaagtaccccaaaatataaatgactaccacatattagcccatgtcccctttaaaatataaataaaaaatgggaaggtaatttctggttcaattttcagaccttaactgtacatactcctttccagtgttagtttgccatcttgtggcctcttaatcctgtgcaattcagtaactgagcaacatgtatgttaagttagcctatgaaactgacaagctttatacactcatcacacacctccacttttaaacttacttcatatggagccatgtaagttactgtacttccaatttcactccagacccaactccagctacaagtgaagcaaatcacctaaaaaaaatattctgagaaaagtgctc

SEQ ID NO: 16429 - DNA, 623 bp, Homo sapiens
agttgttcgaatctaaatgtaccatttaagtcatgggtgatccctagaaacccattttcactgggtgcttctcaagactatttgggaaaagaacaggacagtgactcaaaaccagagactgtattcccaagcgccccatgcctcctgtcaaacagaaatgaaaccaaactagccacagccaactgggggggctcttccctgcctcagtttccttgcctgttgaaggcacacacaaacatgtatgtggtgtggaacaaaatgaaataggaagctgtggtgaaaattaaaagagctatgcagatgtaaaatgcagccactgtgagtattcgaggtaaggaattatacctacaaaagacgctcacggccgggcacagtggatctcacctgtaatcccagcactttgggaggccgaggcaggtggatcaccagaggtcaagagttcaagaccagcctgaccaatatagtgaaaccccgtctctactaaaactacaaaaattagctgggcgtggtggtacgtgcctgtaataccagctactcgggaggctaagacaggagaatcacttgaacccaggaggtggaggttgcagtgagcagagatcatgccactatactccagcctgggt

SEQ ID NO: 16430 - DNA, 491 bp, Homo sapiens
ccattggttgaacgttaaaagtcgtcccagtaacattacatctcactggaggtgacttatctggaagcctgtgtaatctgcagcacagcagagccaagaactcaacagaagagcagtcaagatggaagttataagatctatatgataatattgacatgcttcatacataggggaatccctgagatcatcacttagaacatattcatcctcattttaaaaataattctagcaagctcagcatattagaaccacccccttagaagatacaaggaatgttatcaacttctgcaaagactatgtttggtggggttgctattagacatacaaatgacagtttgtataggaaagggaagagaaaaacacctaaaatgcaaacttacatcaaacatcacaaaggcctgataacatttagtgtagtgacaaatactcatttttcaggtcattcaacccacattactgagaacctagtcccttcccttgtgaagtttact

SEQ ID NO: 16431 - DNA, 604 bp, Homo sapiens
cagaggatatatgggaggagcttgggagatgtgagatttgatcatgctgtgaaattcgagaggaggagatgactgacacacacagtgaggaatcaacgctagataagcatggggggtgggtggggagatgcttttgccgtgcactgtgaggaggcacagtgacatttcaatctaaggagagatgtgaggggtaaagagaggcctgttattagacttcattaaacagggatggtggaggctaagacatctctagaatcaaccgctggcagggagcatttctacttgtagtagaaatgttaagtggaatagttagcttctctctcattgcactccctctctctattaaaaatggagacaggccaggcgtggtagctcatgcctgtaatcccagcactttgggaggctaaggcgggcggaccctgaggtcaggagatcgagactatcctggctaacacggtgaaaccccgtctctactaaaaatacaaaaacaaacaaacaaacaaaaaactagctgggcatggtggtgggcacctgtagtcccagctactcgggaggctgaggcaggagaatggcgtgaacccgggaggcggagcttgcagtgagc

SEQ ID NO: 16432 - DNA, 431 bp, Homo sapiens
gcaatgcacaggatgttagagatacaagaatgagtaggatccaaagcctggtctccaagaggccaagagcatcagaagattgtaaggaacacaatgttggagaaagtcaaacccaagcccactaaagacacaatcacattcctagtccccttggtggctgtctttatgggaaagtcagtttaaggcacggaatcttaggccattgggtcgagaggttgggctctggagttgggcaatcctaggttcaaatcctggcccctgtatttatcatttggatctgttcagggaaattctctcatctctttgaatcatggctcctcttctaacagtacctaccttgctgagttgctggggataaaatgagatcatcaaatgtaaagaacttggcacagcacctggcatctcctaagctctcatttaatgctaacacc

SEQ ID NO: 16433 - DNA, 598 bp, Homo sapiens
agtggtagtacaaagaatggtaggataacaagaaattagacttttgcaagtctctgatattttacatgaagtggtgcattttaaactaagtagactgtagaaaaacgtgcagtagtccagacacaggggctcacacctgtaatcccagcactttgaaaggccacgacaggtagatttgaggccaggagttcaagatcagcctgtccaacatggcaaaaccccatatctactaaaaatacaaaagttagccgggcatggtggcacttactgtaatcccagctacttgggagactgaggcacaagaattgcttgaacccggcaggcagagcttgcagtgagccaagaacacaccactgcactccagcctgggtgacagagcgagactctgtctcaaaaaaaaaaagaaaaatgtgcagtatatattatagttacaaaagcaacaacttaaaaaataatacaagcaagtacagttcaaaagtcagtagagaagttaatatactaaaattgaacactaagaaaaattcaagcaatgcaaaagaggaaaagaacggaggagcaggaattttaaaagaaatggaacagatacaggccgggcatg

SEQ ID NO: 16434 - DNA, 591 bp, Homo sapiens
ttatatatgaaggatttcaaagagatgtcaattttggaaaatgcttctggccatcccaaatgcttggcttatatctactgttttttaacttgttttttttcctcattcattccaactcttattactaaaatactacatcaaaagaaattaagggaatctacaaatatatttgaataagtgattttgccatgtatactgaccagagtcacacttgctcttgctccaaaaacaaatcattgcactgcctgagaggaaaatggattgatggccaagaaagtctgattgttacttctctatacctcatgatttcctttctttttactgcagttctgaaatttggatggccaggtcattcagccctgatcagtcccagagcaaaacttacagtccctaagctcacaagaatgtaatgtgtatcaaaaggtaaatatagacctatgaaatgagatgattgctacagatgctgctaatattaatttcggccattctgtgcatttttttttctgtaaagaagtctattttggggccaggcgtggtggctcacccctgtaatcccagcagtttggcaggccgaggctggcagattacttg

SEQ ID NO: 16435 - DNA, 89 bp, Homo sapiens
taatatttctgacttgagtgttattactctagcacactactcaagtgttttttaataaaaaaactactataccatttaaacttatcaac

SEQ ID NO: 16436 - DNA, 553 bp, Homo sapiens
ctaccctcaccctacactggccctgccctaccctgaccttgccctggcctggccctgcctttggcctgccctggctctggttctgccctggcgttgcccttgccctggaccctccctggccatgtttttttccatggtccttctctggccttgcccttgccctgtcccctttctggtcctgccatgtttctggccctgccctgtccatgtcctggacctgactctggccctggacctccctgtccctgccctgccatactctggcccattcttgctctacactgaccctgccctgccttggccctgtgctaccctagccctgccctggccttctgctgaccctgatcctgccatggccctggccctgccatgtccctgccctggccctggttctgccctacttctggccctggccttggtcctctcatgtccctggctatgaccctgcccctggtttttctctgtccatgaccttgccctggctctgtcctatccctggccctgtctcagttctgtcctagccctggcctttcacagtactttatgcttagta

SEQ ID NO: 16437 - DNA, 591 bp, Homo sapiens
ttctataagatcactgtggcaaattttgcttctatacttcacagttaaaatttgctatctggctactacagacagcagccagtgaatctcactcagctttatcaaactattgcttggcaattcctcatgtaggggattgtatttaaaattttctttgccttatgaactgacaagttgattggccttcaggcctgggatcttgggtcaggccattggtaaagttcagtggctaagaaagaggtcactgattactatttataatttgttttctgataattttagcatgcacatgaactcagaggccatgggttgcagtttataaattaaaacaaatgaataaaaatatgtacaactaattctggccattttcaaagcactaagatatttgttatattcatttaaattagtatgacattatgcttaactttaaggcagaggtggacaataacaaaatatcatcttgtctgtttcttctgaattttcagatgagtatttataaaaataacactgatgaaaaattacaaaagtcataacaaaatattaaagggggactatattcatttaaacccaattagtaattctttattgcta

SEQ ID NO: 16438 - DNA, 535 bp, Homo sapiens
aagatatgccagggtataaatcactctggtttcctaccaagaaggcctataaaagctgtaagtctgagaatgtaccagctgcacccagacttgccctaggcacaaatggtggaaactatcttgattggtttcctcacctcctcatcatcttctcttgatacttttaggacctggccgtcctttgttcccctaggcttacgctgccacctctactgacattgctaataccccagatctactaggacatatctctttccctttcaaggtaacaggttgttcatctaataaattaatctccactaatgggaagatattaaggagagtcctgatttctgttaatatttaaaattgactctcagggaaaatgcacgtgtttctgttagacaatcatggtgagtaacttgtggggtggtcatgtcagtccaacgtgtatatttttctgatagttttttttcttaacagcatggcaccacctgatctctgtcattgaggagagtgcatacttgaagtaggacagttagaaatgaactaactc

SEQ ID NO: 16439 - DNA, 533 bp, Homo sapiens
  misc_feature 432: n = A,T,C or G
actttccctgaatcattgatactttccatgatggagggtgcagcctgggatagtgctggtggggccaggaagctgatggaagctggctgatgcatgggcttgagctggagcctgccttgatgggtggtggacacccctgaccactggcggtgaggagctctgccatggtgctcatgctaaagtggcatcgactcccttcctgtggcggggctccctgccatgtgccagctctgtgctggccacatgacatgctatctaatttaatcttcccagtggccctgttttacagatgaggaaactgctgatgctcagagaagttaactgtcttgcccaaagtcacagaattagtacctggtagatccaggattttaccctagaccagtcttacttcacaggctgtgccgtttctcctaccctctgtcacctctactnggtgggtgcctgaatgtgcctggctaagcctgggcccctagcattgcctgtctggctccacacccccaccaagctgtgtcttccctctccctgcttggggc

SEQ ID NO: 16440 - DNA, 510 bp, Homo sapiens
cagaagggcactctgaaatgcagattctgaaatgagttggtgcagtaagggatgagcaaaccatgttcttatactgcccccttccggcaaacggctggaagagacagcctgcatattttgtgttgaagaaactagttcaatttcatttaaaataaaacttcttttgtaatctctttgccccagccctgctgataggcagctgtaggtaatttctcttgttgcttgaaaatgttgcacaatatgaaaaaaacaataatgttaaagacaagacatctttggtgctctagaagggcaagaagtagggaaaaattactcagctgtatttgtatcaagcaggcacatggaagctgggaaaaaaacagaactccctccttggtttttgagaattgatggtgtgaaatttcctcagatgccaaaatcagctaaagcacaggaagattataaatataaggtaaacagaaggaataccgatcctagctttctttcttagtaagacagaaataaagaaag

SEQ ID NO: 16441 - DNA, 168 bp, Homo sapiens
ttttgtgttcaaaatagatgtaactataggccccagggcaatgagggaaataatacaacaaactatcgactaagactgtcaaagtcatttagtccgcatcactgtttttataggacacagaggtgacttggcgacacccagctagttagtttcagagctaggatgaga

SEQ ID NO: 16442 - DNA, 456 bp, Homo sapiens
cgaagtgctgtgattacaggcgtgagccacagagcctggcctaatactactcaatttttatcaaacactctggcgctagtagacaatctcctttagggaaagaactgctttcaggaaaatattttaataagttacctgtaataaaagtgagaggcctttaaggaaggaaaaaaagaagatttatgctgcctctttatgggaaaacaagagggatttgtcacttattttttcctactgatggggagtggggctaaggaggaaagagagacaagagccagtgagctggtctgagttggggactgcgggaagtcatggtgggtgagtgataatattttaagcacagggacactcagagtttaatctgaagttccattgctgtgatgtaatccactctcttccttcccacatgtcatcagtgattatgacaatataaacatcagcagaaatcttggggac

SEQ ID NO: 16443 - DNA, 561 bp, Homo sapiens
ggatactaagtcttccctgtatggtggttttgaatatctaatgagatcaaatacgatatgataagggcctgtcaaaagccatgcccttacaatttataatgggatctttaaattgacaatttcttctcctcctgcttattagcatacgaaagagaagttatttattttgagtcagtacaatgtatcagacagacattataggtttaagaatcagacaaactggaagatgctttcaagcaagtttattatttcattcatctattcattaaaaaatattgaaaaccatctctgcctcttactagctgagtgagcttaggtaaattactaatgttcttcagctttagtttactcatctataaaattaaaataatagtacctaaatagtaaggtggttgtgaaaatggaataaaacacacagcctgcagcacattatcggtggtaggtatattatgctagatgattattttaataaatgaattagtgagtagccacttagcatgggttttttaaagcttggttttcttgcaatatggattagaataatgatattaaaatattcac

SEQ ID NO: 16444 - DNA, 182 bp, Homo sapiens
ccgtcttcaacatcaccatggctatcagcaccattgacattgctgtcatcaccatcaccatcttcaacatcaccatcaccatcatgatctactgggtgcccaggaaggggtgagccgccctctggaggaatctaccttgatgatgaggtttggtatttttacagaacaggagaacataattt

SEQ ID NO: 16445 - DNA, 520 bp, Homo sapiens
gattataatcaagtgtaggcttcctgggttttgacatccttttagaacttgggtctggaattccagaaatgttaattgctgcttgtatttgttcttgtttgttttttagccagtatttgccctttctatccagccttatgaataatagcagtaaaatcacagtatcttggtcaggctgtattttttccttttttcttttttaagagacagtcatccaggccagagtgcagtttgatgatagcttgctgaagcttcccactcctgggctcaagttatccttccattttggcctcctgagtagctagaccataggtatgcatcaccacaccctgctaattttttaaatttttttctagagagagggtctcactgtgttgcccaggctggtctcaaactccaggctcaagcaatccttcagcctcggcctcccagagtgttgggattgcaggcgtgagccactgcacttggccaagttatttatttttaatctctcttgcccttctcccaaggcaggcttaag

SEQ ID NO: 16446 - DNA, 309 bp, Homo sapiens
tagtttctcctaaactatttctattcaggtgtttacatatgcctctgttctttccttttcttatacctcttattttaaaatgacctctatttcttatttattttatcagatgagcgcatttgactacatcattatagttctgcctaattgtgcctggaaattaacacgttagatacacatattattagattataaattactttcttctttgtgtctcctttatattacatttaggacaatgtggaatattttaaattgtgataaaaataaacattcccaaatctaccatattgaccattttaaaatata

SEQ ID NO: 16447 - DNA, 414 bp, Homo sapiens
ttctatttagattcacagatagttaacccccagaagtaatcatagaattattaaatatccactcctctgttcttggtctgatggttttaactgtctcctgtcttcagtaggactgtcactgtcgcaaaatgctgtttttgtggtctttatctattgtactgatttacttcagcatcttaagaaaagcaatctattgagaaaaaagatcttgaagtgcttagtaaacaaaatttctctctctttcctgataacaaaatacaatggcaaatggagcaaatgtttaaaggtataaaataaaatcaccagaagaaaagatgagcaaatatttttacaattttgctttacaagtatgacacaaaatccaaaaatgataatggaaaagttgatacatttgagttcataaaaattggaaat

SEQ ID NO: 16448 - DNA, 467 bp, Homo sapiens
cagtatttacaaggaaaaggggaaataaatatagagtaaataaagatagtttccacttaggataatgaggaaataagtaaattcaattgcagattgctatttgtctcctgttcaaattcaactcaaagatgtttttcctcaagacagattctgaaaagcccctggaattatcctaaaaaaactattagatagtttctgtaagttcacacataattcagctgaatataggctgatagctacaccagtttcccaaaaggaaggttgtaaattcataaaatacttccatctgccatgtgtcatttgcaagaagtctggtaaaataaaaaatatggaatggccataattcacatttcttttttttcctcttccttttgccaagataccctcattatcttaggcgaagaggaagagaaaaacccctgaaacataatgaatgtgactcagtagatataatcattaatctcatt

SEQ ID NO: 16449 - DNA, 317 bp, Homo sapiens
accacaacaaactcaggtaagttaaatcccacaaatcattattttttcatgcatataggtgagaggtaagcaaagatatatcaaaatgttttgattgagtactatgggacttttccagtgtaaagctaaagtcttcatgatagcttaatgccacaacgaatattattttctaatgttctaatacattgcctccctcttttttggaaaaaatataatacttctacccacacctttatattgacttaaagcgaattattattttgtcttttttgatgtttttcaatatgagaatgatgcctaaagtatacgttaacata

SEQ ID NO: 16450 - DNA, 477 bp, Homo sapiens
acaaggcacagccctagatcccttaaaccttgattccatacaacacatttttgtgagctcaaggttggggcaaagaggttggggcacagtgattggggcaaagttacagattaacagaatctcaggacaaagcaattgttcaaggtacaggtcaaaatggaatttattatgtcttccctttctacatagacacagtaacagtctgatccctcttccttttccctacaaaatagaaatgatcattagcaacagaagaaaactaaaatgagtaacttattttttttaaagtaacatactggctaggcatagtggctcttgtctgtaatcccagcattttggcaggtggaggggggcagatcacttgaggtcaggagttcgagatcagcctggtcaacatggtgaaacctcacctctattaaaaatacaaaaaatgggctgggcatggtggctcacgcctattattctagcactttggga

SEQ ID NO: 16451 - DNA, 260 bp, Homo sapiens
gagcttttggcaacacaaaccatgctacttctgagtctctgaatgttgggattggaagtgtatggaaaacttgagtaagttcctggctctgccactaaatagatgagtgaacttgaacaacttatttaaactctctgagctcctgtttacttatctgtaaaatgaagatatttagagttaaaaacctaggatatttagacttaaatttagacttaaattggctgctgctttggtttcttgaaagaaatactttggtcctt

SEQ ID NO: 16452 - DNA, 216 bp, Homo sapiens
tcttgtaagcatggtcttaatttagaaattagctgtgcattagaaaataaaatatgaaagagagtttgtaccaaagggaactgacttttggtccttttcattctcagggatgaatcagagaggccagacaaatggtcttttctcaaatctggagctgagtagaatttttcagacacagtgaacccttactcatgtgttatttagggatatatcatg

SEQ ID NO: 16453 - DNA, 339 bp, Homo sapiens
actggtatgctacttcctccagaaaaacacccttaatatccgttttggcctcttttaaaattcctcttctccatgttcctgtagtactccagtttacctgtgtctgacactgaagacgctgtgctttactgtacatttgggagtctcccctcccactggagactgggctccctaagggcgggtctgtcctgagtatctctgtggtgtcccctctggtgcagtgtctagcattggtcaacagatgttcatggcaccgaactgataaattgatgtgtgtgtacgtgtcacgtgttcctggcaaaggattaagttgctagccaggcacagtgcctcacgcct

SEQ ID NO: 16454 - DNA, 338 bp, Homo sapiens
actaaagaattatggtcgcttccagttgtaatattttttgtcgctgaaatatcatttaaaagttacatttcaaaatgtatgtatacaactataatatagccattggaaatatatattttaaatgttcagttattttttacagtaatctgtcatgcctgtgtcattgttgacatgaaattaatgttagaatcaatgcaagataatatggatcaggactgaaacagaaataagaattctaacctcataaaagagaaaatgagaagagtgaaatttcaaattccttcaaatggaaggcatgaaaattctcattagctctgggtactaatatagtgggatag

SEQ ID NO: 16455 - DNA, 329 bp, Homo sapiens
ctagcagaaaataattctatttgcctttcagatatggactgaactgagtgtaaagaatatgtaacgcattatattctagccaagtaattagctttttaaaattataagttattaagttggtaaaaatatataccctgcaattcttatcttaaaaagtacagctgggcacagtggctcacgcctgtaatcccagcactttgggaggccgagacgggcagatcacgaggtcaagagattgagaccatattggccaacatggtgaaaccccgtctctactaaaaatacaaaacttagctgggcgtggtggtgtgcacccatagtcccagcta

SEQ ID NO: 16456 - DNA, 493 bp, Homo sapiens
ggagagagggacacaaattgattggcagaagctgaatgtttttcctttgctagactttcatccaatattgaacaaattattgcatttagctcaccaggttgccacagtctttcaatacatcagaccagcacagtacttattactttatagcaatagcaatgatataaaaatgaaaaatattgcttgaaaatgtcaaagagatttttcttttggtggtggtggttgggtaattcagaccattcattccattgaaaacaagcatcccaaatttgaataactcttaaaaaattcctcaaaagtagcagagctaataagataacgaggaattattgggttaaaattcagaacatgaaattcctggccaggagcagtggctcacatttgtaatcccagcattttggaaggctgagttgggcagattgcttgagcccaggagttcaagatcagcaggggaaacgtaatgaaaaactcatctctatataaaatacaaaaa

SEQ ID NO: 16457 - DNA, 523 bp, Homo sapiens
accaagtaggactctatgtgttatgttatgaagaaagatgttttgctaacgagatccacacatatctttgatgttcaaagtgggaatatagtgtagcaagaagaaaattgttgaaaatatttccaattgtatatgttatgcatatcatctaaacataaacatgatgcattgaaaaaaatactgttggcaaagcaatttagaaattccagaaaataagccaggcatggtagtgtgtgcctgtaatcccagcactttgggaggctgaggcaggcggatcccttgaagtcaggagttccagactagcctggccaacatggtgaaaccctgtctctactgaaaatataaaaattagccaggcgtggtggcatgcacctgtagtcccagctactcaggctgaggcaggagaattgcttgaatctgggaggtggaggttgcagtgagctgagatcgcaccactccactccagcctgggcggcagagtaagtgagactccatctacaaaaaaaaaaaaaaaaaaaaaaaa

SEQ ID NO: 16458 - DNA, 482 bp, Homo sapiens
atttgtaactcacagggcagaataacagctctagagctcaatttatctggaggagattcagcacacctgcttctctttttccactggcatggctcttggtgcaaatttgtatttatgtaatagttagaaattaaacatcagcaccaacggaaaaatattcaacgccctttattaaacatcaaacaactttgtcaatgggaaaagctgccccaactgttttagatcttacctctcaacattgttgtcaaagtacctttccactctctggtagtgtctttgagagggtttgtctattggacttaaaactacatacacaaaggtaagataaaggttatttacacagccaatcttaaaagtagaatatcagcactctttaatcttcccatttttttgtagagacacgatctatgttgcccatgctgtctcaaactcctgacctcaagcaatcctcctgcctcggactcccaaagtgctgggattac

SEQ ID NO: 16459 - DNA, 381 bp, Homo sapiens
tctattctttttcatgtttccatgttcctttctctttttcttgaaagattagacctagaatctatcataaccaactaatgcatactctatataaatttgttgatcaaataaaatgttagagctatttaaatttatcataacagctttattaaaaaacttttactgggcttagttcaagaaccagctttgctctaacaatcctggggccccatgttatttagttgccacatggcctcacattcaaagaaatacaatctaaaagctaaaagtaattttaacaggaattctgttctttcagcatctctgaaatagcttataagcgatttatttttcaactcacatcaatatttatcaaagtactctttttttttaaataaaaag

SEQ ID NO: 16460 - DNA, 429 bp, Homo sapiens
gactcacagggggatctgttgcaagctgaagtttgagaccaggatgctagaccctgaactacttgaggacagaaatcctacttctccctcacctgagtacctagcccagtacctggtcttcaggagatatcaaaagctatttgttgggcggatggtgggtaaatgaatgagtgggtgagaggccattcatctctgtacagctctgttgaatgtatcctcttttgtcttgcacaccattcctgcttccgctgggatgtgcgtgcttcccaggccagtgccaggagctacagtcatgccaggtggcagcagatgagacctactttggaaacctgtgtccgactcagggcagttacctgtgggtgcagtaccagtgccgggaaggtgagtccccaacttgcttgagcatagaaatgtccctctgattttatg

SEQ ID NO: 16461 - DNA, 217 bp, Homo sapiens
gttagtattcaatggtaggttccattcattttccttaccttgtttgtagctataaaattgccagagtaaggtagagcttctccttcctattccaactcattttctgtatatcaccccatgttccataaggttatttccaaggagaagggaggcaaagaatataaattaagggcagggcgcagtggctcaggcctgtaatcccagtactttgggaggc

SEQ ID NO: 16462 - DNA, 374 bp, Homo sapiens
tatagtgttgaggggcagatggggtatggatagatgttgagaatggcgtgaaggagtccttatgggactctagttcccctgctccctccaagaccactcagacccttggataagtcaccaatagctagaaataacacgagtttacttgaaatgtgtcttccagaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaacgggtgcgaggtgggtgagggaaaagagactacgcactgggtacagcatacatgctc

SEQ ID NO: 16463 - DNA, 361 bp, Homo sapiens
gacaattgaagcagcatgggaacaattccaaaccctgcatgtgtgacccaagagggaacgtgaaatatacaattcttccaagtatcccgccaggctgcagggaattttagtttttgatgacaagggctttgttgttattatttgtttgttttcttataaaaacagcccataaacacaagctaacttcttctctggcactcagtctgagacagcagtctgttctaaagctggaagaaaaacctgccattgaatttggtgttaagtcatattgctttcctaaggagttttcaggggtaattttggctatactaaaaaatcaccttcaggaagtggctttagcaactaattccttttaagaagc

SEQ ID NO: 16464 - DNA, 295 bp, Homo sapiens
tggaaccagcaaagcatgaaaggtttaagacacttcatcagttgggttttcttgccttgaaaaagggggaatagaaaatgatttggtaagcactccctctttcacttcctttggaagggattgggcaaaataagtattatttcctcctcatatacgtagaattagtttttttggttttttgtttgtttgtttttgagacagagtttttgagactctgtcacccaggtgggagtgcaagggcgcgatctctgctcactgcaaactctgcctcccaggttcaagcgattctcctgtc

SEQ ID NO: 16465 - DNA, 291 bp, Homo sapiens
cgacagaagggtatctttattaacaattgacttgaatttaaaaaaaattttagaagcagttaattacagagaagtgctgacatttctacttttcataggaaacttggagagaagtcaaaggtgtaaaaaggacaaattttagaaaatgagattcatgaggaaagactgattaagttcactttagttaatgaaatgtggaattatgaaaaattaaatattaaggagaaccctaatgaaattataagaatagaaaataatttactcttggcctggcacagtggctcacaccta

SEQ ID NO: 16466 - DNA, 105 bp, Homo sapiens
tattttattctccattcaactcacaaattttctatgcagtcaaattaaacgtgaaagatgggtttctcactagctatgaacactatcaagttgatggttacacta

SEQ ID NO: 16467 - DNA, 541 bp, Homo sapiens
aatatacctgctctaggggtagaaggttaggaggaaatgccaatatcatccatcattttgaatctagaggcttcttggcttcagagttgtcaaaatacatctctttttttggtgaatcaatacaatgaagtatgcaggaaaatggcaattacacctattatacagatggcaaaactagaagatataattgtagtttttatagagttatctctttaaccacatttacactgactttcttgttctccccacttccactctccttccacgcataactaagttatgcgtgttggttcttcaggtatatttaaaatatgcaaccacctgtgaactcattcacagataaagtgagcatatcttgcaaaggaaatacacagcgaatctaaaaatgtacatgccattttattttgtatatatgacagcaaaatagaaaagaacttttaaacgtttacttattctgacttcgtaacagcatgtcaaccagccttgtaagtaatgacagtgtttactagtttgtaaagagtgctttattacaaatgtgagc

SEQ ID NO: 16468 - DNA, 498 bp, Homo sapiens
taaattgtttatgtatatattatttgcacagactttgcttccattttactgaaatggaagcaagtcatgtgtattttttttaactactatttttttaaactttcattcaatctgataaccatttagccattttattttcactcccagatggtaatctataaaaatttgcttatataatttcttacatatataggggctttattagctttttgaaaatatatttatatgcatctgtttgcatcttacttttattgcttaatgctatttcatgggacttttcaggccaactatgctaactcaatctttttaatgacagtctaatattccatgctgttgatatgccataataaatccaactattcctctatgacattctttttacaatgaggcagttaacatccctgaacatctatcctaatgaattgatgcttttaattgctatggtataggtttacaggattagcattaccaggcctaaccatatgtattttttgaaat

SEQ ID NO: 16469 - DNA, 365 bp, Homo sapiens
gttgaaatggacttttaaaacgtgttttccatatcactaaggcacagccctatgttttctttatttaatatttccagcaaatagtaaagtgcctggcacatagtaactgccaagtaaatatgtgtttagtggattaataaaagaatgagtaagattttgaatgttcttgataaagagtattacttcattaagccttccttaaggaatattacatttgcagcagtaaggaggagaagttggaggaaagagaaataatagcctcttaataagcctaaggagttttagatgggtaagaatttaaaaatacccattatgagtctggccttgtcctaaggtattgggatacagagattaaaatacacaca

SEQ ID NO: 16470 - DNA, 388 bp, Homo sapiens
agccaccagaagctggaagaggcttgaaggactcttccctagagcctttggagggagcccggccctgcccacaccttgatgtcctccaggtctgtaggagaacacacttgtgtcgttttaagccacccagtttgtggacagttgtttcggcagccacaggaaataaatacactggaccagcctcctcacctttccaaggcgtggcatgggggccgcagcgtggcagggaggaggaagcaggcgagcgtgcagggaggctcttggggcccagcctggcaggtggcaggagcttgggaaaagcttgctgtggtttggctctgaagacagtctcacctctagtaaatttctaagtggggccctgaaatgtgaaaacacaaaactggattct

SEQ ID NO: 16471 - DNA, 582 bp, Homo sapiens
caaccccctagctaagatgaaaacataacatgagcaacaaataaacctttgatgttttaaccgctaagattgtggaggttgtccaagcccattcccactgctctagcttactaagtaaagtcaaacatttttgtgtttattacccagcaatttcaatcgatggcatttgcccatttgagtatatgtataaggaagcaggtagaaggatgtttacaagaacattgtggtaatagaaagaagaggaaaaaatggagtatccgtaaactataaaagaataaactctaatatattcatacaacagaatcctgtagagcagagaaaactaatgaaagatagccaaatgcatcaacaaagatgaatctctaagtatattattgaatgtaagaagcaagtcagaatagtacaattcatgttaaatgcaaagtgtgaagagttgatggaaattataagaatccatgcataggttgtaaaaatatacagaaaacctaagaaatgattaatacgaaattcaggattgtgatgttctcttctccactatctctatatagagtagaagacagagaaatgtactcaagaagtaga

SEQ ID NO: 16472 - DNA, 578 bp, Homo sapiens
ttgatttcaaaattccaaatatttttgaggacccaccgtaagtctttttcatgggtttttataggaagtacatgtccctggtttaaagatactctggtgaggttctcttgccctgaggaggggctctaagaatgaggcccttgcataggcagtctgggagaagggcaaaagcagaagggattctgtgagtctggaaagttcctcagcaccttcttaactctgagcgtaagtgctagggtgtactggggcatgcctgagctgccagaaggaatatagacacatctacagtcttaattttgacaaacaaaactggtcagtgaactggaagagttaagtattagttaaggggaatctgaaacttccttcccaggtcaaaaatatcttcaccacccaccatatcttttatgcaacacatatgtcctgagtaggcactctgggccaggagggatttctacagtgtactagacacaggcattactttcaatgaccctggtgatcctcagggcaaagaaaactataattaccagaaaggttaatatgttgaactttatatattggaaaaatatggcaccaaatct

SEQ ID NO: 16473 - DNA, 570 bp, Homo sapiens
agattggccagaaaatttgtttcttcatggaggaagaaaaatgggcctttaaaaatgtgtttaaacaattattgagactactgtccctttgtgtatcttctgtgactgaaagcggtaaagctgacagcaatgtttccacacaccagtcagggctgcctgtttggctagacagaaaattttcccccatgaggagctccaaagagcctcccagattatgtctgcactgtaaaccaaatagatctaatcgatatttacagaacatttcatccaagagttgcagaatacacattcttttccttgcacatggatcattgtcaaagatagaccatattttactcaaaaaataaaataatatcaagcatcttctctgaccacagtggaataaaattagaaattaataacgataaattttggaaactatacaaatacatggaatctaaacaatgtgctcctgaatgaccagtggctgagcaaaaaaaaaataagaaataaattgaaaattttattgaaataggtgataacagaaacacaacataccataacctaggggacacagcaaaagcagtacta

SEQ ID NO: 16474 - DNA, 544 bp, Homo sapiens
atcaaggagaccaggcctgccctaagggttttgctttcttcaaaatgtacagcaagtagaaagcatacactactgcaagggccctgggcacactatttgcacagatgaacaatacctgtggggataatactgatggtttgagcactactttgtacacacctgccattatttatgtggtaacgtccttgacaaaatgatatgttcctatgacacctctcagccagtggagtttctcaggctagcactatgcccaaatccccagaaagacatgacacagattaaaatcccagcagaagaatctccttagggcctaacactgatccaaacattctaggccagtcacctccattggcacagaaatacacagagggaaaaaccttgagtcccctgctgcagagggggcaggctgtgctgtcgggggaggcaggtgatccagggcacacatatggggtgaagggttctagaatcacccaccggaaaagccagaaggggaccccagagacagtgttcctcaaagcctgtctttctacaaatgagaagactg

SEQ ID NO: 16475 - DNA, 556 bp, Homo sapiens
ttagacgctcttttgaagaaaaggtgcagaaaagctcttaagaacttaaaggagaagacgcttttcaaatttcgttttctggttcaagatgttttggtgagtctatctgaaaatgctaaggaaaaaagcagaaataaaggccttccaaagagtcttaaacaacccccaggcctcttttagaacaagcaacatgcgtaacatttggcaatgtgcaacactgcaactcataaagcaacccagtctgataaagaaatacaggagtatatttcaaacaatttttctgatggggaagagagatccatctggattgtgggagtttgcaaatcagaagcaagcagccctttcataccccagtggtagagggtctgaggatgaagatgagtgcagacgacataactcacagactagaagttcaaggtttgctgcctgacatcttggaagcagctacaatagtttcctctctggtgctcctgccttcactagtttccccatccaatccgtcatacacacagcatagagtaatatccttgaggcacagtgattaaactatgcactc

SEQ ID NO: 16476 - DNA, 387 bp, Homo sapiens
  misc_feature 1: n = A,T,C or G
naagacagtgataggaagtgtgagaaaagctgaggtcctgctgcccatttgattttagggtttttttggtttttattttctcatttatctatttttattttatgccatagcaactaccaatgcctggctaatgtggaaccaccagtacagccttccttttagctgagtactacagaagaaaattctgcaagcacagtcacgtcttacatggccactagcaaacatcaaacaattcagcataatgtaagtacaaacagttttatgagaaatgctaaaatgttaccagcaaccaaaataatggtccaggctttgaacaatgattcaattttaaatccttaaaaacaatgcagcagtctgcaagtaaccacattctcagaagaaaatctc

SEQ ID NO: 16477 - DNA, 622 bp, Homo sapiens
acctaatgtcctctgggtttctccatgtggctgcgaatgacaggatttcccaaagctttatggctgaagcatactctgtgtgtatctgtatggcagtttctctatcccttcagctgtggatggacagggctgctgtacgtttggcctgtgccaatggccatgtggaagtggggactctcctggtgaactgaaaatgccacattgacattggtgataaacaaaatgggatgcctttgaggaggctgtacattgccaggaagagatttgtggcatcgttctgctggaacgtggatgtctacagcaacactgctctccactatgctgtcctataatgagagtacattcctggtagaaaaactattttcccatgatacggatattgaagtgctgaacaatgatggaaacacaccacttttagttgctgcagtttgcaaaagacagcaaatgctggaatttttagtgaagaaacaagcaaatgcacatgctgttgataggttgagaggaacagccttcacgcctgctgtacattatggctcgttaggtatagttggcattcttcaacaaaatattactgtctttattcaagatatgtatggacagacagcaaacaattatgctattt

SEQ ID NO: 16478 - DNA, 583 bp, Homo sapiens
aaagaatgtactggcctcaatttctgataaggtatggatgaaccttcctcatgccagacaagaaagcaggatagattagcacactatggtaaaatgtatttcttcaaattaataaacctacatgagataattcacattagccaataaggcagaatacagtaaaattatataacaataattatttttctaagaagtgaggaaacagatgaataaaaagtgaatccctcccaggaaaggtaaacagcaactgtggcccaatgtctctgcatctctggaaataaggagctgaagaggctggaaaggtatattgacagaaagctgatataagagaagagatggactaaagataaatttcagctatttctgatttcaatgtgggtcagacctgctaactagtaataattactgctgttctttccttgtaagtctctccttcccttcagatcatactgtttcttgttggtctcaggaatttactatacaatgaaatttcttggatttgagaccaaattctgttaaaaaaataaaaagagactttaaatgatgaaccaagaaagacactaagagggaaaatctatgaata

SEQ ID NO: 16479 - DNA, 578 bp, Homo sapiens
tctgagaactacatttacaagagaagatacgtgatatagttaaatgaaacagtgtgtgcaggctgaaagagttctagagcacatggtaagggtgggaaatgatgtgcaaacctcctgacagagataaagaaggcaattgtagcatttgtcctcaaaattcacttacaattcaaatgtttcaggggaatttccttatgttaatgtatctcttgtaatgtggctgaatgtacaaggaaatttggatttcctctacataaatttgataagaacattctatagctaacctgtgtttttgacaagttctataattaagctaattataataatagcttgatggtaatcactacaataatagctaacatttattgagtacttgctgtgtgtcagcactgtgttaaattactttaattgtgctctttcagggaaattaagagacttgcagaatgaaagagccacagcaggataaacaattgccagtctcccttgttggggactggctgactttataaagcaaacaaggcattctgtagtcactccaatgagtgggagattagaatgagaacggcattagaaagcac

SEQ ID NO: 16480 - DNA, 136 bp, Homo sapiens
atgtcaatgtgtctgttgtcatggcggaggtggacggcacctgctactgagccgcccgcctgtccccacccctgaataaactccatgctcccacaaaaaaaaaaaaaaaaaaaaaaaaaaaaggggggcctttttt

SEQ ID NO: 16481 - DNA, 343 bp, Homo sapiens
aactataaataagtaaaacaaagttatcgacaatgggaattaatgacatcttatgtaagaaagcataatttttgtattctcacttaaaccttttgctatttaaactttgactttcaattcaaatgtcattttgcaattaatagcaatagcaagcagaaacaaacaggaaatataacttttatttttttgaaagggagtcttgctctgtcacccaggctagagtgcagcggcatgatctcagcttactacaacctccacctcctgggttcaagcgattctcctgcctcagcctcccaagtagctgagattaccaggcgtccaccaccacacctggctaattttt

SEQ ID NO: 16482 - DNA, 524 bp, Homo sapiens
gtgtgttgtattagtccattttgtattgctagaaaaaggtacctgaggctgagtaatttataaataaaagagatttattttgctcacagtcctgcaggctgtatgagcgtggcaccagcatctgctcagcttctggtgaggcctcaagaagctttcaatcatggtcaaaggcaaatgaggagcagtcatgtcacatgatgagagagggagcaagagggagatgccaggctcttctaaaaaaccagctttcatgtgaattaatacagtgagaactcactcattacagcagagaagacaccaggctgttcatgaaggatctgcccccatgacctaaacacttcccactaggtcccacctccaacactagagatcacatttcaacatgagatttggaggggataaacatccaaaccatatcaggtgtctctcattttaaccaaagttcttaatttcaattacattgtattttacagttagtaccagtgtcaatactttctattttctaactatattactaggcatga

SEQ ID NO: 16483 - DNA, 532 bp, Homo sapiens
gggagatggagaggcagcagatggcctcagcctcagagaaactgtgggtatggggggcacagcttgggtaagttgccaagtgaccaggtcctgggagcgctttgcgggtcaggctcgctggctcctaggtggggacgttgctggctgacacggggaccatcgggagacgggctgggcaggtgaagggcagtccggtgcctggaccactgtgagctggcttggcggagacgaggccagggctgtgttcaatggaggctttattatcactcaggtgtaggaaggatcagaccactgccattgacaagatggtttgtcatcctcagtttccaagagaaaggggcatgtcacaccacaccgtgaggccacagggaagcccagggtcagtcagaaggcagagggttcgagggggaactgtgggcctgagacggtaatgtggtttctgcaggaaacttgagttcccagccatgatgggaatgggaggtcagacacacctgattctactccctcacttttgtagtttacacacaactga

SEQ ID NO: 16484 - DNA, 562 bp, Homo sapiens
gccgaatacaggtaatctgtgtgggtgaaaataagcttgctgaattgcagggcgagtcttttttcaacgtcccatgctattttcgggatagatataacatatagctttaaaattgatattcatcctaagtccttcaaatacaggtaaataaaatagagcagattatgtgacactaactgtaaatgtcctgagaatggtagaaacctctgttgactataactggttctaaaccaagatggtggaattttattttctcaaatgttttcagcatttaaaatttcccttgtatgtctctcttaaggtcccaatttcctcgaataaataggcaaacaagaactaataatgtattttctttagctacattctccctcctgatgctatgatttttaaaaatctcatgctttctgcaaatattttaaatgataaatttttacacaaggccccaaaatagcagcttatgtgcagatgcataaagagaaggctgtattttgtatgtaaactatgttaatgcaatgaggagaccattttttgtttcttttcacagcattatgacctcctaact

SEQ ID NO: 16485 - DNA, 551 bp, Homo sapiens
cctgagttcaaacgattctcccacctcaggctcctgagtagctgggacaacaggcacacaccaccacgcctggctaatttttgtatttttagtagagacagggttccactatgttggccaggctagtctcaaactcctggcctcaggtgatctgcccacctcagcctcccaaagtgctgggattacaggcgtgagccacagcacccagccagtcattttgggttttctttggttattttggatgccttactgggacccactcaaaaaacaaacaaacaacaaaacaaaacaaaatgaaaaacactttcataaatgtctgtctcaaaaccttttctactttctccaaatagaactaatgcatacatattcttaagatttgctcagctatatctccttggttctgacttaatcctcttctgcagaaaatttcatctcacatcaaagcctcttccctccttctgctgtaaagttgttgagagctgtcacagactgtcagctcagcttcagctatgcttaatgagtgcttgtgcagaatgcaccccaggtaaagg

SEQ ID NO: 16486 - DNA, 370 bp, Homo sapiens
ctgtggatggagttgagagataccacctcagaataaagagctaagaatcacagctattcaaagatggattagactgctttgggacagtgagttcttatcaccaggaagtattcaagcataggttagcaattgctgggtggatattgtagagaggatttgagatttagtttgcaattcaatcacctatctttaacatcctttccacgccgtagattttatggccttctttcattaaatgaaggctagaagggacattgaaataatttggtactttcctttgcctccagagagaagagaaaaaatatgatttctcctataaaatagcaattgaggtgtgagcctaatagtcttttttttttttttttaaaac

SEQ ID NO: 16487 - DNA, 578 bp, Homo sapiens
gataacgtctggtttgattcacttattaaaagtagtccaaaggtccttcttggttgttggttgctccgcagttgctataattacaaggccattaatttggaaaccttttgtttctcatcttgctctgaggtcctcagctaacttacttaaccctgtagcttccttatccttttcctctctctctttcttgtttggtaatgttgtggggagactccatttacaaaaaggacagctaggattagctgaattgatgtaatgcttggaatgctgtaggaaaaacaaaaggtccaagtgggctttgaaattagtaacagattcatttttcttttgtctgcaggtctggtttagtgcaggtgggaaacactttaggaatggctttcaaaagcttatttatggccgggcatggtggctcacgcctgtaatcccagcactttgggaggctgaggtgggcggatcacgaggtcaggagatctagacaattctaggtaacatggtgaaaccccgtatctactaaaaatacaaaaaattagcttgggtgtggtggcaggcgcctgtagtcccagctactcgggaggctg

SEQ ID NO: 16488 - DNA, 560 bp, Homo sapiens
aggtacacagtgaaaaattaatggagatgccatctacctccttgtcttacattttcttgctctgacagtcagctcagacccatcatcatgagctccttttataagtcccctggaaaggtaagacagacactccaggagagaatgggcattggaagagaagagacagatcactccaggcattgtcttgcagaaagagtaagaagaaataagggaaagaaagctgctgggaaaggaaaacaggttttccaggagccactggtcattcttggttgatgatttgtgtgtaatggagagttaagccacctaagtgaaggactgcctgaatacatcctacaggcagcaatggcctacttcattaaacgcagcacaatgttcttggactagtgtgtcaaaatagaaaagtaattgctagtcttattatcttaagctgcatatggtatgatgtgaaagtcagtatgtaaaagaaatgtttccttaaaggggtgaacataatttcctggaaaattaacataagtcaaatgaataaattagcagtcagagtagaaacaaatattcttcat

SEQ ID NO: 16489 - DNA, 598 bp, Homo sapiens
aatgtgtcttatttttaaaaaaatgtaaaaatacataaatagtagtagtataatgagaaactatatagacacgcaaacttgaaaaatcttctattaatttacgtgattactgtagcataatcccaaattaaactcactttttctggatgactgacttgggtaaaataattcatatatgaacaatgtgggtaaaaagaaaaaagtctccagtttacactataaatagagtgattttatcaaagcaaatattaggaatttatccttggctttttaaaacaaaaagatactaaaatacttgagaatcctaatttgataatactgaataatgccacagtttatcctggcagagtaggacattttaaaaagctataaaattcactatatactcggccgagcatggtggctcacacctgtaatcccagcactttgggagccgaggcaggtgggtcacttgaggtcaggagttcaagaccagcctggccaacatggtgaaaccccatgtctactaaaaaatacaaaagaattagctgggcatggtgatgggtgcctgtaatcccagctactttgggaggctgaggcaggagaattgcttgaaccc

SEQ ID NO: 16490 - DNA, 345 bp, Homo sapiens
atagcagtgggtcttgagtattcttatgctacataacatctggaagaaataaatttcctaggatcaaagggctccgtgtgcagcccagagggtcctcagggtgctcctcagagcaaacaaacagttttcttgatgagtcactgcaattttttttttttttgccaaaagcccacatgtattgcaagatctcaaggaaaagaggtggagtaaggagaaagaaaaaaaaatttaattagggcaccagaagtcatttttaaaaattttacccccaaaaaaaaaaaaaaaaaaaaaaaaaaaggggggccctttttttccgaaaccccaaccggaaaaaaacccttgggg

SEQ ID NO: 16491 - DNA, 629 bp, Homo sapiens
agccatctgtatgacttagtcaaagaagctagctttggactcagaagtctgatttaagagccacttgggcacagtggctcacacctgtaatcccagccctttgggaggccgaggcagtcagatcacctgaggtcaggagttcaagaccagcctggccaatggggttagtagaaaccccatctctactaaaaatacaaaaattagctgggtgtgatggtgcacacctgtaatcccagctactcaggaggctgagacataagaatcatttgaacccaagaggtggagattgcagtgagctgagattgagccacagcactccatcctgggtgacagagtgagaccctgtctcaataaaaaagaaccactctagactgtgccactcctctctctatgcagggtgggccagtgaggctctgaaatatgggaggtctagccccttctcagggcaggtctggttctggtcctcggggctcccacagaagtaaaagttgagcccctttcaagagtcactgtcagggggttggggacaatggctcacactcagcattttgggaggctgaagtgatggagttgcttgggcttagaagctcgagaccagcctgggcaacatagtgagacccccatctcta

SEQ ID NO: 16492 - DNA, 656 bp, Homo sapiens
cggctgcgagagacgacagagggatatgatgcggactgttttcactcttatatcatctggtgacaaaattggaagcttatggaaattactatctatttaatgctgctcattcaaacagtccttaacaataggtaaaaattaacataaggggaggcttgtggttttgtgtattcatttcgatgttaaagaattgccatattaatagcttcacaactgattatatatcctttgtggcaacagctggacaaaataagagatacttaacagtaatattcactataaagtgtttctatatcattttactctagtagtagtttttctcagtttgcttatttctttttaggtatgttgcacaatgcagaaagcacttagtttcactatgtccgtgtgttcatccacatacaatatatgaaatatctgtgacaatgtggacactcaaagtactttcacaagcacttggatgcttgaaggctcccatttgtgccttttaactgaatgaggttttcccacatgcctgtgtggaaaccagaggcaaagtgaaggagaggaaaacaggaggatggaatcatagaaaaggacagtcagaaagtgaaagaacaaaggacaaactcaactagagccagagactgacagactgaaatgcaagcatagtcaga

SEQ ID NO: 16493 - DNA, 609 bp, Homo sapiens
gactttccctttatgaagaaaaatattcctttgaggaaaaaaaatcctcttattttgtaaagtagttccaagagacagctggcatattcaagatataacaaccactctagagagcaatgaatacaaacacacacaagaaaatctgtcacttaatggctaatattcgtaaactatcaacagagaaatgaagttcgtaattcagacagaaaacccatttgctcagtgtgttgctgataaaacatgcaacataagcaaattattaaaaacctaactgtagcaggtcgatagagagctctgcttctgtccccataatcccattattcaattaagcaatactacaggtagaacaggggacacaataattatcaccaacaacattgccattcatgcttctaccgcaggccaaacttccttcagatttttgtggaaggtatttgtatgtcataaatacataaaaagtcaagacacagataaattacctctattatcttttccaaggatgatccaaagaaaatgtcaaatctaagctgaaactcttagctgagtctggtaaagatatacttttatgtctttccttattataaatatctggctcatcattttcctcat

SEQ ID NO: 16494 - DNA, 571 bp, Homo sapiens
ctgtccttaggatacaacgacatgctatgagggtgacacatcaaagccatcactgcaaccacatggagtctttctggacacagaacattctagatggtggaactagatcatctcagacaatgaggaccagtgaaagggtctggccattggcaagaaatctgctctaatggtctctgggatgatgaagctagcaaaggagctgctgattttttacaattaataaaatccaataagttttcagcgatttggcttaggagccccaaatttaaacttggttaccacgccttactaattattcacattatttgtctccctaaaaattacctcagagaaggcctggaatgctacattggaaggaatgtgtcaaacttattcttgacctattatttgataattcttagagaaacagttgggcacagattcacctcccaatcactggccactatagggtccttcggagggactaactcagcaaaggagcagtggacaactgagtctgctggcctctctgttcctgcccaacttcaggtttctgaagctgtggaaaaaaccatttcactggtcatgaaca

SEQ ID NO: 16495 - DNA, 542 bp, Homo sapiens
cgcatactttaatacatcacagaatttggcagaaagaagattttaagcaattgcctggtggcactgccactagcctaggccaaatcagaagctcttccctgaccagcatctcatgaaagtgctatcagtgaggcttcagttgaggtgggccttcaagagttgtcagtggaaggctccagggcctggactttcttgctcccaagaggtaccacaagggtaaatgtacccagatctggaccaacatctccttccagcccaacttctaccttcccttccatcatggaacagtaggtgcagcctggtgcacaagcagatggtggactggaaggtacatcaaggtaatgcatgggagatggagatggccagctgactcgcaactcaccttgagggagcagttattaggtcccattcccaatccttacacagggacctccattcctgtgttgaaatttaaagtttaagggctccttaaacaacagccctgaacctaatccccactaataactgaatggatatttctagtgcttctcacctatccacct

SEQ ID NO: 16496 - DNA, 544 bp, Homo sapiens
cacacaaaatggtggatccacaaaaatggtggatcaaaaccatttgatatgaaattattttcctttacataggaagtattgatcataaccacatgtgtaaatgattacatctttgttataaaactttaattacaaatttcctgattgattaaaaattatcacaagctcaaattaagaagacgtcaataaaatgtttatttattcaataaattccccttaaatatttatatgagatgtccttctgacttgtattgtacattaagattttttggcaattgttttgggacaagccaaggagaaatggaatagtactaggggtttaacaaaactgctgtctttgcatttcatctacaaacagagtctatgtaacattcatccctggcaaagaagttaatattccctagaagagaaaaatatttaagtctttaattaatcttaagtagatttttgtatatggcataaggaagggatctagtttcagtcttctgcatatggctagccagttatccaagcaccatttattgaatagggagtcctttcccca

SEQ ID NO: 16497 - DNA, 499 bp, Homo sapiens
caggtaagcctacaggctaaggcagaaaagtataaagataagaagaacctagatccatcatgccatagttgatctgttgaattaccactgctgaatctgttctacctccaaacattttgttatataagatgatgaatctcatgttgtataaccctcttgtagttagattttctgttatcctaggccaaaaatatcataaagaatggcacagacatttagagaaatgagttgaggacagaccatgaggtcccagggagagagaaagagataaagagagtaatgtagactttttaattttttatgaggtaagctatacttttttatttttgattactcattaaggaattttcctgtaccctctaaaatgtatccctatttatttgtattagtaaacagttttcaggttcttgtatccaaatgatctctaaaaaagacaacatatattatcacattcaatccccatgacaataactctgtaagttaaacatttctttttgct

SEQ ID NO: 16498 - DNA, 576 bp, Homo sapiens
tatccactccacgcacaagtgggctgtgatttttctggaattagaagtctatatagttattgataaatctcttgatttcattttgtctccctgttgcaatgcagcaggaagatttaattttttttatacaacactatttccagcatgaatcaaagtaagtaagaagtaacttatgcattctcagaaataagcctacatctcattttgcttcaggcatttcaaaattttttttcttctctattctcatactttaagaagaaccttaaatctgaagccctaggacttagtaaatattgcaatgagtggagaaggaagtttattttcattatttgatacatatgtcatctcagaatgctgagagaaattacattattgtgttttatatgtgtactgtgaatttttgtcagagttaaagatcaattcattatcaagaacagcaaattactaggccatatattttacgccttctcgctgcctaatggtttatttatttcactgacggctgttttctagacaactggaatatcaatatgagtttttaagatgcccttcttcacaatcatattttactttttt

SEQ ID NO: 16499 - DNA, 526 bp, Homo sapiens
gcagtggtgtgatcatagttcactggaacctccaacaactgggcttaagccatcctcccaccttagcctcctcagtagctgggactacaggcatgcattgccacacctagctaacttttgaaatttttgtagagacggggtctcgccgtgtttcccaggctggtctcaaactcctgggctcaagcattccttccacctcagcctcccaagtgctgggattacaggcgtgagccacttggcctggctggtttacattttttaatgcccgtcttcagagtcaaaactgggattgccctggtgttagtttgcattaaaaattgctgatatgagatttatgcagagctgggacttgctgatattgttggactttgtcatctgtacttgaaatatgagaaagggaactgcttaaaatatctgggctccctttccggtagctttagttgtttcccatctttaaaccaaatgctgaaggcataacataaattaatgtattgctaaaggccgagtggataaaatacacaacagc

SEQ ID NO: 16500 - DNA, 320 bp, Homo sapiens
aacaatagagcataacaactttttactcagtatttacattgtagtagatattataagtaatctagagttcatttaaagtaacaggaaaatgtagatgtgcataggttataagcaaaactataccattttatacaagggacttgagcacatccgggttttggtatctagagagggtcctggaaccaatcccccataaataccaggctgttttttttcttttttttttttttctaaaaacataatcaaatctaaaaggagcttactcaaaaaaaccgtaagggttttcaggggactcaaaatttttttcaacttaggccagg

SEQ ID NO: 16501 - DNA, 583 bp, Homo sapiens
aagtgaaaaagaggaaccagggcagtagctggaaagtactgtcagtgtgataagaagtatttcaactggcagagatatcagcattcttccaagctaatggacttgtggttaaagataccagaataaagacatttttactttattcaccatttttacatcaaccaaaaacaataagaacaataaaactattaactgtgaagatattttgaacatttattttgtttggtgatactctcttggagcacaatcaacttagaaatcaagacgaagaaattagctcaaaatcatacaattacatggaaattgaataacctgctcctgaatggatcctggataaataattaatttaaggcagaaatcaagttatttgaaactaatgagaacaaagatacaacataccagaatttctgggaccacagctaaggtagtgttaagagggaaatttataaaaccaaatgcccacatgaaaaagttagaaagatgtcagtttaacaacctatctaaaagaactagagaactaaataactaaataataactaactaaataactagaagaactagagaactaagagaaaagcaaccc

SEQ ID NO: 16502 - DNA, 592 bp, Homo sapiens
atttgggcaaagaccctgatgggtacaattacctcatagctaaaggaatcatcagtgatctttgctaacacttcactactctggccttcttccctcctaaccacctgtaaatcccaatctatttgtagcaccactctgccttttgagtcttttgctggggatctatctatttctgtaatgaatttataaaggatgtgttgacatgatcttaagaaaaactctgttgttgcaagggagaaactaggaagaaaaaaagagtttctttgttcaaaacagatcaaaccagatggttttacaaatgacagtagctaaagagtatatcattgatttcgacatgaataataaagggctttagggactgctcctctcatacatgaggttttggtttccaatatttagcaatctggacacttgccatggtaatgattacttcatgtgggtcacaaaccccacttcaaagtaaagaaacagtataatgaaaaagattttgaagagcagatgatgaaactaagcaaataaaatataaatgtgtatcttattttataacttcgaagatcatgattattctttacaatttcaatgaactgaacac

SEQ ID NO: 16503 - DNA, 574 bp, Homo sapiens
tccagacacaggatatatcaaattcctgatttaaagtagttctgaacaagcagtaaaattaacattagttcacactagaggaaacagtgattccttacagagaaaaggtatactttatgtaattaatttcattcttaagacactttaaaagcagaccaaaatctagacaaaactttttctatcagaagataaaaataatagtcctacagttgcttcataatgcaatattttattttggggaaaaggcagagacttcacttagctatgatcataaaaaagcaatataaatagtgattttcgtattcatttttctgaagttattattccaccttacctttatttggaattccataaaactcttctctgaacattgtgtatcctgtctgaaaactagcaaccaaaactacaaacttttaagtcttccactttacacagaaatcaataaactagttttaatattggactgaatttcaaagttctattctctgttcctatttggctgaaaggtatacatatatcaagaaagtttctatcgattttcaactagaagtatcagttttgctgtcagagctct

SEQ ID NO: 16504 - DNA, 642 bp, Homo sapiens
cagaatacagtgtaagaaaacatgaccaaagcaaaaatagtaaggactaaagaagggaggaaggggaaatatcaacatggactgaatatgacccaaaagagccttgatggatggtcagacatgtaaaggcaaattggttagggttaaggggtggaggtcagggcacgttctatagggaaacggcagctgatacagaagcctgaaaggaaaagcgggcagagcacctggacaggactcttcaggaacgagcacgcacgtgcgtgaaaaacaacttagtgaggtaccgttcacccaaacattagagaaaccgcgtaaaaatgcttcttggtaagcatgaagaaggcagggctcgccctgtagaagaactcaataaacatttgaactgtctaaagagtaaaagttaatgaataggccaaactcactcctttctttgttttaagagctacaactttagagaataacaaatcacaaacccagtagacaggtcctggcatttcaaatccaaccccatttttcccttaatctttcccctctgagcaaatggtatcgacatgaacaagccatgttgatttgatcaagacactcatccatggttaaaagagtctttactttcaagagatacaaacagaaatatttacatgg

SEQ ID NO: 16505 - DNA, 636 bp, Homo sapiens
gaatgctaagattcttgtctcgctttggggaaatatacatattactaaacttaggtattgagagagtaaactgaatttaagtgtggatattactaaatcaagattcaatctctgtaatggaaggtagaaagaagaaggaaaaccaaaaattaaaaacagcttagtaatcataaaacaaaattaattggtaaaaataaaggatagtatttactcacatgcatatatattatgtactgtgcatttaatataacatcatttttaataaataaaagcaatttcataggaatgcttttatactgttgatgggagtgtaaattagtttaaccattgtggaagacagtgtggcaattcctcaaagatctagaaccagaaataccatttgactcagcaatcccattactgggtatatacccaaaggaatacaaatccttctattataaagatacatgcatgtgtatgctcattgaagcactgttgacaataacaaagacatggaatcaacctaaatgcccatcagtgatagactggataaagaaaatgtggtatatatatataccatggaataccatgcagccatataaaagaatgagaatcatgtcgtttgcagggacatggatggaattggaagtcattatc

SEQ ID NO: 16506 - DNA, 628 bp, Homo sapiens
ttaaactcatactttctctcctggagaggagtgaatgaagagttaaatggacccctgaagtaataggcttttgaaaatttttcacatgaaagcatgattaaagggaatacatgtgcattttagatgtttcaacagtatcttaatataccctaaaattaacctataatgtacttaaattttatttttcactcttctggtaaagtcacaactcaagtatttatctatgaaacattttaaaaaatttaaacccttatcaaattaattgctggtgatgtaaaatttacctgctaaataatgtttcagcaatgctattttgtgagagctcacgttttttaataagaacttcaagttacataaaactatgaaacataatgttaacaatatagagatgcctatattttgaatgctggacctccttccattatatatgctccagcaataatacaaaatcccctttcctaataggcttgagtccaaaggaactaaacaacaatattctcaaatgcacttcctttgaccacttttcagtttctcagacaaaaatggtgatgatttttcatcttaaatatttttcacccttttagttttctttccttatataatctataattatacctttgaacacact

SEQ ID NO: 16507 - DNA, 610 bp, Homo sapiens
atattttgactgggccaattagtagctacgctgcttgatcctgagccagttgctttacctctcagaaccttggttctcttatttaagatgagaagattagtatctacccatgagactgttatgaagatgaatatatgttaggcacctggcccattgccctctgcgcttggtcaacagaagtggctcttgttattgtgaacttcaatatgcatgacctatctgtcagtcacttaacatgacttttttttctcaagtgatttttatcttctataacattctcttctcattcttccaaaaaggagctctatgaaagcaattaggggaaggtaaagggtgacaaggatggagggtaattatgaagaactacagagttcttttcatattttgtacataatatcatttctggaaattatatccacattaaaatatcaaaaaaaggtattttcactgacgaatggaaactgtcctgatgtctctgctagttttaatgcccctagacacattatttaactctcctgatctcagtttctttgtttataagaggagtagcttgaatgccttcatctgtttaacatttactggagaaccaaaaataatcaagaaataagct

SEQ ID NO: 16508 - DNA, 640 bp, Homo sapiens
ttatattattgtttaaacatagttttgaaaatatatactaaaaaactgataagcacttcttatgataaactagggtctgtgcttcaaagaacaatatttgtcatttttcagtatattaaaaaaaggtgccttaggctttaaagatgttagaaagaggaatcagacacacatgcacacacacacgagttattgcaacaagatggaaataagagtatatcctatttctcagtctcattctattacagcacatcatttaagcagtttggtaatatgatatcctgagtgtgaaggcaaggtagattcattcctctagatgtttacttctttgattttaaaaactgaaatatttactcctctcatatcaatatcagaaaataccactggccttgaaatcaactttaattcttcagataaatatattgagaaatatctttactatttctgcttcacaaaattccagttcagcaccagtaaagacatataattttataaaccaaggaagacaaagagaatagcagagagcatgacaacagatgggagatgtcagtgaaattatagaagagtaaattagtttagagtgttaactgatttagacgagcagtgaacactgaaatctaagtgttaaaagaaaagccacacc

SEQ ID NO: 16509 - DNA, 337 bp, Homo sapiens
agctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacag

SEQ ID NO: 16510 - DNA, 483 bp, Homo sapiens
gaagtggacgatcaaagttgccaatgacttaggaagccagcagacacttgcttctttcttttctgggataattttgtttcctttatcctcagtattttcaaagcaaaataatgtaaaagatgtatctagaagctaccttttaatcatgtttctgctagtttctctctccctcctctccctttttctttcagtctccctcctttcaggtttttctatgatagggacttaaatattcacaagctcagaacaaaaattgtgggatttttagccttgatgttttttcagatgcctacatcctcaagatatggctgtttatattacagagctgtagtatcaaaacagcatggtactagtataaaaacagacacattgaccaaataggatagagagcccagaaataaacacacacacacacacacacaccctatagtcaatagacttttgacagaagtggcaaccacacacaatggggaaaggatagtc

SEQ ID NO: 16511 - DNA, 98 bp, Homo sapiens
atcttttaattataaattccactctcatttcactatattctactaccttaccatagtgctcactttaactggaccacaagttcagtatagttttcatt

SEQ ID NO: 16512 - DNA, 397 bp, Homo sapiens
aacattagctgaggaagcagagaattcagactattttcatctctggacagaattctatgaattccatctacccattattctttatatctcctacttggatcttaatctccactctggcaattccccataagctaaaataataaatgtgtccttaatcatttatttccaattccttaatatttctataatgattttttatgtgccagtcttcaccattctggtatctgcactcccagtttataaaaccatcataaacactaggcaattctgctctttttcaggcaaaaagttaaaaaaaaaagagcatttttatagtttgtgccacatctatagtaactgggactacatcaaacaaagaattcctggccaggcacagtggctcacacttgtaatccct

SEQ ID NO: 16513 - DNA, 583 bp, Homo sapiens
ctcagtgattataataagatcttattcttattctaaaatttgtctttgtatttttataagggagtaattgctgtcaatcctactgctttctagattgacagccataaacattgactgtatgtagtatttgttcctcctggaaataggtaataaaagtagcgtagcgaatagacgtgttatcttctgttcacaacgttctactttattcttataaatataatcttagcattcttttttttgttgttgttgttgttgtttgagacagaggctcgccctgtcgcccaggctggagcgcaattgcgcaatctcggctcattgcaacctccacttctcaggttcaagcaattctcttgcctcagcctctcaagtagttgggattacaggcacccaccaccacgcccgactaattttatgtatttttagtagacacagggtttcaccatgttggccaggctgctctcaaactcttgacctgaggtgatccaccttggcctcccaaagtgttgggactacaggcgtgagccactgcacctgacttaatcttagcattcttaatgaagacttacagtacataagccatgat

SEQ ID NO: 16514 - DNA, 595 bp, Homo sapiens
ggtgatccactcacctcggcctcccaaagtgctgggattacaggcgcgagccacctcgcccagccaatagtatgatttttgtgaggcatacatggcttgactaaaaaccagtgactgagtcacttatattttatttcattgctgaaatataaacagtttcatatatgagggaataaattcaatcccacctacatttttttctttttcacaattttcggtgcttttaaaaaatattgtcttcttttgaatacatttttagttgattcatctttattgtgaggtatagacacaaaatctcagtctcacagtatacttacatttctaagtttgttgccaagatgtaaaatcagggcttttacataaactagtcagatttcaggtttctgtttaaaacttagaattctagaactaagttaaccaccatcccttcaacaaacgtggcaccaggagcttgtgcaggctgcccccactgagcatggactcaggttttccacagtcctcaccactccctactacctcctactttccgtccacacctctcatttatatcgcccaccggaaactcgaggaattggaattcacagcacctgacttt

SEQ ID NO: 16515 - DNA, 440 bp, Homo sapiens
gtgattcttaggccttaccaataatttgaataatttttcagaaagcactgatattttaattaggtctcagaaccctctagcccatataatataatgtagaaaccccaaatgatctccaagtaatttagtgttgacagttatcctgacctgagatgatctggagttggttgagccctcttaaaccctaatgcaatgttctgttctttacaccatgaacagatccttccaagggcgaaactagttattacaaaaataaattagcctcatgaagagatgaatatatagtagaaaaccactgcttataattggcccatctttcatccatgaattttgaaacaggaaaaaaattaaatatatgtagtctctcaacctaggccctcctcaacctagaattttcactctccttagggttagaaagaataatttcgtggtaagagctg

SEQ ID NO: 16516 - DNA, 512 bp, Homo sapiens
actgttctaagcactttacattattatctcattttaatatcctcaaaaaccctatgaattaaggtattattattatcctcattttacatatgaggcaactgatgcattgagaggttaagaaacttgcctgtggtcaaaataagcagaagagcaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccct

SEQ ID NO: 16517 - DNA, 503 bp, Homo sapiens
atcacctcaagccagccagttgattagaaatattgacaggtattcagagaataaatttaatttgaattccttacacaagcaagttttcagaaggttcatttgttaatcgatttatctggaaatgagaaagccccttttccatagaagtgtaggtccacacaggctcgtctaatataatctcaaataatagatcattttaatgagaaaggtagtaagcaatgcagtgacatcactagtaatgatgcagttttataatcatacctccgtgaaactcaatataaaacctgtccaaatgtagaatgcaatgaaaagtcaataggcggccaggcacggtggctcacgcctgtaatcccagcactttgggaggccaaggagggcagatcacctgaggtcaggagttcaagaccagcctggccaacatggtgaaaccccgtctctactaaaaatacaaaaattagctgggcatggtggcaggcacctgtaatcccagctactcaggaagc

SEQ ID NO: 16518 - DNA, 498 bp, Homo sapiens
tagagtcagctatgtcagatatgtctgtcataattttgcataggtgatttcaagaaaatggatatctttccattccttcacctttttgttctattcaggccctaaatggattgggtgatgcctgctcacattggtgaggtggatcttcattatgcagtctgctgattacaatgcatatcttttccagaaacactgtggcagacacatgagaaatgtgcttgagaagttttgtgggtatcctgcccaagagggctgcctattgggtattgggggaaatgggagatggggattgctgggtcatcagctgcagggataaggggtaaagctggagttggggtagtgtctcccacatcagagaaatggtaaaaaagtgaccccacagagccctccacaaaatgcatacacatattcatgagatggcagacatttcgctttccgtcccaaggagaacatagtcagcaattgtattaaccagggaagcaataatggctatcagag

SEQ ID NO: 16519 - DNA, 539 bp, Homo sapiens
actccaaattcctgctccactacctgtcaataaaatggctttttgtgagcttggtccgggaataggattcttaaattaatatgttgtcacagtttaagaaaatgagcacagtgatcttaagacacagagatttattgtttctggcaaagtcaaacctaaagagaagaaacaacaaccactctttttttttgaaaacgtgttaggtgattttctttagctatacaactacacatcaaacaaggatttgagtgtgaggcaatgtgttagaacattgagtaagacacaatcccagttgctgcaggaaatttaaatagtgataaatgtgtaagaaaagtactgtggagactatggaagaagtgatttattttgcttcacagaggagggccttttgcaataagctatagaagtgtccaaaatggctctttcaagaaaaaatgacatctttcctcagttaccaccactccatcctaatgtaacagcattaacaatagcttttttggcaatatgagaaaagttggtaagatagagtaggaagtctt

SEQ ID NO: 16520 - DNA, 656 bp, Homo sapiens
cgcgtggacgcagcttgatgggggagaaagagctctgggagcagggcttagagcctcgtctcgcctcctgccaactcggtccggcaaggttccgaacctccctgagcctcagcttcctaatctggcaaacatgacgacaaaagtccttctcttttaaggttggtgcaaaaattaaatggccctttactgtatatttagagcacctggctcacggattagtcacctcgctcctgggctcaacagtgttcactgggtccttacagcatcacactgggatccttaagggcaaagaccaaaattagacctagcttaattcctggtgtgcaagtgctaagtgttatgaaatgagtgagtgacaggatgatccagctatgagaaataggagagagtttgcggtgggatagagactgtaccttctttttgtataagatgtttggcagttggggataacttaccggaagcaagcttaagatgcacacgaaatcctgaccaagaggatgtagaaattagatatatggccaagaatcagagaagcaaataaacagatctcaataaaatgtttagtttcgaggttagaggtgggatatcagggtaaccaggcaaaataactgatacaataaataactacatgacaaatcacttctctcacaacacat

SEQ ID NO: 16521 - DNA, 577 bp, Homo sapiens
ggcctcacaaatcttgggttaagaacttctcctctaaaaagagtaggaagtcgaaattgaaaacaggagcctatttactcaatcatttggcttgaagttgaggcaaatgccttatatataggattgtcgctgaggtctccatcttcccaagcaaaggtgccctctgcactcttcttgccaaccaaaccaaaccaaaccaaacaaaaacaaaaaactcaagaaacaagcacaagcactccaattcttgtgcccacatcacagtacattcaaccttaacaccttagaggtttacttatccttatccttaaatgttttctttcttgtaggccactaaggttgggtatgcttctagtaatgggaatacatggggctgagcctctacttgcctgcctcagagcacatatcggaaatttcctagtaccaaaatctgatccctaatttaggaagaagtcaagagaccatgttggaagataaaaataaacgtatataaaccagaacaagatgggaggggagaggatgcaactgggagacagaacaacttgtgaagagacaaatacattacagaaattcataaagt

SEQ ID NO: 16522 - DNA, 470 bp, Homo sapiens
ctgttgggccctcatccctctactgattgatggcctcatgtggctctacatgttcacaattataaataaaactatataaaagtggcagagcttagcttccatctaaccagataaggataaaacagttctaattgacaataaaaggaactttaagtgacatctttcccatgtacctgtaacaaagtcaaatggtagatttttctctgattaaatgtgtattcttgtggtcaccattcactacaaccattaatttggcatccattttgtaaagggcactgtatcatactctgtggggggtgatggaaggtggataaaacagcttctgtatttagagaacctattatctgatgaaatactcaaccagctaacatataataaatatggaacccatacacacaacatgcaggtgtctgtatctatctatctatctagataggtaggtaggtaggtaggtaggtatgtaggtaggt

SEQ ID NO: 16523 - DNA, 591 bp, Homo sapiens
gtagaatgttggagtcatataatgatggtttatggacggaatatatcaacacaaaattgatgtcacatcaaagtgggtttgttgctaattacttgccattatgagataaaagtacaggcctttgatttaagaaaactcattttgcaaatggatatttaaataaaagtaaatacattcactgttagaaataaaactgaagatttaatgtattaagtgactgtcttcaagcagtcaatcaataatgtttatgatacctacactttcatgattttttttattttctgggacaatctgcaatttgtaatctgctcaacttttcatgatgatatgaaattcagtttaaattcatgaaaagcagtatggtgctggtacaaaagcagacacatataccaatggaacaggataaagtgccaagaaataaagccacacacctacaactacctgatgataaacaaagtcaccaataataagcaatggtgaaaggactccctaaatagggatgggataactggttagccatatgcagaagattggaactggaccctttcctttcaccatattacaaacattaactacagatgaattaaagac

SEQ ID NO: 16524 - DNA, 511 bp, Homo sapiens
ggaatcggcgatgtgtgtgtgtgtgtgcacgtgtgtgtgtcctctgatgagatggcttcaatatgttctcacctaatggaatttgcttaaaaatatccactgaggtttttttgtttaacagtttctcaagattatcaattatatttttaggttaaaatataattttataagcataattgtagtcatttttaaagggagagatgcttttaacttgttatgacttttagccagtcctaacatgttaaaatttttctgtggttttgcctgaatactatgaagactacttatttacagaaaaagagagtgaacaagagagagcagtctatactgcctaaaagtgatattttgagtgaactttatttttatctcgaaatctttagtgaaatattagtaactgttggttactaaccagttcatgtattagctatttcaggaaggtgattactttagatttacattgggaattagagaataaaggccttctgtaataaaatcatcaccatcatgaatt

SEQ ID NO: 16525 - DNA, 285 bp, Homo sapiens
gatgtgtgtgtgtgtgtgcacgtgtgtgtgtcctctgatgagatggcttcaatatgttctcacctaatggaatttgcttaaaaatatccactgaggtttttttgtttaacagtttctcaagattatcaattatatttttaggttaaaatataattttataagcataattgtagtcatttttaaagggagagatgcttttaacttgttaggacttttagccagtcctaacatgttaaaatttttctgtggttctgcctgaatactatgaagactacttatttacag

SEQ ID NO: 16526 - DNA, 541 bp, Homo sapiens
ttgttattctcctattactccaaactatggcaaccctaggggaggatcttttctttcattcccttccccaacccaacaaaatataagcaaacaccaggaatgctctgctccttaatcccatacacttttaaaacagtcctcacattagaaaatgatgtgagaaataaacacagatttttttttttctattgagatggagtctcactctgtcacctaggctggagcgcagtggcacaatctcggctcaccacaacctcaggttcaagcgattctcctgcctcagcttccctattagctgggattacaagcgcccgccaccatgtccggctaatttttgtattttccagtagagacgggtttctgccatgttggccaggctgatctcagaagtctgacctcaggtgatctacttgctttgcctcccaaagtgctgggattaccagcgtgagccactgcgcccagccatatttttgtctcatgttgagatgaatgcaaattaaagtatacttcaagaaacaataccaaaataatgcaaaacata

SEQ ID NO: 16527 - DNA, 399 bp, Homo sapiens
gattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcg

SEQ ID NO: 16528 - DNA, 171 bp, Homo sapiens
taaatttccttttaattataaacctattatgattggaagggatattagagattactgagttcaaactcctcatttgacagatgaggcacaaatgcccacacaggctcagtcatttgcctataataagccacaagcagccaggtacagtggctcacgcctgtaatcccagca

SEQ ID NO: 16529 - DNA, 590 bp, Homo sapiens
tgggcacagacgtgagtgagtgtgtgggatgaggaagaaatgtgtggaagttcttgtgtgatggagcaaaagttcttaagtgcagcaggtgaatttgctgacattgcgttgatttgttgggatagggattgaggaaagttggtagaagtttagaataatcactgagggaaaaggacagggtttgatggggagactagagagaaacatgaagggttgcctgtccaggaaagttggtgtccaccaaagttggagtctatgaatatctaaagtcagatattcttgtgatcgtgatatttattcagcttttgttgagcttagtagtttagaagtacaggaggtggatgattccattgcttaaaggtttggttttataaaagttctgtcagaaggatgaaagagcaagagacttgaggttaaaatgttccaagagtgtttgaagaaatgaactatgttattctaaagatgtccatagaggctgggggcactgtggctcactcatcccggcaccttgggagcccaaggcaggaggatcccttgagcccaggagttcaagaccagcctgggcaacatgatgaaatcctgccactacg

SEQ ID NO: 16530 - DNA, 670 bp, Homo sapiens
agtctgattcaaggtggatctttcaatgaaaggggaacatgattaggattaagtaaggataaagataaaataatttatgacctgtgaacacaacaagatgaagattttcaaggtgaggattttgaggtaagtgattcgaaaagtcttggggtataaatactggcttggtgctatttgttggagagttcagtgttcagttaaaagggttttatgagaagttcctgaaacaaacaatatgcttatttacacatatcttcctgggcaagagtactctggaatagtaaaatcagattgatgaaggcagtggaatggtaaagtcatattagtgtagcagctaaatagtaaagttatgttaatgtatgcattaagttttttgggtgtatgtggtttgggttctcagtgtcatctagccccccactcacatttattgttcttgttattccctaaaatagtttaatttattgtttatttttaaaagttgccaatggtatccaggttataaacacactctgtaactaggtaaaatctctaataaccagaaatctcatatacattctattttgtcttatattttcagttgttctgttctttgctttatcaggaaagccaaggaaataactctcatgctaaaaattcactgtcggacgctctggaataaaaaaaaaaaaaa

SEQ ID NO: 16531 - DNA, 621 bp, Homo sapiens
cccgattctgaaaccttctttgctcaattaaactctgctaaatttaatttgtctaaggtttttcttttagcaacgttcatggagcttcactttatagggacagggaatattaattgtcagaaaacaaaaatgaaatacagaaatagcttgattatttacagcttggctcagcatttaccacatttgcacatggtctgaccagttaacagactatgattggcttaagcttagctactatgattggctaagactaagccacaagttacaaaatatactcttaatttagattgcagtctgtttacacactatgttaggtaaggatgtaagtacagaggcagctttaacaatctaatttaacaatattatctaatttaacaatattatccagtggcatagaaagaataatgtgactttaggtttttactaaataaataaatgtagaaatatcctaatagaggacacagtggccaaagtatactccaaaaacatacaagtcataataagatttaagtgagattttaatgacaggtttttaaaaaattgtcttaagaataaatcattcaaaccatggtaaaatagttgacaatcgggaggctgaggcaggagaatggcatgaaccca

SEQ ID NO: 16532 - DNA, 516 bp, Homo sapiens
tacagacagcacttggctggggttagtgagtttcagcagaatgcatctcttgcactgacgtagtggagaaatgtttgtccttgggttttgtttttgctgaatctttccttcatattacctgcttcttggtccctgaaggtagatgtctgcccaagatagagccatctgttttaatttctccccttgccttttcctcttcctattacatttgctggcttacgtatcaaatcaggcttgtgttcctagtctctaaatagaagtgcctcctcaaactactctataaatcattattattaataacaaggataataatgataatactaaatagcactcatgtaaaatcttccattacaaaatgctttcagaaatagtacctctgggctgctggtttatataggaaacacaaaaactgattaaaaaagatgacttttctagccaaaatgtgtttgcttttctgggttaaattcatttgtttgattgaaaattttataaagaaggtgtgtattggagaggtct

SEQ ID NO: 16533 - DNA, 621 bp, Homo sapiens
atctccccattcctggagcccccactgacacctgcctgtgtccacccagaatactggagtgacatgacactggttagacacagcagtacagccgggtagccaacataatgtcctatactctgggaaataggcagtgcagcgcactagggaggctgccctcaggacacaggatgctgaagtgtgcgttcaccagagcctgagagctacttgctgaggccactgccactgagagcaaccttattcccctaatctcagcagcaaggctgcaacacatgccctgaggataggctctccccacacaccactgccccagtcgctgccacttgagcatgccacccaggagcctggggatagccctgctctgcccaccatagcctgcatctgtacataccactggaggacctgagggcaggcctccccagcctggtattgccaccattactgccatcactcacaccacacacactgcctaggggcccgaggacctgcacacaaaccccgcccactgctgtcactgctggcacctaagtaagccacttgcaggccaaggaattggcctgataccactgacactggtacccacattcactgcacagaggcccaagaacaggcacacttggg

SEQ ID NO: 16534 - DNA, 528 bp, Homo sapiens
ctagttactctcagatgaaataatacacatttgtttcttctcaaacaaaagtccattcactgctcaaacaagctggaggagaagaaactagcttgaggatggcagacaaaagtcggtgtatccacatgtgacagcttgcagattgtgggcatgctatgacatattcccaaataatattcatcagccatttcttccaggtctactgctttatatatattgaccatatcatttctgaatatgctcattgtaacatccatttatatgtttgaatttttaaatttatctgaataatataactactttagcccttacgatgttcggttatcttagagatttaaaaaataaatataaaaaaagatttaactaaagaatatagctcagcttaacattgcattattttttgtttaagtatctgtatatttctttgagtgcctttcttatctggtattaggggtagatttatgcctctctgttaaactcattggagagattaatggtagcaataacagttacagaaaaaaaaaaaaa

SEQ ID NO: 16535 - DNA, 87 bp, Homo sapiens
atagatgagatcttctgctccttagctctcttgctttaaaaaagtgaaggcattgcgtctagagcacttctaggaatctgactggat

SEQ ID NO: 16536 - DNA, 276 bp, Homo sapiens
acaataaatctgttagcatgatttgatctgataattctacttttgagattttatcccaaggaaattatatggtgcatgtatcagggctttgggggatgggcgaggagcataattttacactggcaatgggaacatcgttagggttactgccaaaaaagtagggggtgggagtggcataaccaagtgtctgttaatagaagaatacagtatagttagtaaaagtaatacacaaacatctagatttgtcaaggaagtaatacttgggaagatagtaga

SEQ ID NO: 16537 - DNA, 480 bp, Homo sapiens
aacagtcctgcctacacaaacatcaagtgaattactattctaataccaccaaggtaatctcaacaaccattttctggggtcacacaatgacaccaaatttcttcccagtgctttttaattcaaaggattctcttgcaacccatcaaggctactcttgattattgataagctcttaagatgttacaataacaaagtatattttatttagaagtttacaggcttcaacaaaccctttttctactgcagtttgtgcctttctgtcctttgtgtcctaccctgtggccacgaattatatgaagaaaaagtgaccctcctgggttgagaggggtgggtgtggaagggagagatgaagaattctacctaccactgtcctaagtttcaatttataaaaaaaattaaaattcatgaaataaaaacttattttccccttccaccaaaaatctacaaacacccattaaaatgaggacatcctataaacac

SEQ ID NO: 16538 - DNA, 433 bp, Homo sapiens
aaatccagtgggaaacagaattgtgggctgccagtcatgagggagggagaggagtattgcatggaaataaaactgacacatagtgtggatgggatccaggggagaaatgcggagcatgcaaaggagtcagctgaggacggaaccacgggacctctgcactcgggaggctggaggaggaggaagatggcgcctagaagagcgagttccccgggagagaggtcagggagcgaggagaggcaggaaactgcagggaggcaaggccggctgcaggaaaggagcccggaaacctcacacgctcataagcaaactagagagtccagaaggccacagagaagacccaggtgggctccaagggcaaacaggtcccagacctgaaggaccagacatctcttaggaagcccctgtcccagcagacaaggagagagagcctgtg

SEQ ID NO: 16539 - DNA, 612 bp, Homo sapiens
acacgtaaaacagaacaaagctaagagaactaagaccaggaatgaataagataataaaaacaacggagctccgcagtgatgagagtgagggaataggggaagaaataaaagaacttatttccactcacttataaaagggttagacatgaagtcaacataatagactttttaaaagttcaactaatcaataaattgtgtgaaactcatgtctaacacaacaatgtggggtgtatttattatgaagtagaggtggtagtgagttgcttttttatgctgtaatcagctttatctttgaaggtagttttaatatttttcagtagagaagcgagagtaattcctggagaactctagcacaacacacttgcattacaacctttactaataggtttaaaattatagtgattatctctaaatacagtgacctacatgtttaatattgttcagattacattcttttgttaaaattagctttctggagttcctgccacactgaattagagccacatccatctatgccgaattggatatcattaaatatctggatttatgttattttctcttggattattttaatcattatcctaaaatatccatacactcttaatgcaattt

SEQ ID NO: 16540 - DNA, 546 bp, Homo sapiens
agttcccatgtttagaatttgctttatagatgtactcgcaaaattatgtcaagattatgtaccagagttttttgcagcacaattttaaacaagaaaaacaaccttaattctgtcaatgaaataccatgccggccgcgcacagtggctcacgcctacaatctcagcactttgggaggccgaggcaaatggatcagctaaggtcaggaattcaagaccagccgggccaacatggtgaaaccctgtctctactaaaaatacacaaattagccaggcatggtggtgtgcacttgtaatcccaaatacttgggaggccgaggccagagaatcgcttgaacccaggaggcggaggtagcagtgagccgagatcacgccattgcactccagcatgggtgacaaaagcaaaactccatctcaaaaaaatatatacatatatcatgccaccatgacaaagaatgaagccgactggcatatggataatgtagaaagagctccagaataaaattgtatgtgaaaaagtaaggtgcaaacaatgtgacactattattt

SEQ ID NO: 16541 - DNA, 384 bp, Homo sapiens
tggctcactgcaacctctgcttcctgggttcaagcaattctcctgcttcagcctccaaagtagctcggaaacccccacctgaacccaatatggctaccacaggcacctgaaacgatgcaacagagagatttgtacacaaagtaaaaatcataaaatacagttccctttagtctcaatctttatgttatacatcccatattttgtcacaaagaagtgtaagttaacttcatactttagtaatgcctaattttttaaaagaagaaaataaggccgggtgcagtggctcaatcacctgaagtcaggagttcgagaccagcctgaccaacatggtgaaaccccatctctacaaaaaacacaaaataaaaagtagctgggtgtgctggc

SEQ ID NO: 16542 - DNA, 597 bp, Homo sapiens
gtcgtgttctgcactggggaagtttcaaatacagacattccgctttgtatcattgccaaactggaagtgattttgtgttttattcaagcatttcaaccacgctctgattagaaaacttttgatttaccacgttctgggaagaaatgaattatctagagcagagataaacctgtggtctaaaaatgggtctcagtggtgtccatggaaactgaaaaggtcacatttgtgtgagtgactgtatggtttgcagatgggagaggatttaaaactttctcagattctcaaatgggtgggtgaccccctcagtggttaagagctatttcctgcataggaaaagagttcactcactggctcttggaatttcatctcgcatgttgctcaggtagtttaatagaatttacgaaggggccacaaaggagtctaatgtcagtcactgaagagtaaaaattagaagctgatgagaaaaggccaggtgcagtggctcacgcctgtaatcccagcacttagggaggtcaaggtgggcaggtcacctgaggtcaggagtttaggaccagcctggccaatgtggcgaaaccccgtctctactaaaaatacaaa

SEQ ID NO: 16543 - DNA, 559 bp, Homo sapiens
cctccagaacatccgggtcactcctaagaatccaggatccagacccagtacacacatatcaggagctcagatttcccacatcaggaagggaaataaagactactttcttaggccgggcgcagcatctcacacctgtaatcccagcactttgggaggccgaggtgagtggatcatgaggtcaggggttcaaaactagcctggccaggatggtgaaatccagtctctactaaaaacacaaaaattagctgggcatagtggcgggcacctgcaatcccagctactcgggaggctgaggcagagaattgcttgaacccaggaggtagaggttgcagcaagtctccatcgtaaataaataaagtctatattctttgagggcccaaacaagatgctttcaaaggcccaatcttccctcccttttaaaaagtgtgctctcgccaggcgcagtggctcacgcctgtaatcccagcactttgggaggctgaggtgggcggatcacctgaggtcgggagttcaagaccagcctgactaacatggagaaatctcatctctactaaaaata

SEQ ID NO: 16544 - DNA, 583 bp, Homo sapiens
gcatgcccctagggaggtgggtgtgatcagttttttaacaatttttaaagcttaaggattcattaggaaatttgaggcttgttataattggacagtaacatcaaaaaatcatctacagggagtagtttttttcttttttttttctgagatgaagtctcactctgttgccaggctggagtgcagtggtgcgatctcggctcactgcaacctccgcctcccgggttcatgccattctcctgcctcagcctcctgagtaggtgggactacaggtgcctaccaccacgcccagctattttttttttgtatttttagtaaagacagggttgcaccatgctggccaggctggtctcgatctcctgaccttgtgatctgcctgcctcggcctcccaaagtgctgggattacaggcgtgagccactgcgccacgcccagggagtagttttaaagttaattttaaattgctggtaagtaagaaacgcattctactctggctgaagagcttacagcccccccacttgcaagtacccctgaccacagcacccgtgccctcggagctcccctcacccacaaactcagctcctccc

SEQ ID NO: 16545 - DNA, 523 bp, Homo sapiens
ttcttccacttactgacaaagacagcccatgtatactctccaaatctcaatttctttgttgtaaaatggtggttctagtgcctacttcaaagttgttgtagggattaaaacagataatatatgtgaagaatttttattcttcttctattattcattgcttagcatataacagatattcaatgaataatatttgtggctatagttatggaggaagagaaggatggtttactagagtgatcttttgagtgcaatgatcacgttatttaaacttgtctcctcttagatcgttactggaaacactgctaagagatgtacgattgtaaggcaacctgtcctgtactctgatatgattaattacaccattccattaataactccgtggagaaaagtgctacatcctgatatcttctgtatatatgaatggactttcataaaaacaaggccctgtttaacttggtcatttcctgaaggacatgatttaattaaatcttcttttatacttaattccaatatcatgtggcac

SEQ ID NO: 16546 - DNA, 490 bp, Homo sapiens
accagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatc

SEQ ID NO: 16547 - DNA, 511 bp, Homo sapiens
gatcctcaccaatgtgggtgggcctcattcaatccattgcagacttggatagaactaaaaggaagaggaagggcaaatttgttggctgcttgagctgggatattcatctttctcctgatcttggacatcagaactcctgattctcaagcctttgggtttggactggaggcaccagctttcctgggcctccagcttgcagatggcatatcatggaacttctcagcctccaaattcataactctaatacaccagtacaatggaaagattcctaaattcaaaagccagaaggctgggttcctgttcccaccctgccttttaccttctgtgtgttcctgatgaagacacttcatgctccactatttacttacctctgaaacgaagggctgacccagatcagttgttctctgacctgcttggagggactcagaggctgtggagcaacagatttgggaatgaggaatcgttccctggaagagtcagagcgctcgtagacacattctgctggattgca

SEQ ID NO: 16548 - DNA, 508 bp, Homo sapiens
gcctcagcctcccaagtagctgagactacaggcacatggcactatgcctgctaattttgaaaaaaattttgtagacatgtggtgttgctatgttgcccgggctgtctctaatactcctggcctcaagtgattcttttgccttggcctcccaaattgctggaattacaggcatgagccactatgcctggccgaataagaaatttctaatggctgcacacatctttgaaagagctgagacatttcaggaacaaactcgtgtgatacagcccattacctgaaccttccacttgcctacctattagtcttcttttggaagatgggagatttttctcagtgcttagttaactttcccttaagcataagtaattttctaagccccttcttggtatctcactccctccgtaattgattaacattaaaacaggggcagttacaaaagctcaagtctagcatttcagtgttactttgggagacgctgcattgataatattgacgacaatcatttctc

SEQ ID NO: 16549 - DNA, 444 bp, Homo sapiens
gaaaagatcaaggtatatgctgaattacttggcatgcaccaaggaaggatggccctgtgctcaagcaggaatagagatgttggttgtactgcagggttacctatgggattgctatggggctttattaccctgaacagtgtctttggcctatacagccttccttaaagctctacttctcagttattgcccttgattgcagtgccattaggaaggagagttaaataccattttcttgccattgctgaatgcaatttgtgatcaaatgtaaaggtcagggagcaacaacccctggcacctgtgccagaggctcactgaaacaagctcattggtgaatgaacgaattgagattgccccttcttttggcgtcttgagaagctgcaggcagtcattcctactcctttagaagtgggcgttatggtgtgtacctgagagctcaactctgag

SEQ ID NO: 16550 - DNA, 474 bp, Homo sapiens
aaagcccaagttcagctaaggtcttgtaggtaaccaagccctggctctttccactgctgctcactgccgggtgccctgagcacaagagcagtccccgtcattactcccaggcccactgttatgggcacgtctgctttccacagactgcctgtatccaagggtagagcccctcttcctcctcttgcatccaggtatcctgaagtttccacagctcctgtaaacttggaaacaaggaacccagcccctcgggtgccccaaagccatcagtttctcccttgctgcagtcacccaggaatccacctgtaaggaatatgacttctgtgtgctctcacagctgtgtacatcgatcaggtcaaggacaatagtcaatctactgacaccactttataaagcttgctacagtttaagattatcatgctgagaccagcctgaccaacatggagaaaccccgtctctacttataacacaaaattt

SEQ ID NO: 16551 - DNA, 312 bp, Homo sapiens
tttagtctagggttaaatagtgtgattgcttataattcattttattccaaatctgtcttttttcttctctattttctcaacttgtctccgactgcatttataattggtgtcatttcttccaagatggtgccattaagttgtctttcagtctttaacttttaggttttgaattttcatctctttcttgggtttcttaatgtattttttaagaatcttggaagagcagtttgaaggcagccaaccaaatgccattatgagcaatacatttttgctcttgggatttttttaacctagatttaaaaatctcatctt

SEQ ID NO: 16552 - DNA, 398 bp, Homo sapiens
agaacatcagtagagattgtgccaagcttttccttaaaattttttggtaagtgtagtcaaatgggtgtaggggatggtggtgaggggggagatgggaagtttttaatcaagggatcacactgatgagtggtatgatccagaaatgtcttttctagcaccaaagttaggattaactggagaagcaagatgctggaggcaggaagaccagaaaaatagttcattgcaatagttcatgtgggaagtgagactaccgcaaaacaggtcaatggcagaaacaaaaaggaggaataagatgttataaattgaggctcgtttacattcttgaaggcagggcccaagtcttacacctgcagcactaacacaatgccttcttgctggcagggactcaatttatagat

SEQ ID NO: 16553 - DNA, 455 bp, Homo sapiens
gtcaagtacttaagaaagaggaagatactcatccagaaaataagaggagcagggccaagagaagtgacagctgtgccccctcctgactgtaggagaacagaggctgtgtaggggaaggagggacctagcaacagaagatcatctgacagatctgagcacttagaaaagttgttaggaggccaggtgtggtggctcatgcctgtaatcccagcactttgggaggctgaggcgggtggatcacctgaggtcaggagtttgagaccagcctgggcaacatggagaaaccccacctctactaaaaatgcaaaaatcagtcgggcatggtagtgcatgcctgtaatcccagctacttgggaggctgaggcaggagaattgtttgaacccgggaggggaggctgcagggagctgagatcacgccactgcactccagcctgggtgacagagtgagactctgt

SEQ ID NO: 16554 - DNA, 443 bp, Homo sapiens
aagaaatgatttttaaagaagacttaattaccactctatgtgtttttaatgctggctgaaaatacacaagaagacaagctaaagtgacatgtgacaagttctcatttagtctgtcagccatgatagcatattcagaaagataaacaataaaaaaaaaggatcaagagataaaggtagatcctcccatgacctcaaaataattatagtatttgctggtgaggccaaagtttctgtacacagatacctgacatagacagctctatggaattcaagggaaaattaggggaggggacaggtgacaagctcagtctgtggtattaatcgagtagtattctgactgagccccatctgaatttttatttacccattctaatatttcctggaaactaaggctttttacttctctctcagtctactcaaaatgaactactccccaccccaag

SEQ ID NO: 16555 - DNA, 497 bp, Homo sapiens
acaacatgcatgaacagatgaatatgtaagcagagagatataaacttgatgaaagcatcagaaaaatgtactagaaatcaaattcactgtaattgaaataaagaatgccttggaggagtttaaccagtaaactggacacagcccaggaaaaaaatcagtgagcctcaagatttatcaataaaaacatcccaaactgaaatggagagaataaaagagtgagggaagaactcacagaactgcaaacatgaacttacaaatatattattcttggagaattaaacataactctaccagtaattgtcagattaagcatgcagaaaatcagtaaagacatagttgaactgaatagcaccattaataaagtaggtctcattgacatttatagaatataccaactaggttataaaacagacattaataaatttaaaaaaaggaaagcatacgaaatatgctcttagactacagtggaatttattgaaaattaataacaaattata

SEQ ID NO: 16556 - DNA, 318 bp, Homo sapiens
attgccaacagaatactaacatttttctctttactccttttcctccaggtcctcatagataatttattgagcaatctgataactaaatttgagttatgaaactaatgcttaagagtattttctatttcatttcttccagatatgttggtaagacccgttcatatttgtttccaagtcataaagaccaaatcatgtttacagggtcataaaggagataacttcattttgagaatattttcagttgtgtgtactctctgaaaagaagattaattctatgtgatagggaccagtgtaatttttaaacactaattgggcttg

SEQ ID NO: 16557 - DNA, 456 bp, Homo sapiens
agataaaatatttgtttatatagtccttcatctaaaccttgacacctgtattcattcatacatgaaaagaggattattgtaggtacaggactgtagcaatggaaaaactttcttcaaaaagtcagctttcatggagaaagagaaatgggatatgaaagaaccttaagaggttaaaaaaaagtggaaaatatgtcacattatagtgacttcattcccatcttcccatgtagaaatcaaccacccaacctcccatccattccacttcctacattgctaaaatactagtgaataaaatgatctctttttaaaattagttttgtattactccatcattctcctaaccagtctttctttctctagtcttacttcatcaatctgtttattaatccatatttcagacttcataaactttttaaataaaatatattcaattaaatcccttcattgcacctacat

SEQ ID NO: 16558 - DNA, 442 bp, Homo sapiens
gagagattttaaagacactagaagtggctatgtacagataacttttttcttctgcatgagaaactgaccttgggttcaatcacttttctgtgtctgttctccccttgataaagaatggccatcggccacacaccaggcacctaggcttgggggactttgtatgaactgaaatacttcataggaagacagttttgggctctcctgaccatgctgactcttgtaactgagcatgttgttgtgggagccaccgtgcaaggattagtataagagatatcggttcttgtggagcatgcggcatctaaactagcaagggaataagagtcatacctggcaggtggtatgagtcttatttccttgcacctttgttgtcacttggacagctcctgggcaactatatgaactgctgtgagaatgacttgcattgaagagaaatgcgtcatgc

SEQ ID NO: 16559 - DNA, 375 bp, Homo sapiens
caaggatgtcatcactggtcctctgaaacattatactagaagtcctaatcagtgtaatagggtaagaaaatgaaataaaggcacccatattagaaagaaagaagtaaaactggctttattcacagacgacaaaacccacaataaaactaccaaaactaatgagtgagttttgcatggtttcaggctacaagatcagtattctacaatcaactgggctcttatatactaacaatgccaacttaaaagtttaaatctttaaaaaaatagtatttaccacagcacccaaaatatgaaatacttaagaatatggctaaccaaagaagtattagacttataccctggaaactaccaaacattggtgaaagaaatgaaaga

SEQ ID NO: 16560 - DNA, 350 bp, Homo sapiens
accaagtaggactctatgtgttatgttatgaagaaagatgttttgctaacgagatccacacatatctttgatgttcaaagtgggaatatagtgtagcaagaagaaaattgttgaaaatatttccaattgtatatgttatgcatatcatctaaacataaacatgatgcattgaaaaaaatactgttggcaaagcaatttagaaattccagaaaataagccaggcatggtagtgtgtgcctgtaatcccagcactttgggaggctgaggcaggcggatcccttgaagtcaggagttccagactagcctggccaacatggtgaaaccctgtctctactgaaaatataaaaatt

SEQ ID NO: 16561 - DNA, 358 bp, Homo sapiens
aaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatg

SEQ ID NO: 16562 - DNA, 518 bp, Homo sapiens
gcttaatacccggatagtgaaataatctgcacaacaaactcccatgacacaaatttacctctgcaacgaacccgcacatgcaccccaaacttaaaataaaaattaaaaaagaaaaaaatagttatatagtaaagaaaaagtagtaagtgtcagcgggagacttcaaaattatgaacaaagtaaaagaggaacgagggtggggtgtcagatctaaataaaagaaatacaaaaaataataaagaaacaacaaaatttgccaaaaatatccatactagagaaactacttttttaataatcatgaaaaaagcatgattatataaataaaagaaaaaagcaatgactactaaaatagaatataaaacaataaagaaaacctgtagtaaactaagaaattgttgagaaaatattattggtattttcaaaaggcaaaattgaagtggcagtattaaaaaagggttgttgcacactgtgtatatttaaaaggcaaattagaaaaatggcttaattacctatgtagc

SEQ ID NO: 16563 - DNA, 535 bp, Homo sapiens
tggctcactgcaacctctgcctcctgggttcaagtgatccccctgcctcagcctcccaagtagctgggactacaggtgcacaccaccacacccagctaattatttttgtattttagtagagacagggtttcaccacaggtgacacgggtgtagtagatgacggggttggccaggatggtcttgatctcctgacctcgtgatctgcccatgttggcctcccaaagtgctgggattacaggtgtgagccatcacgcctggccaaaagtaaatttatagtgaaaatgttttcaatatctaaatagaaaaaataaaaatagacagcataaaaagaagaatcagaagaatttttaaaaagcagatgtgagaaatagaaagaaaaaataagtaataaatataaatgcatattaaatgatgaataattctaagagctgattcttcttaaacgcatggaatgtcaaataatatattctaatgaatctaatgaagttagagagaaaatgcagaaagtatatttgaaaagagaatagtcataaca

SEQ ID NO: 16564 - DNA, 486 bp, Homo sapiens
ggtgacaagcaacctcgggccacaagcctttgagtgtagtgtcctatgggtcccagggaaattggaaggggtattgcagtcattttagtcacatagacacatgccttttcaatatccaatgtttgatggaagccatttgggggcactctggcaactgggttttcacaaattggattttgggacataacagacagtaaggaggtattttacaaattgtccccaccatagcataaaaagattactttaaaaagcatctcagggctgggtgcggtggctgacacctgtaatcccagcactttgggaagccgtggcgggcagatcatgaggtcaggagttcgcagaccagcccggccagcctggtgaaaccccgtctctactgaaaatacaaaagttaggtggattgcctgaggtcaggagttagagaccagcctggccaacatagtgaaaccccgtttctactaaaaatacaaaaaataagctgggcat

SEQ ID NO: 16565 - DNA, 395 bp, Homo sapiens
cgcatactttaatacatcacagaatttggcagaaagaagattttaagcaattgcctggtggcactgccactagcctaggccaaatcagaagctcttccctgaccagcatctcatgaaagtgctatcagtgaggcttcagttgaggtgggccttcaagagttgtcagtggaaggctccagggcctggactttcttgctcccaagaggtaccacaagggtaaatgtacccagatctggaccaacatctccttccagcccaacttctaccttcccttccatcatggaacagtaggtgcagcctggtgcacaagcagatggtggactggaaggtacatcaaggtaatgcatgggagatggagatggccagctgactcgcaactcaccttgagggagcag

SEQ ID NO: 16566 - DNA, 173 bp, Homo sapiens
tgattcttttctgggggcacatatttattacatgtttaatttttagaaaaataatacaaacaggtcacacgaaattaaaaaaagtagagatgagggcatcgcagacttggcctcccaaagtgttgggattacaggcgtgagccatagcgcctggccaaaatgcaattcttgac

SEQ ID NO: 16567 - DNA, 538 bp, Homo sapiens
agagggcagggcttacagggctgtcacccttattctccgctgagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagac

SEQ ID NO: 16568 - DNA, 428 bp, Homo sapiens
agggttcagttgagtcttttgcttcagcctcccgaatagctgggattacaggcacctgctaccattcctggctgaccttttgtattttcaatagtgacggggtttcaccatgttggccaggctggtctcgaactcctgacctcaagttaccagcccaactcggcctcccacagtgctgggattacaggcgtgagccaccacacctggccagggtataataaaatgcttaatagaactagtctaccctcaaccggaacaatgaaaatttagtcactgaagtaagtcaaagaaacagtttcactgatgagggaatcattctacatgaaccataaacaaggcaagaaactcattaaatatatctgctgtggtgcaatgtgccctggaactacaatggttactactccctcaatattgcccttagtgaaagc

SEQ ID NO: 16569 - DNA, 498 bp, Homo sapiens
cattcactttctgatttagaatttcttcaaaattgaggaagattggaggatagacaatttctttttctttaaaataaattattgaatgataggaagacctatccagatctgatggaaaagctgagcacctcttggagatgctccatattagattttgaacaggatgcattgggatgtgaaatatccagcttgattctcttgggaaaggtatgagagttttgctgtgggcgagacaagggaaacagatgctttggcagtgatcagaagggtggactgagaactgagaacactgtccacctttttctctttttgggcacacagctagactacattttacaacttccctgcaactacacagaggtgacatccagccagtgaaatgtgagtaggattaacttgcttaatgcttagaactgacccattaaataacaaatctcccatagataatttgtaattctctttttctatttgtagctgtgtggaaagacttcaaagaac

SEQ ID NO: 16570 - DNA, 519 bp, Homo sapiens
gaactcctgacctcgggtgatctacccacctcggcctcccaaagtgctgggattacagctgtgagtcaccatgcatggcctggaatctggatttttttcacaaactttctcagagaattacacctgactccactgaattctacaagcccagattttctatttttgcttagtaattctagtgcctgttacgtgctaagtggccagggccagattaaaatgttagcatccaaaggtattaaagaaattatgccccactcgttcccatgtataaatcaatatgaaatgataataaatagcaaaaatacatgaagagggctgggtgtggtggctcacgcctgtagtcccagcactacgggaggccaaggcgagcagatcacctgaggtcgggagttcgagaccagcctgaccaatgtggagaaaccccatctgtactaaaaatacaaaattagccgggtgtggtggcacatgcctgtaatcccagctactcgggaggctgaggcaggagaatcacttgaaccc

SEQ ID NO: 16571 - DNA, 481 bp, Homo sapiens
cacctaccaacatgtcttattaattcaaataattcattccaaattttcttcaatgtttaatgtacaagtcatgccatctgtaaatagcagatttgttcttctaatatttatatactttatcaatagtctttgtttttatactctaggaaatcaacagaatgtgacaccacaggttgattaagaataccaccgtggaagacagtgtggtgattcccgaaggatgtaaaactagaaataccatttgacccagcaatcccattactgggtatatacccaaaggattataaatcattctactataaagacacacacacacgtatgtttattgaagcactattcacaatagcaaagacttggaacaaacccaaatgtccatcaataatagactggattaagaaaatgtggcacatatacaccagagaatactatgcagccataaaaaaggatgagtgcattcctttgcagggacatggatgaagct

SEQ ID NO: 16572 - DNA, 515 bp, Homo sapiens
ttccgaaaaatatagtttcactttctatattatccaaaactattccaattagtaacttgtactttaaaaaagacaactgttttataaaatacactaaagagatttaagagaatttaaaggtcaaagttacataattacattctgctcttcattcagtgctctgaatcataaaggcatattctcatctctttttttactcaccattctcaatctttaaaaaaaaagaacatttggctgggcatggtggctcatgcctgtaatcccagcattttgggaggccaaagagggtggattaccagaggtcaggagttcaagaccagcctggccaacatggtgaaacccagtctctactaaaaatacaaaaattagccaggcgtggtggtgggtgcctgtaatcccagctacttgggagggtgaggcaggagaattgcttgaacctggaaggtggaggttgcagtaagccaagatcgtgccactgcactccagcctgggtgacaagagtgagattccatctc

SEQ ID NO: 16573 - DNA, 522 bp, Homo sapiens
tcttacttagttaatattattgtgacttcaaataagctaagctgtggctaatgttttctcatctataaaacagttgataagagtacccatttcataggcttactgtgaggactaaatgtattaattagaattaagtctaaatttttgagtaccatgcctggtacatagcaagagggcattaaagattaactgttattattatttgattatagcaaatgtattactgaataatgctggaggcagagagatttaattcctaatcctgtatttaattcctagtcctagaattttttagttaatgatgttgagtatgttagttaacttgtttgagctcaatcttaacagaaatctaatagaattgttgtgctgaataagctagttatttaatgtaacttattagtacatattttgtcattattagatgtgtggtaaatgataggtcaaaaaagattgtaattaatggcagagaagtaaagtagttgcagataacaactgtaaaatgctggactgaaaagacactga

SEQ ID NO: 16574 - DNA, 506 bp, Homo sapiens
gagagtttgagtttcagtccctaaagccaggggcaagtttttcaagagacccatactgcagggccacattgtggactatgtaacttcagctaatttcttggaaatgtgagtataattgtctctgcattttatatatttaagtgatatgatgtgacagcatctgggttataggatggggggttctgaaccatgagaacccctaaatttgagaccgttttgtgtcaggatattctgagctctgtctcaagggattttttcctctgacccacagtgcagaattgtttcctgattaggctgtttcaaagctaaaagggacaaaaatagggctgagcagccagccagccaaatgtaccttttataaatctatctctaaacttgtagagaactctaacaatggtttcattaatttaacaatcactcaatgtcatatctattataatgtactaagctcttaagagagaaagaaaaaagaaaattgttttattcccgtgatttaatttaaaatg

SEQ ID NO: 16575 - DNA, 530 bp, Homo sapiens
gttacttttcaattcctaggaaattgaattctcttctacttattttcagatcccaactcaagtaacactttctcacagaagctatccctacataataatttgtagttatgtttagtagtgtgattatttgtttaatgtttgtctctgtcactacactgttagttccatgagggcaggaatcatttgtccaccatagtatccaatctggcacagtacagcaacaaaagaagtatttgctgaatgaataaaatgagtgtgtgtggctggttgggggtgggtgaatattaatgtgaacataactcctcaaagaaagtaaagaattgaaaaaggagaaggaaaagagaaaacattttattatgaatatttcaaaattgcaggaaacacactgcaaatccccggggagccacttcctatttcaatcaaacccttattcaacattcttggttcctttttgttttaattgagatataatacttagatctcaagtattccattgacgggcgcggtggctcacgcctgtaatcccagca

SEQ ID NO: 16576 - DNA, 605 bp, Homo sapiens
ttgactcatgcatttgcaattaaaatatttatgcttgtgtgtgtttatcaggatactcaatccaaaccttattcaaactaccacagacaagaaatgtgggaatttcttggcttctgtaattaaaacacagagagggtgtgatgcagctaggtctcaaggacaactggaagcattgatttcagtgccactaagactgtcttcccatctacctctgttttctttgcctatcagtgtatttctcttatatgtgtttcttttgcaagaatgaaaagtaccacccctggcaaacttcaggcctcacatgtctctatttcagcttcaaagaggaagtgaaatgtcttctttctgatgcctaggaaaagaatcctgagatggggctacggttatattggcttgagtcaatttttgcggctgggaagttggtatcatcaggaaatatgaaagctttactgaaatcacatgtttgaaatttggggaaagatttttctataagtgggaagagaaaacttggcaaacagttttatgtactttatatgtaacactcacagcaagctaaaattcttttaaacttaaaaaatctgtttttaaaatggtactacgaagca

SEQ ID NO: 16577 - DNA, 604 bp, Homo sapiens
tggcacgtgcctgtagtcccagctactcgggcggctgacacaggagaatcgcttgaacctgggaggcggaggtgcagtgagccaagattgcgccactgcattcaagcctaggtgacagagtgagactccgtctcaaaaaaaacaaaaacaaaaacctgatatagagccttatggtcatgatctattatatcctgtgtattgcacatgaaggaaaatattgtctttaataatattactgctggtttttaaaaaatcattaagtttcagaaagcttgctttctttacctcttactttctagctaagtagataattaatgtggttttatatttacctttaaaattctgtagttgtagagtcttctgccttgtgtttatacagagtttataaaaatttacagtgggccgggcgcggtgacttacgcctgtaatcccagcactttgggaggccgaggtgggtggatcacgaggtcaggagatcgagaccatcctggctaacatggtgaaaccctgtttctactaaaaatacaaaaataaattagccaggcgtggtggcaggtgcctgtagtcccagctacttgggaggctgaggcaggagaatggcgtg

SEQ ID NO: 16578 - DNA, 552 bp, Homo sapiens
cggatcacttgaggtcaggagttcgaaaccagcctggccaatatggtgaaacccgtctctactaaaaattcaaaaattagccagttgtgttgttgggcgcctatagtcccagtactcaggagcctgaggcacaagaatcgcttggacccggaaggcagaggctgcagtgagctgagatcaaaccattgcattccagcctgggcgtcagagcgagacttttctcaaacaaacaaacaaacaaaagaatcacaccagcctagagcgagtaggatgactagaatctcagcagccacagcaccaggtggatcatcgccctggagaggggaatatgagggctgagtcacagtgtcatccaaaaaggacttgtcagcctctgcagaggctgcctctcacctgcggaacacgtacccactgtgctgtaagtcctggagcaatttgcttcagccttctcaggtgtatggttttatgccttggcttttccattgtgtccacattttctcagaaaatgcaaacttcttgagaagtgacctcatttccctcacctgcagcaag

SEQ ID NO: 16579 - DNA, 605 bp, Homo sapiens
ttttacttctttcggtggaggcagaaattgggcatgagacagtatgaggggtggtctcctcccttatccccaccagaactttttaatgaagaattggaatatgactttgttaatatagtggaatatatttgagcttgcatcatgggtaagtgaagagctattacggtttttgggtggccacatcacccttgtttatttttcctgtaacagcagcattccaatttagtgaaacgaaagacactgaagttatgcttacctataattatctctattggataaattagtaaccatgttatactaatatctactgtaataatttgatagtaacttttttgattagatacacttagtataattttaatgtactatttataatgtacataggatttttaaaaattgtctgtaaccataatccaattaaaacactttatattccaaatgtatgaatataaaaatattgaaattactaagggattcattcaaagcaaatattggtggtgttatattcacactactgtataaaatactgcttaatttatatgaatgcagtttgtctacaaacactacacataactatgctaattgttctgaagtaataagcagaa

SEQ ID NO: 16580 - DNA, 584 bp, Homo sapiens
gagctagcaagaagctagaaggaaacttctggtatcaaaacaataaaaaaaaagaaaaatttttagtgcaaccagtaaaagcattgaaataaggtatgctatttccaaactagttaaaaaataaatataatgaaaagttaaccaatcaaaaaaacagagggatatatgcacatataccaataaaaaaaacagagggatatatatatatccatatatatgtatgtgtgtgtgtatatatatatgagataatagaaagcataaaataattcagaaaaaccaaatatatcagaaattactgtaaataccgaactagaaataaaaattcagcaattatatgtaagagctttgttttaagcaaaaataaatagcaaagttgaaagttaataatgggaaaaaatgaatcatataatattaaccccccaaaacttgtttaactatatcaatacaagaaaaacagactatacaagaaggaatataaaaatagtataaaatttccccactatcagagtggggaatctcaaatatattccttgtatttcagaatataagggaaaatttatcgctctatgtatttatgttacaaa

SEQ ID NO: 16581 - DNA, 208 bp, Homo sapiens
cacttgaaccctagaggtggaggtttcagtgagcagagatcacgccactgcactccagcctgggtgacagagtgaaactctgtctcataaaagaaagaaagaaaagatattgtagagaaagacattcttgttcattgttgatgggactttaaaatgtttgagcctcttcgaaggcaatttggcacagctattccaacctcaatgtctt

SEQ ID NO: 16582 - DNA, 573 bp, Homo sapiens
gagaaagaaaggaggagaataagcatctgacagccactgagccggggctgccaccaaaggggccttgaagagaggtagagggcatggacgctctgaatgcagatagaaaaaagaaacagacaagaaagagaaggtggtagaaaaggtgagaaaagcaaagtaagagaggtgattaagagggtccaacatcactaagttgagaaaaatgcaagtttccaggaagaggggcagccgacagtgtcagaatatgtgagggactgggaagctgtgaaatcatcatatttcagaacgtgaggtcagtaattctgagggtaaaaataaaagctgcaatggaatgcaagatgaggcacacaggcaagtgtagagggataaaaaaggactttgctaagaagaaacaaatgcagggcctcctggagatagtgagctacaaaagatgcaagaaaaagaaggtgtttgctaaaagaagacagtagggtaaagaggtttcttcccacaataaaaaaaactagcatccacagaaatggaaaagtggctgggcgcagtggctcacacctgtaatcccagcactttcgg

SEQ ID NO: 16583 - DNA, 610 bp, Homo sapiens
ctatattttcatcttttaattagtatttatttattattattattgtgacaagatctctctgttgcctaggctggagggcagtgccacaatctcagcttactgcaacctctacctcccactgatccctccacctcagtctccagaagagctgggactacaagcccacgccacttggcctggctaattgtgttttcagtagagatgggttttcaccatgttactcaggctgatggcaacgatcctgggctcacgcaatctccttgcttcggcttccccaaatttaccatgcagcaaagcggttgctctgttttcattaagattaatacaaactagaattaaatgcaaaatctcctattttgttatacaacttctttaaggaaatcacaggttccgtggtacagaaattgtttttaccatttaagctagagtactatggtgctgaaagaaagacatacgtctcaggcttatgtaatttcagcagaaattttctttaaacaaaatatttattttatcttctcatttctacacataaacagaatattcatgttgtagcttgcataactatgtattgttggaagtaaagcacaaaaacatttagggctcatggctt

SEQ ID NO: 16584 - DNA, 561 bp, Homo sapiens
  misc_feature 477: n = A,T,C or G
ttatatatttgcaaatattccaaaatccaaaacaatccaaaatctaaaacacttccggtcccaagcatttcatataagggatattcaacctgtagtatagatacaatagactcctaaagttgaaaccaccatgtattcagatggggggtgaagatagtatgaacacatctacatggggagcttagcgtattaagaataattatctaagcaaaacactttacccacttcaccacaatccttaccatgacttgacgcacaagcttaatggtttcactccagggtctattttggttaaattttgcatggagccgttccaggagagaactcatcttactcagcttttctgactctatgatttaaatcagaaaacgttatcagtaactgttctatcaagaccatccacagttttccttgcaaaataaattcccacacttcatcacagtaagaattcagttaaaatattttccaaaatcattntacttcaaaacatccaaagaagacatttttaatggcaagatgacacacaagttatgggtctgatgtaaggaataccataccact

SEQ ID NO: 16585 - DNA, 581 bp, Homo sapiens
tggagtaaaagcaagggcacccaagacggcagggaattaaaaggaagaactcttaattagaaaatagaaaatgcctcctgggtggtgttagtaataggtaaatttaagctgagatgaggttagagaggacagaaatggaacagatgaaaccacataagacagaaaagtagtggggcatgttgcagcaaattgactccacatgggctgtgtacagaggaggaaactaggttggggccagatcctggacacccttgaattacagcatgagaaagaaagttgtaccttaattcagactgcctgggaggcttatcagggggtggaatggtagggattgggagggagggcgtgcaagggcatctattgaacagagtgggaagattgaagtggtgctgatatataaactggattcgaatgaggggaggctgggagtagatggatccaggcaattatgttaataacagtctaggaccgtggtctttaaactttattactgcatacctactaaaataattttgaaaactctgtatcatgtattttaaagttgacattcaaaattttctccataaaatttccatatttgc

SEQ ID NO: 16586 - DNA, 551 bp, Homo sapiens
ttgcattgggatgtgtaagttttcaacgcatgaacactttaagattcttaaagtggtttcttgagatagaatgtactgctatggcttgaatgtgtctcccacattcaagccatagcagttgtgcacatatactataaggcaacaggaatcatccataaacagggggtatgagtaagagtaaggtaactataaatagaaaacatatgtactgtgtacaaatagaaggtaagcttttaaaatggcattggcaggagcactgaagcagagatttcaggggacaagttatcataatggtgggggaacagcattcctgctgctgagtgggcttagaccagctcctctgactttttaaaaaaagtttcatcccatggccagactataaggacagtgatcaagaaagactgagccatcaggtacagtggctcatgcctataatctcagcactttgagaggccaaggtgggaggatcacctgagcccaggagttcaagaccaccctgggcaacatagtgaaaccttatctctacaaaaaaataaaaataaaaaaatgag

SEQ ID NO: 16587 - DNA, 595 bp, Homo sapiens
  misc_feature 89: n = A,T,C or G
agagaaaggttggggtaagtaatttcctcctaaaggggaaaaaagcctacaatttttgtataagtaactgaatccatatagaggcaggnctgacacttgaaaaaggtcacacagtgtgagtatccttagaaatagaatgtttcagtattgtggggacaaagttcagctcacttaagaacatttcctattacgaaccagttattttcaaaatgagactgctatgtagttatataaattactcaacaactgcagtagaactagatgtaatagctacaataatatttctagtataaattatctaagaatcatttttaacatatctcctttgttagtattcattatactcaaagcttgagggacaattgaataatcagcctctatattttcaaagttgttctacattgagagttgtcatcatttagttaagaaaactcgaaatttttgcacttatgttcaatgaggcaggttgaaaaagagtttccgctcttaacacgtcattattctcttttttcaaatgtaattacttagtcaattaacgtcactcttctgtaaaacatttaggtgtaagtgaaagccatttctttatcatcatact

SEQ ID NO: 16588 - DNA, 459 bp, Homo sapiens
ctgtcaaatgcaatgctcccaggctttccatctctagtcctcagacatgtcttcttcaatcagagtcacttctaggccatatcaggcttggacagcatcagactcaggactgcacctttctaaatgcacacgcctcataactggaccttcttttcctttttttttctttagagacgaggtctcactatgttacccaggctggtcttaaacttcctaggcttaagtgatcctcccaccttggcctcccaaagtgctgggattacaagcatgagccactgcacccagcctgtaattgagtcttaaacactgatttgtatgggccaatctggctttgttttgtgggctattctctaattaaatgagttgttttcagctaatagtcagttaaaaacacatcacagtggttatttctcaaaacctaaaaccgaaaaatttttaaaaacacaaaaaacagcgccg

SEQ ID NO: 16589 - DNA, 463 bp, Homo sapiens
atgatgcctgccatcaaggcttccttttccacttccctgtttgtacaatatatgtctattggcccttctaacaggaccgcatttctgagagaacgcattatgtgcttcctctacttaagtagaattttatgctgagatctataagatcgcagacaggtgataaaaaatataagccagtatatgtgcccccctcttaggcttctggagtctcttgggaatgaaccagttgatggtatttcctctgaaagctgcttcacctaaagcagggcagcatcttctctaggaagacccagaaggttgcagcacaagtaaggtgatatcctggcctctatggctgtcctgctgagatgtcctccagaccttccataccatggggtcagcttgtgtaactatgatatatagggtctggacagtctaatctcatagaggctgaaccggtatatatttgtgactagaatgcccc

SEQ ID NO: 16590 - DNA, 637 bp, Homo sapiens
agtccagcacacagaatccaagctctgcctgtgcattaggcttcaggacatgagggaatggcagtgaattagggctgcactatgccaggaacactcatttaccacaactggatttgtcagcagttccagtgaactttccttaggcattatagaattaactgtacttagagagaggttcttggttaacctcagtgttttcacattttaaattatttcctaagtttcaagtgaaactaaatatcatttgaaagacttttaaaggcagtctgcccaccccactccaactcaccccaatttccactaacaactacttcaaatgtaattgtcagaaagagcaccccactccactgcaccccaaatcagcctccgatagatattgcatctgaccctggggggcccttcccgctttcctcttgctatgctcactacactttatttccctcaatgaaaactccttccccaccctcctaatgtgtgacttcacattctatacatagaatttctttttttttccaaagtgaatatagttttatatattttttaactacataaaaataaaacacactcaatacaaaaagaaatggataaaacgcaaatgtgaaaacaaactcaccaatcaccaaccactcagaacttt

SEQ ID NO: 16591 - DNA, 636 bp, Homo sapiens
acatttaataatgaattggacacaactggataatcatttggaaaaaaaagaaaattgtactcatacctcacataatgcatcagaaagaactccaaatggatctgaaatgtaagtataaacaatgagagagatatgtacaagaggaaaacatgggcacattttttataaacgtagagtgaggaaaaccttcataattagactcaaaatccagttgcaataataataacaaaaaaaaagattggtaaattttactgaatagaaacaaattgcatgacaaataaaccatagtaaaatataaagaaaataacactgtgatatatagttgaggtgtcatggataaaaggccaatttcctggatgcataaagaattctttactgtcaaaggaaggaaatatcaaaatctgacagaagaaatggcatttaaaaaacatggggaaagcactcaacttcactcatattcaaagaaatgctaattaaagctaccgtgtgatgcaatttcttacctattagcttgtttggcaccaattaaaaagcttaagaacccaccctgtcagtgaggctttggagaaaaaggcactcacaaattgctggtgcacgtgcaaaatgatacaatccctatggaagggaagtgacagt

SEQ ID NO: 16592 - DNA, 514 bp, Homo sapiens
ttacaacaagcagggatgtcaggaaagtcaattaagaggtgacctccaatagcaagcctttgtcattcaggtttaggcaacattctttgtcagcctctaagtaacactaactgttgaccttttgctttgcattgaaaggtcattaggataagttaagcctcctaagcgtgcactacttttgaacctgtggctcacaacattccattaaaggggttatcaaagggtggctagaagaaaaaggaaaatgtcactatgaactttttaatctataaactacattaagcagttcaaattgtcatctgtaattcagttgtataattagaaatactttcctttcaacttaatccaaatgccacatctcattgtgatactaacagtatgttgtcttcaccaatgtatagctgtgtttatttctatacttaaatgtttagaagcaaaatttcctgtttctctaagctctaagtttccttttttagtaactcttccatatcaaagacatctcacagaacctctc

SEQ ID NO: 16593 - DNA, 511 bp, Homo sapiens
gctcactgcaggcgccacctcccaggttcaagctattctcctgcctcagcctcccaagtagctgggattacaggcgccaggcatgggactaatttttgtatttttagtagagacgggatttcaccatgttggccaggctgttctcaaactcctaagctcaagtgattctcccgcttcggcctcccaaagtgctgggattacagccatgagccaccgcacccagccgcactcatgtaaacttgtaagtaaatccagtaagctttaaaaatcctgaagttgtgtaattttctcaggggaataattttacaggtataagcgtagaaaattatcagttctatttctataatgtagacttagaaagatcctgtgtactgagagtgagatgaaatttggacaaaaggagacttatggactttcacaacaacagaacaatcatgatcaaagcttatttttgccctgtgctgggcactttgtgtgcgttgacttggttagtcctcacaccagccctatg

SEQ ID NO: 16594 - DNA, 516 bp, Homo sapiens
actaattccaggggtgaggtgttagcggtcctgggaaaattgaaagacagcaaatatatattggggttcctggggtctggagctagacaactatgtgggacttgaattccggctcagcatttattagttgtgagaccttacgcaattttcttaacctgttagacacagttataaagttaggggaggcaagttaaaaaagatatatatgtaagactgtttgttaaagtattacttataatagcaaatgtctgttactggggactggttaaataacaattttgtctccacacgctcaagtactgtacaagtataaaaggagttgagaatagctttagatactgttatagaatgaactccattggatattgttaatttaaaaatatgaggtggagaaacacatgtatagcatggtattatttatctaagagagaaggagagaaatacacacaaatgcatacacgtgtgaatgcacacatgcacacttacattacaaaaatggaaaacaaagcaaagctt

SEQ ID NO: 16595 - DNA, 523 bp, Homo sapiens
  misc_feature 427: n = A,T,C or G
cacagattatgcttctaataactttaaatattaattatggaggaaacgggttaatcattttaaggattctttttggttgatataatgattctattaattaatatttgtcttatgggagccataagcgtaataggcataatgagagcacacacttgtaagtcagagtggttcttacaggggagacaggaaaaatggagtccaaaaggcctttctgtaagttccttgggagcagggactaggtctttcttgttcaccattatgtcagtatcaggcacaatgcttgacgcctagtaagtgttccataaatagttgaatgaatggatgagtttctcattaagcacttttagtagctcatatttcttgtactgtggataatcaagatcaattatattcatctaaggttaagagcctttgctatactcagttntctttattaatgtaaatttaataaactgatttttttaaaaggcatgcatctatgtatacacacacacacacacacacacacacacagacacacaca

SEQ ID NO: 16596 - DNA, 565 bp, Homo sapiens
ggttgagtggtcttgggcaagacactgtccctctctgagcctcactttccccttctgtggaataaagggactggaccatcctaactcatgttttttctacagagaggacctctgtctacagccagacttgataatgaattccccaggagtccaacctctggccctaaaaagggggttcaaggaaatcctcataccccacctctttcaacagcactggccaatggcccccatgctgcaggtaaaaacatggccaaagatatggatgaaacaaaatccaatccagccaggcacggtggctcacgcctgtaatcccagcactttgggaggccgagacgggcggatcacgaagtcaggagatcgagaccatcctggctaacacggtgaaaccccgtccctactaaaaatacaaaaaaaatagccgggcatggtggtgggcgcctggagtcccagctactcgggaggctgaggcaggagaatagtgtgaacctgggaggcggagtttgcagtgagccgagattgcgccactgtactccagcctgggcgacagagcgagactccgtctcat

SEQ ID NO: 16597 - DNA, 345 bp, Homo sapiens
atgaaacagcctacaacttcagataaaatataattatcaggtagattaaaaataagcatgtttaaaatgagaagtcataaaagaagtataataataataacataacagaataagacgtcaaaaagattagactgagctacataggaaatcaaatataactcagaaatttaaaaattatcatttaaagcttactatgttaaaccaaagattatatattaccaaataaataactaatgaatggaaagaaagatctgaggaatcttcagaagcctgtgcagagagatgaagagacagaacatgcagaggaagggcttactgacaaggagtgtggactgtatgaggact

SEQ ID NO: 16598 - DNA, 459 bp, Homo sapiens
aaacagcacctatattatgatccagagacactcagttgtaagggaactaggacgggatttctcactggcttctggaggcagttttgcaccacagttgcacagatgaggacaattgaaaggttgctggtgtgatagaaaatggcttgaaaaatatcagtccatcaacaccatcccgactggtggtgcacgtacccacccaattcattcttctaaccaataagaatctgcaaaacacaaccgtctttcaggtatattagattgtgaggccccagcatatgtgagatgtgcttcttgcctccaaaacaattactttctttacaaattttttgtttgttgtttacacaaggtctccctctgtcacctagactagagtgtagtgccatgatcatatctcactgtagctttgcactcctaggctcaagaaatcctccctcaacctcctgagtaactgggactaca

SEQ ID NO: 16599 - DNA, 585 bp, Homo sapiens
agacagcaacatgatggcatagaaaagtatgaaactcattggtaaatacaaatatatagacaaatactgaatattactgtaatgatggagggtaacacacttttaattcaactgtaaatgttaaaagacaaaattagttaaaataactataaataaatatatggtaaaagatatacaatatgaataaatgaacatagtgccaacaataatataaagtgtagggagaaaataagttagagttactggatacaattgaacataagctgttatctgcttaatatggactattataaaatattttacttaagtgccaaggtagccataaaaaaacctatagaaggtacacacatacacacacacacacacacacacacacacacacacacagaaattaaagcatttcagatacaaaaatcaacaaaatacaaagagagatagagagagagaaaaggacacacaaaagatctacaagactaacagaaaactactcataaaatggcaatagttacttttttcctatcaatagttactttaaaggtaaatggaataaattcctaaaaaaaagtcatagagtggctgaatgga

SEQ ID NO: 16600 - DNA, 531 bp, Homo sapiens
tgggtgattgcatagttttgtgctagtacctttttagaaggctttaggttgcactaactagagacaatacaagaactattgaagctggtaataaaatatcccattgaaaatgattaggccaatgttaaaaatgacagcattgagacatactggattgtttataaggaatgagtagagtctgaagagaagggaaataagtgatatcatttccctaaaggagctgaattaaagtattggatttatgatgtttttatttatgcaggggccatttaaagcattttcattttcaatttttatgtgaatgctgttgcacacttactcttttatgatacaaccttatgcagcaggctgaattagggacctgtttaacttctgggggtaactcatggtgttgaattagatcttcgtatgtggtttccattagaccaaacttagtgactgccttccacactatgcaccctcatattatttgagaactctcagaacagttctgttaacatcagtcaatttgcattcacagctgcattcaat

SEQ ID NO: 16601 - DNA, 215 bp, Homo sapiens
ttgtaagttggtttcaggctctgttgaataaaagtgtttgaatctttttttctctattaatatttcttggtagtacatatggtcaaatgtttattaaagaggaaaaaactggtaagctttaaaatgctgttaaaagttttggaaacttccttgacagaaatttcatttttggtgttgttgaaggttaacttaaaaattatgtgtgtgtgtgtgtg

SEQ ID NO: 16602 - DNA, 362 bp, Homo sapiens
aagatggcaaatgtggtaggttaataattaaacatttggaaccagtgttcttagtgtgattctagaagtgtactagaaagtcaaactaaagttttctgatatcttaatgaaaaaatcagttgaaatttactctaagctgtcaaacatcattgttccctaaaaaggaaggtcattaaatgtacctaccaaacacataaaaaagctttcagctcatcagcatagatcatattgaaaaatttgcttcttattgtacccaaagatctcaaagggaatatacacattccttcatttgtcctaaactaaaatacaaatataatgtgtgtgtgtgcgcatgtgtgtgtgtgtgtgtgtgtgtgtgtgtg

SEQ ID NO: 16603 - DNA, 427 bp, Homo sapiens
cagagttccaggatcctggattatgaggttcacaagagctgattgagctctctcatagcaacttacgtaaagggaaagctattgaatgactggtattgtttgagccctgggaactagtgcagacatctgtgtgctttcggatgtatggagttctttgtgtaatcagtccatttagcctagactgaaggaagatttttattcctctctctaaatttggcctctattatattagtctgagatttttttttccttataataatgactagcagtgtacagttcagactaagcaacgggaagatgtgtgtatgaaattgttagagaaatgaacaaccagagttacagtaaacagttgtcttatgttacagtgagtagaggtgattcctatgtggctgctcctaatgctggagcccctcagtctgattccaca

SEQ ID NO: 16604 - DNA, 631 bp, Homo sapiens
tgtagattaacctgaaatctcagcattttgaaacttcaatgcctaataagattcaataatttcttcaggtggaataaactagttcccagagataaaactaacctattttgtattgttttcagaatacagtactactggccgggtgtgggggctcacacctgtaatcccagcgctttgggaggccaaggtgggtggatcacttgaggccaggagttccagaccagcctggccaacgtggtaaaaccccatctctactaaaaacacaaaaacaattagccaggtgtgatggtgcgcacctgtaatctcagttacttgggaggctgaggcaggagaatcacttgaacctgggaggcagaggttgcagtgagccgagatggcgccgctgcactccagcctggtccacagagcatgactgtcccaagaaaaaatacacacacacacacacacacacacacacacacacacacacacacatagtactattacaagactatttcatacttgatatgtgtttcatattaagcacattgggagggtagaacagatcactgtatacttttcccttctaaaaaacacacactgagatgagtcaggcataatgactcatgcctgtaagccctgtactttggca

SEQ ID NO: 16605 - DNA, 567 bp, Homo sapiens
  misc_feature 350: n = A,T,C or G
gatttaaactacactttcattcagtgcctcatgaaataattatgctgtcaaatattagcattgttgcttaggaaactggtatcaaaatactaacttttctttctgtttatctcttactacttaataataccaacaatttatggctcacttaacctacaatttagatcaataatataaattgaaagatatttgttaaaaaagaacactgtcaatgtctctctttaaaatctaattctcatttgctatactaaaatatttagtcaccttttctaacataactccatcttggaactacgtcctctaattaagttctggggggaccaagaatggcatctgatgccattccttanaataaaaacaaaaacacaccttggtacaattgcacattctgaattagcttgtaaaagcagcacaactgtcccagaaacaagcaaatcactcttggatatattatgatatttttcaatacagtaggcttacataatcgatgccattatagaactcagcaggtgacagtccacatcagtaaacagacatctactgatgacaaagaaatagtaacaatag

SEQ ID NO: 16606 - DNA, 563 bp, Homo sapiens
catcaaccctgagcattcaagcctgcgtttccctgttaggaacctcggtggtagccggagctctgagaaacccctaggcagaactccttgcctagtttatggcagacatcagggaaggaaaggcaaatttcaggtctttctcacaataaataaataaagataggtagatttgattgatggatggatggatgaaacctgggagtctacgggcaaatatttatcagacactggaagtgtaagttgtcacaaagattatggagtgcacctgtcttatgaccctgttattttatcctagtatgtgcactagagcatattttctaacagtgtaaattgaaggctcacaaattagtttagtgagagaaaagataacggattggaagagaattaccatattcattcgttgtgttttaaaatttttaaagtaaaatagagacattatttttttcatgctttcgaatgcatctataaaaaatagacttgagggctgggcgcagtggctcacgcttgtaatcccagcaccttgggaggccgaggagggcggataacgaggtcaggagttggag

SEQ ID NO: 16607 - DNA, 532 bp, Homo sapiens
ggttacataattaaaggggagctctcatttatttatttatttatttattttaattttattttattttatttttgagacggagtcttgctctgtcacccaggctagagtgcagtggcgtcatcttggctcactgcaacctccccctcgcggggtcaagccattctcctgtctcagcctcccaagtagctgggactacgggtgtgcgccaccatgcctggctaatttttttggtgtttttttagtagagacagggtttcaccatgttggccaggctggtctcgaacgcctgacctcaggtgatccgctcacctcggcctcccaaagtgctgggattaccagcgtgagctactgctcccagccctcatttattctttatgctttgttacaacttattttgaggaacatactgttggactctggcagagacagcacctcttgcttttctaccggaggctgttttgactccgggtcagaaacaccaaacccctactgctccatgagcaacatcgagcaggggatttactcctgggat

SEQ ID NO: 16608 - DNA, 551 bp, Homo sapiens
agaactaacaattaaaggagaatgtgtattttctttcttcctttctttttttcaagaatcagggtctcactctgtcgcctaggatggagtgcagtagtatgatcatggttcactgcagcctcaacctcctgcctcaaacaatttttccatctcagcctcttgggtagcagggactacaggcgggtaccaccatgcccaactaatttgttagtgcgtttttttgtagagacagacagagtcttactatgtttccaggctagtcctgaattcctagcttcaaatgatctaaaggagaatgtttctacagcaggttagagacagtgtatctagtggggaaatccagctgttcacctcctcttttctgaaataaagtactactctattaattatgatatgaaatcatatatttgggtctactaaaaatttgttctctttattgaacttaatctccattttaggtttggtgaggctacttattaattttcaattgaacacttgtatttaaaagcatttctggctgggcatggtggctcacacctgtaatcccagca

SEQ ID NO: 16609 - DNA, 422 bp, Homo sapiens
acagcttcctaggtgctggtaatatgcatccaggattggggaccactggaatagggcatgtcagaagcatctccctctggcagttttcctcagcttagggtctaaatgcttttgcaatatcaaaatgtcttctttttaatttttaattttatctttttttaatacagggtatcgctatgttgcccaagctagactggatctcctggcctcaaatgaccctcctgtctcagcctcctgagtagctgggattacaagcacacaccagtgtgcctggctatcataatgttttcttaattctatttttatcatttttagcagagtaaatatttgatacactatgagaacagccagggtaaataaacttgatggtaagaaaataaaaagctttgtgaacctgcatataggtatctatatcttaagta

SEQ ID NO: 16610 - DNA, 522 bp, Homo sapiens
tggtgacactgccacctgcagaccacactttaagtggcaattctctaaactattccattttttttccctgcttgttaatatttccacttccaaagctacagattttccacatgaatgaaggtctgaggtgtgttttcaaaataactcaggtcagcaagatctgtaagaagggacttggactgtgggagcggggaagcaaagggaaggatgatatacatatatgggttacctaagccaagcctacaggtgttcaagcaagaattacagaaagccagtgttgttgagatttttcctacatttatctgcctcgtcctcctagacagcatttaagttgcaaaatgttttttagcaggctaatgacaggttacatccactacactatatcgtgatggaagaagcaacaattctttttcaaggagaggaggtgatatggtacttcccatcagagccagatgtgaagaaggaagacaaagaatggttttattttctatcgcaggtcactgaacctgtgtgtgtgtgtgt

SEQ ID NO: 16611 - DNA, 562 bp, Homo sapiens
agacacaaacttgctttacctgagggccaaactgttatgaatacttcatgtagctttcctttcacctttggggtggaatagtacctaagtgaaaaggttagtagattccatttttcttatcaattagttgcttaagcttttcatctgtttcttgtaaagagtcttttaaaaagagaaaataacagttttttgaaaaatttttagaagtttctgcacatgaataggcatccctggatgggcctgatctgggagccctcatttttagatgcattttttaaagtgttgagttgttcatctggaatttccacataacggccatcttaattttaaattgtctttggtgatatttcatcatttttgtaattgttttctgcttcctgaacctaatacttatacatgtaaaaggcaagcatagctggaaaatagattacttaattctatagaaatcaaggattttatttttacattgaatctttggtgtcttccagccaagataataccccgagagggaaacaccacacggttgggtcatgtaatgctttcacagtaaacctcattacag

SEQ ID NO: 16612 - DNA, 346 bp, Homo sapiens
aggaagaaaatattctacgaattgaaaggaagaaatattttatttgcttacaaagtatatctttctacaaacacaagataaaagcaaggaactaacaaattattttaaaaccaatttaattatagttacccacaataaactaattaaagaaaaaaaagtagaaacattaggaaggtcattgttatttactatgtggaaaccacggctatggtggtgattattccttgttttagtcgcaaagtacctgaatcttttttggcattttgggctccccccatcatgtaagtcctgctggatagcaaggtatacccactactggagaagttgaagcaacagaacttacttt

SEQ ID NO: 16613 - DNA, 549 bp, Homo sapiens
tgcagtatggtgatttaaaaaaaaactacaaacagttttcaaaatatgtaattatttaggttaaactcctttttcataggtaatgaggagtggacataaagaatatttagcatgtttaaagaaaaagccatcaaaacagtgtttcttcatgaatcaccaaatgttcttaaccttttaacctttggtatctggtatgtgaaatggcagtgttgtgtgcccttgaaaagaatatgaccaggaagaatgatattctttagatatcctctggaatacaatataaacaatcccacagcgataataataactaacacttacatagtgtttactatatgccaggcactattgtaaggaatttaaatgaattaactcaatactcaaaacaactctatgaaataggtgctattattccccattttacagatatgaaaaatagaccataaagagggtaagtaccttgcaaaaggtcattcagctggaaaaagcagagccatgattccaatccaggcagtctggctgtgtaggccacaccttaacccttaaacatgatgc

SEQ ID NO: 16614 - DNA, 430 bp, Homo sapiens
agggtctgtattgattgatatatggaaatgtaatctgcttgaggtgactttatagaacataactattgcatataacaagacctaaatgcattcctttctaaatggaaatctaaacacagagtttgaaaatttaggtaacactaaattcccctttcttgtacttcataagtaacgaagtatgaggaaattataaaaggtgtaaaagtgggtttggcattgtgctaccaatgctaatgggaagatgacttgtctgtgcccttggatcatgtccttgtgattctattgtatttaacaataatgtgaatttggtccatgagaaagatgtcatttctctcattcactacaaaatgataacataagatgagtaatcagctccaacctttgccttacaactagtatttcagaaatgaataatggattacggattgct

SEQ ID NO: 16615 - DNA, 548 bp, Homo sapiens
accaccttataagtggggaaaccgagattgaggagctaagtagtctgcccaaggtggcatagcttgtaagggcgagagtcaggattctgccccagaccagctgactccagggcctctgcttcacggtaaaatggcggtgagtcaggtgcttacgcctccagctcttgctgacccttcccactattgcttttcttcttcccattcagaactgaactttggtctagcttgggttgcatcttgagttttggtttggtttgtttcctcagctttatggccggcacaaggagtatctcagcagccccgtaggcaccgactttgagatggtgagtagcttggcttcctgcagcactgtgagctgtgtttagccggagcattctgactgtggatgagttacactacctctcttaaaggcccaaaggtatactctacagtgtgaaaaggaagtcaaagaatagcacatatagtccttgttatgtgttttgcaacattgcatgttgatagagaactgttaatgctaagaaaaaggtctgaaaggctatgcacatgct

SEQ ID NO: 16616 - DNA, 497 bp, Homo sapiens
  misc_feature 319, 375: n = A,T,C or G
gtattctaagtaccttgcgtagggactgacaagtaacagaaatttaataaaatatctgacaactagtcgattgatttatttaagaactgtctttgaataccgtaaatgtttaccaagcatggaacaaatctatggagttatcttcacagtcaattagatacttgaaaaaaatagataattgatatgtgttttcaatagagacaattataataataaacttaggtcaacatttagaacatgccatgagttcaaattactcttatctatcagtaattaaatgcttacattgaaaaaataataatccaaagaactatcttanaatcagtgtataaaattctattggaatttatagcattctaacacagatttaactgncatactaaaaaacattattagtcattagagtaatatttacatatattacctaccatatgtgacattgtgatttaactcagctcttcgtaaggattcatcaagaacatcatacattaattcgc

SEQ ID NO: 16617 - DNA, 516 bp, Homo sapiens
agtgagccatgttcataccactggacttcagcctgggtgacaaagtgagaccctgtcacaaacaaacaaacaaacaaacaaacaaaaaagaaaagtagtattcacgttttggacattcctatctaaactaggtggaaagagaaaatggagagtactgggtctaaggaggcaggtattctagggtaagtaatttggtattttaatttaagcagaaagacatggtcccctacttttccccttgggatatgccctggagaatgacaaaatgattttaaaagaaaaaaatatattttaaatttgaaaaaaaaagcagaaggacaacagagtgaaatgtattcagtgtagggcaaaatgaagttgattttagcaaatgcttagatcaatggacgagaaaggaaacaggctacattacatatccctaggaaaagcagcttatcagaagtcatattcagtcacttttttctgttgcctttttgaacatagatgacacttgacagtttgtaatataaacatttt

SEQ ID NO: 16618 - DNA, 406 bp, Homo sapiens
gcttgcctgatgccacggggagtcaatgacaagaccatgcttggaacacaggtcttttggagtccagagttcattctctcaaccactgcaccatctatacctgcctgttagaagtgttcaaactaatagtatccttcacaatcaagaccctggagagggaccataatttgtccaggaccatccagagactatgggtgggcagggtccttcgttcacctgctgatacatctagtggctgtctttgcagcctttcccaaactgtgctccgtggaaccctggccctctgagatgcgccacagcagaagggttccccagtcaggtgggtctagggagggctgcatactctgggatcctcttgttgattgatagccagacagagaccttagaaaaccctgctgggccagtc

SEQ ID NO: 16619 - DNA, 471 bp, Homo sapiens
ggccaaatgtactatacagagcatctggaagaaagtattcttagcagaagaaagagaagtgcaaaggccctaaagtgaaaacacaccggtaatactcaaaggacagcaaagaggccagtgttaaatgggaaagggtaggaaatgaggtcagaagtagcacaggatactctgggccatcacaagggccttgaaatttgtctcaagtgtgataggaagccactggaggcttatgggtaagaaaatgggagaaatattatctgatcagaaagcagctgaagttatttgtataatagcagggtttgggagagagaggaaaactctgagctagttattaaagtcttgataatgagggatgactgggggatgggtaggtgagagcaatgagagacacagggtggcacagctaagtagaataggtctgaaagaagctagcactcaatctactagcactagtggattacatttatgcct

SEQ ID NO: 16620 - DNA, 81 bp, Homo sapiens
gtatgcattttacccttgatgggtcaaactttcataatagattgatactaggccacagattgtttacaaaaaaaaaaaaaa

SEQ ID NO: 16621 - DNA, 456 bp, Homo sapiens
aaaaacctgactcatcagtgctggtgtgactcacaggccaacaaaactggcttgccagactggttgggaggggaacctgctgctgccaccataactcggggctgtgggcaggtaaagcccatccctccatccctctggctgtagaggacgcatcctacccaccgccagatgcagggcctgggtggtgggcctggctggggcaccactctcagcctgacccccgccctggaacagccacagctgcttcaggaacttattagcgaggggcggagctgggagggaagacaactcaggggctttggaacacagagaggtggctttaagaatcagagaggaggccgggcgtggtggatcatgcctgtaatcccagcattttgggaggccgagacaggtggatcacctgaggtcaggagttcgagaccagcctggtaaacatggtgaaactccatctctact

SEQ ID NO: 16622 - DNA, 474 bp, Homo sapiens
ttatattttctttattaagatgagcctcagaaagtaatatgaagtctttgataactgtaatatttagaggtatgataccgaaggttttgaggaagtaagaaaaagagtagcacaaaaaaatgagcacatgttctggggtttatctgaatcaatcagctttgaaatgataaaatgccacagtttgttgtaattgtccatgacaggacaaaaaatgtacaatttattcacaaagatagctgtcacctgtaatcatgccttatcccaataaaatatctttaaatagtggaatgtatagaatcatacccaatgtgtgtggcttctgtccttccttcaccagtgaatacacatcttgcagccagtaggtcaccaaaacttacatcaactggatgccccacagggtagaaagcctaccaaaaagacaaacacaatgaatcattaatattaccaataaaatccagaactacatgtttgact

SEQ ID NO: 16623 - DNA, 583 bp, Homo sapiens
aggtaccaagtatgtatcggctactgtttgaagtggtgctgtgctggagttactaaacaaaacagacacaagtctctatttttgtgtaacagacatgcaggcaaaggatgacattaagttaagtttcaattaaagggaagattgtggacaagaaggaagatacactccaagcaagtccctcaatcttagaatagcttcttgggcctgctcccctattaaactgtgataagcactccacctgtctgcttatctgcaaagcaaaactgggtcttggaaaggactggtagactggtcttcatttttagcttacgctaataaaagagctgagcctgccgggggcagtggctcagtcctgtaatcccagcactttgggaggcggaggccagtggatcacttgaggtcaggagtttgagaccagcctggtcaatatagtgaaaccctgtctcttactaaaaacacaaaagagtagccaggcgtggtggtgcacgcctgtaatccctagctacttgggaggctgaggcaggagaaccgctggaactcggaaggcggaggttgcagtgagctgaaatggcaccatagcact

SEQ ID NO: 16624 - DNA, 569 bp, Homo sapiens
ccaaaggatgataccatgctttgtggctttccagatatccgccacccctaaccaataggacattggcaagtatctatgaaatcagattctcttcctgtcagtaagtgggggagttcaggaggccacttagatatatagtatgtcactgatcactggaacttcagcaagtcacagcctttctttaattgaatatgctttttcacaagtttctaagttaaataaaagaagtagaatgtcatatgaagctattcctaagaattttaggagactctagagaaaggtcagtttattctctagatcacattagattttcttttgaaggaagtatgccatttagctgatcattttaaatagtaatgaataattgtgtctggttaaataccaaggcccaagatctataaattaaattctttaaaaacaaaaataatctgattggtcagaagcagtggctcacgcctgtaatcccagcactttgggaggtcgaggcgggtggatcacctgaggtcaggagtttgagaccagcctggccaacatggtgaaaccccatctgtactaaaaatacaaaaatc

SEQ ID NO: 16625 - DNA, 596 bp, Homo sapiens
aagttcaaatttacattttactccttaaattgttttcaagttgaccttagaacattaatgttaatttccagtttctccatacaaagtcttagagaacaatttctgcagtgcttttaaaacttgttttaccttacagacgtgtttccttggtcatattgcctttcctttatttctactctaatttcagcacatgtgcctcttcattcttttaggtctagttaaaagcaaaaaaaacgaacttttgattgccattcaaagcaatttcactacacatgcattttatttctactcctagtcaattttccatgtttaagtctgtagatggtggtatagtccttggactaaggccatcatcttagttatctcaacatctctcagggcttggcacaatgttcagcacataataggtcaacatcacatctttcaataagtgaaagtgtatgaaagtagcttaagatgttaatcaatcagattttggcagagccgatcattatactaacatttaaaggactttcctctgtaaacgacactgacaattttaaagaaattaaaagtcacggctactttttcttcatattcccaaaaaaaaaaaaaaa

SEQ ID NO: 16626 - DNA, 611 bp, Homo sapiens
aaatggtctcccgcacaagcccttgtctttgcagcccaagtgaatgatgcctccctagtttcgagctctgccacaatcagcaggacaccccaatgcaaggatgctcttggaggtgtggcctgggagaggcaacctgctgatccttggacagggaaaaaataaaaggcaggaaaatagagccaggagaaagaacaacttgtggtttaactgactcctagctggcagggcctgttatggcccctctcctcctcccagtaaaacaatgttaaagacaaagaaaatcccaaagctgaagatttcttggaaagttaacattgggaacgttggaaccatccattaatagattttgaaaggactatctactgagatggctggtagagtgggtaagaaagacagttgatgggctgggcgcggtggctcacacctgtaatcccagcgctttgggaggccgaggtgggtggatcatgaggtcaagagattgagaccatcctggccaacgtggtgaaatcccatctctactaaaaatgtaaaaacatttagctgggcatgggtggtgcgcacctgtagtcccagctactagtgaggctgaggcaggagaatcgcttgaaccc

SEQ ID NO: 16627 - DNA, 623 bp, Homo sapiens
atctcaaaaaataatatttaaagccatagaatttataatttatgcgtcaatagtttctcctttaagtggtcaccaaaaagatatcaaactttttttgctataagagcatatttaaaaaatatcaatgaaagtgttaccagttttcaatcctcctcacttggacattaaagggattaaagttattgtcagcacacacatggatcagctttcaatggaaaaaaattaatgttttttgatgttgtttcttttccttaaggcttaaggacactaggagaaagacataaatagaagtatatattatcatctagatggtgactctccaaggggatgatgagggaaaagaagtaatgctaccctaattctgaaataataaaagcttaagcaatgaatggctgaattcacacctcaaaatttcatggaagacaggcatacaaagataagctttcaaaattgaatgaactcattaccacaattaaagaaaacaaaaagaaacattttgcataactgctggttttgctgctccttctgctaatttagtttgtctggaagagccactgtgtggaccacccatgcttcaatgcacttaaccaatacctttagaagaaaacaggatagctacaaag

SEQ ID NO: 16628 - DNA, 531 bp, Homo sapiens
tccctcccagtggtggacttgagacgaggaagaaaaactgcctcgcacgggagaacttaatgagatgaatctacttgcccctaccttcttctctgccctagcgatttcacctccttgagcccccaatgccctgtatgttcattttatgtagcaggtggcatcctgaaaacccggatcaagcaaaattctcttccaccaagccctattttaaatatcctggaggaagaggaggctcctccttagaaagatcctcctgctcagtttgaatcgtgaggtaaggctcaccgtcaggtctggggatactgggcattatctttggtccttaggccagtattacctaaagaataagaagttttaggccaggcatggtggctcacatctgtaatcccagcactttgggaggccaagacaggtagatcacttgagcccaggagttcaagatcagcctggacaacacgataagacccccgtctctacaaaacagaaaaaatagccaggcatggtggcatgtgtttgtagtcccagttactc

SEQ ID NO: 16629 - DNA, 599 bp, Homo sapiens
taaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacatt

SEQ ID NO: 16630 - DNA, 585 bp, Homo sapiens
agggcgtattggagtggaactacttacagagtgtcagggcaagtccttacatttgtttatgcttaggacacaacacagaagataattttctaagttaaagattgtatgattttatcttgacttcagaaactggtcatacttttttactttagtttctaagaacctcagagctgaacttgaaacaactttaataattccaatgagacatttgttatttatcctttttaaaaaagacttttctaatttaaataattttattattgctctaaatttgccaggttcatttaagaattttataaactgttttaaaactaatttacattaagttggaataaagttaaccaaattaatacaaacatattttattgcacttctctttattgtgcttcacagataggaacattttttctttatttacaaatgagatgtttgtgacaaccctggtgaagcaagtctattggtgccatttaacaaacagcctgtgctcactttgtgtcttggtttcacactttggtaatcttcacaatttttaaaatatttccttattattatattcgttacggtgatctgtgatcagtgatcatt

SEQ ID NO: 16631 - DNA, 588 bp, Homo sapiens
acctctcaaatgaaagctcccctgtggctacggggaagaggcgccctgggggaagtagccctgggctgagactagcttgaatgctctcctttctaaagctaacagcaaagtcgcctggaaccagggtggctggtctcgcttccaaatcataaaggaagaaagagctctagaagacagcatcttcaaagaagagggcagtgatcaactgtgtgagttacaacaccaaatatgaaaactggcagaaagaatcacttgcacactgtttgcataaaataaaaccacaatgaaatgacctagaaagggaggcaataaaagggtatcaggaaaagtatgaaatacacacacacaggatttctctactggtaaaattgcaaagcaacggaaacatccaattatgccgaaagaacgactaaagcatatggtaaaagccgtgagtgtggatcggggaaggggcaaggcagcagccacacagggaaacccaagcccgtctcttgagacctgacagtccaacagacaagacacatggcatgcgacgtgaaatacgatataatcaagcttcatttaactgatctatctgaaaccccgtgt

SEQ ID NO: 16632 - DNA, 463 bp, Homo sapiens
tgctacttcccagggactgagctggcgttggtgagggacaggcagaagccatcctaccatgggtccaggcctggcgtgcctcccctccaccagtggcttccccacctctgtgctggggagctcactaattcacatggcactggtagaaaacctggaattgtctgaaagtttcttcttctatttattattatttatttatttatttattttgagacatagtttcgctcttgttgccctaactggcacaatctcactgcaacctccgcctcccgggttcaagggattctcctgccccagcttccagagtagctggaattacaggcatgcgccaccacgctcagctacttttttgtatttttagtagagatgggatttcaccatgttggccaggctgctctcaaactcctgacctcaggtgatccacctacttcggcctcccaaagtgctgggattataggcatgc

SEQ ID NO: 16633 - DNA, 583 bp, Homo sapiens
cagccttggggtatgagcctccagtctgtcaccaggtcccctcttggtgacaaacacaatcaggtgactgtgccctctaggatgctcagtgtcacacaaacccagtgtgacaggtggaatgggctaggagaaggccccggaaggaatgaagccacttagaggcccccgtggttgggaagccaacctgaggcaggaggtcttgcttcaactagcccaggagaggctcttccctctacctccagggaccgcatttccctctaggaactgatggggagaaagcacaaggccacccaatctgctcctggctgcaggtgcctcaagagtgggtccccagaaagcctccttggctgccaggcaaaatgtgggtacagccaccaccagctatgtgtctctgagcaagtgttttgacctctctgtgctcaatttcctcatgtctaacatggactacaatggagatgaacacactgcccactccataaagctccattcattttatataagttaatgaatgtgatggcgggaacagggcctgacctatgatacgggcttggtgagaatttaatattgtagtatacatatatat

SEQ ID NO: 16634 - DNA, 563 bp, Homo sapiens
ccatctgtgtgacctcgttccggccatgaaacccctctgagcctcagatttctcatttgttgtgtggaaatggtgataatgtctgttctacctgccccataaggttgctgtgaagatgatgtaatataatgtatgtgaaagatttaatttaataatactaaatagagcattataatattttctgatattaatccattaagataactatttactagctgtctatttggctaactgataataatccttttgagctagtataggcaataatatgcatggtacctaatctcctgttcttctcttgtcaagcctgatccaaatttttgatgtatcttggcagaactgagccagtcttccaaagaactaaaataataataatgaaaagaacatatttagcaataatatttttgagataacatttttcttctttggctgtacttgctaaaacaacttacccaattttctggaactgtccttctaagtagttccaaacatatcttattttctgcactttgatgcatctcacctgcaaaagaaaagtactaagaaaacctctagtttgagga

SEQ ID NO: 16635 - DNA, 546 bp, Homo sapiens
ttaacttcactctggtgtgtttgtgtccttgatttccttggtgtcaggcaacaaacctcaggtattaccccagacaaacaatactgcttcacagagaatacctgatctcccaaaatttggttaagatctgaagtttattttgccgtacaactccattttttgaagttttacttgcttccaacaaggaaggcaagatttcttgcttccatgatgatggaaggcaggtaattcctctatggagttggagctcgctcccaacagggaagatgagtttgagttttattcctgactctaggatggtagaggctgtcttcagcctgagacccatccctaagtaagttaacaaccagctgttcctaatttctctttaccattagagtgcccagtaatcatattgttgggtttttttattgttttttccagactttcttccatcagatttggtcaaatctgagtgagaatttcaaattttgggtaacaaagcctctctaatttggctaaaattcctctccactgcacaggaaggggaaaaaacaaacacgtgct

SEQ ID NO: 16636 - DNA, 582 bp, Homo sapiens
acattaccttattcgattattcaattccttaactaaaatataatttagttgtaatttaaatcataattccttgaaaaagattgtttttcaaatataaggtattatctgttttataactctggctcactcctggtttctatgcactttttcttaacagcattttaagacattaattttaccttattgataatgcttcctttttgaaatctttccagcagtgaaattaccatgcaaagtataacttcaagtgtcaagaacgcaaacatgactaaaaatatattgctttacacatacaacaagtgtatgtgtttctgttttactggtttagaagatgtgtcacttgaatattcaaaattcagtgactttctcaatttcggagaattttaggatgtagttgttcaaggcgcttatttgatagataagggaaatcaagtgccaagaagttacatgatggtacaccaccactcaggctagggccatgacccatcatcgatctgctggttcttagcgctctgcctcacatcaagaccagtggaacagccacctgcatcatttgctgagtaagcatttgaacgtgaaatt

SEQ ID NO: 16637 - DNA, 555 bp, Homo sapiens
tccccaggggcaaggtgggctggaggtaggtgacaaggtttggctcccaaacgggcactggccaaaaacaaatggaccagcagggccaagtgacatggcagaagaccaggtgggtgactcggtcaacactttcaaacatccccaaagttatagtaagcatcaagagacgggttactagagtctcactgttaagagtaaaaagagattgtgtatgcaaacaattagaaaaatcagaaataactaatgtttaaacaaaacctaacaccgtaatacttcaagacctttgggctcatagtctgcctgacacataggaagtggacaggatggctcagagcactgtaaaggacctcacttgacctcctgcaagtcagttcttctcaggacaaagtggacttttccacaagtttgcctttagcaatattataataaactgcacttcaactgtcttgaacaaactcacagctccacaccaatgcagtcttaaaaatgagactggccagtggctcacacctgtcatctcagcactttgcgaggccgaggtgggtggaccacctg

SEQ ID NO: 16638 - DNA, 567 bp, Homo sapiens
atgagggaagtactttgttctatttgctgttgcagtcacagtaccaggcccacaagtagataatagagctacaagaagaaccaaggtatgaaccttgcctttaaggtctactggagtgagacagacatgtaaacagtcaatttaaatgcagtgtaatgaagcctacgactggggaaagaaagggaaagacacctgacccgtgcttgggactcaggaaaggcattctagagtaaatgacacctcaactgggactttaaatgattaagaattagccagttgaaaaaataaaagtggtttcagagcagaggaacagcatgtgcaaaggctctaaggtaagacagaactcagaaatcagaggcagaaagggaaacaatgaatctgaagaagttggcaatgacccttaagccaaattaagggatctggactttatcttggggacagtagggagactgctaaagagttctgtatgggaaaatgatatgatcatttcagaactgggcattttcaacggtatcttccacaccacccaagaaaaacagtgggtcagaaaccaattgaacttctctc

SEQ ID NO: 16639 - DNA, 573 bp, Homo sapiens
ccccattactttccctcacgggtgctgatatcacacaggttttgaaattgttgatgcttggtcccattcatatttgggatttgtgaggatcttctgtcacctaatcatagggttttaagttttgctgttcacatttttcaactcttttggggtgggattcagggagattcagagtacatgtttactaagtgcatatgtactaatgaacttattttataagtgctatttccattccaaaaagtcctagatgaggtcccatttaacccacaaaataataacggatgccctgatatgctctgggacagggtctatgcccagtaaagaatattaatctgttatttgagctatctaattggatcaaacttatagcacaatgtattacggactaaagtttgtgtacccccaaaattcatatgttggactcccaattcccaatgtgatggtatttgtagatgaaattttggggaggtaattgggtttagatgaggtcatgagggtagagtctttatgatagaatttgtgtccttagaaaaagagacaccagagagcttgtgcacgtgctctctctctatg

SEQ ID NO: 16640 - DNA, 568 bp, Homo sapiens
agtaagttttggatagatggtgtttaactagcatatttctggagctgaagggtgtggagggagctaccagcatgtaaataactcaaatgtgaaatgtagttatgactgctgaggaagaatattatcaaggacaataacccttgttacaccaatatttacaagtcaagcggaagaaacagagctctcaaatttaggagacagctttcaaacattttcaactgcaaaccacaggaagtacactttacatcaaaggccaggacacaaatacatacctgtctgtgtaactgaaacaaacacaagtcaaacaaggatcaactacttttccattaaccatttatgattaacttgttaccactgtaccaatttacttttaaaattacataatgcgcttaaagtcagctgactctcagcatgacctaacaatcttttcatttagccctagcttctctttccaatattctcaagcagtcacaccaaagctttggtcatcaacaccactctcctttcccttagaaaataatgaaaaattacagatatattttcagatagagaggggagttgagagaat

SEQ ID NO: 16641 - DNA, 544 bp, Homo sapiens
ttaaagattaagaatactcaatgcgccaagaagtgctatataccagaaaagtttgtatcaattaatgtatctaaattaagttaaagtttctttcaatttaatgtgcttgcagatgtaaaattgcatgtttaagttttgcagttatgtactaaatctggtgctacacttctaatgtctaaaggttttattcaatttcaatttatttgttttatagtttgccagaatgtgcttatgaaaggcactctcagtcataaaaataaaattataagcagactggcacataactatttttttaaataataaactttctgattttagagacttgtattcttttataggtcctggttctctttcacgctctgacctataagaacccatacagcatgcattgctgtgtatggaaaagcagtaaagggaagtacagccaccttttaggtcccatgaatagcaaaatctctttgactaatctcttgtttcagggtatgtccactccttgtttaaagaatgtaactggctgggcttggtggctcactcctgtaatccc

SEQ ID NO: 16642 - DNA, 566 bp, Homo sapiens
tttcattttcttttaataaagctgtttaattttgcaaaaacttttttaatgaaaaacgtatatttatctaaccctaaactctgtgttcttaaagagagtcaatattttacaccctaaagttgaactatctaattttttcatactttaataaagccatgtacatatcattcatccctgtgagaattagagcatagcatgtggtaatgatcattcattagtttttatgaatttaaccttgtgaatacttttattacattttcttagccattaaatacaaaacaatcacaaaatgttagtacttgtatgttctctgcatgtttccaataaaactatgttaaatcaatattgtaaatgatacttttcaccattttgttcaaagtgcaacaatggataaaatagtatattgtctctggcatgaatattcttattataaactattttccaaacaaatgtctttcaaagcacttgccatttagtaagcactaaatactggcagctggttttactgatatcattcatttagcaagcttataaaatctcagtatgaagtggcttcaaacttacca

SEQ ID NO: 16643 - DNA, 550 bp, Homo sapiens
gtttgccttctctgcagtctggcccacttcatttggggtttcccatgccccctgcttcacatcctttgactctggcttttgttccctccctcccagaatagctctcagttcatgaagcacaccaaacgccggaagctgacggttgaggacttcaacagggccctcagatggagcagcgtggaggtgagtggggtgcaggctacagagggctcaggtggcatgaggccacttccatgtccagttcagggctggcgatgtggtgagacattaagaccaaacgctgccgggcatggtggctcatgcctgtaatcccagcactttgggaggccgaggtgggcggatcacttgaggccaggacttcaagaccagcctggccaacatggcgaaaccccttctttactaaaaatacagaaattagctgggcctggtggtacatgtctgtaatcccatctagtcaggaaactgaggcatgagaatcgcttgaacctagcaggcagaggttgtggtgagctgagattgcactccagcctgggcaacagagcaagaccct

SEQ ID NO: 16644 - DNA, 539 bp, Homo sapiens
gaaagtcagtatcacagctcaagtcattacggcagaaggaagggtagtctcagtcctgtttttaggataattaggacatcatccacggggcaggcttgagtcttttggttcgggaattttctgccctgagaaaagacatcattgagatacaggtagagtgttccttatgcaaaatgcttaggaccagaagtgtttcagattttagattttggaatatttgcatatacataatgagatagcttggggatgggacccaagtctaaacatgagattcattatgtttcatatacaccttctacacatagcctgaaggtaattttaaacagcagttgtaataattttgtgcatgaaacaaagttttgactgtgttttgactgtgactggccacatgaaattaggtgtggaattttccactgtggtgtcatgttgacaagcaaaacgttttggattttagattgttggattagggatgctcaacctgtgtagatttatcatttttaaaaatgcttccatctttgaaggaactttcatgtaatcct

SEQ ID NO: 16645 - DNA, 571 bp, Homo sapiens
acatgcatgaatctgataaatgtcacagtaagtgacaaaaggtcacaaaagaatatattcagtatgacttatatgtgagttaaaaacaggcagaattaaaaatatatgtttggtaaaactgtaaacagaagagaaagatttgattaaaacaatattcaggacagtgagggggtgagggtataaagtgaaggaagaagatgtcacctggaaggcttgaaaagtactggtatattctactgtctaagctaagtgctaggtccttgttttcatttcatcattctttaaactgaacatatactacgcaatattctaatgatcaactcttctacaatttaaaaaatgtaatggaacttgttttctaagcatgctaccaaaggcagaattcaatttaagaaataaaccttaggctgggcatggtggctcacgcctgtaatcccagcactttggggggccgaggtgggaggatgacttgaacccaagagtcaagaccaatctagacaatatggcaagattccgtctctataaaaattagctgggcgtggtggcatgcacctgtagtctcagttactca

SEQ ID NO: 16646 - DNA, 529 bp, Homo sapiens
ggattcatggttcaaaatagaaatcgtaatgaaaattataaaaatcttttaaaagaaaacccaacattaaaacctgcatggtgcagctaaaggtgtgtgtggagggaaactgaccttaaatgcaaatattagcctggaaatcagactaagaaatgagcaacagcaaattagggcaagacataacggaaggcaggagacagcaaagggcggcagtgaacgcgcaagcacgcggacacgtggcagggaggactaagacgccgaaagttctttgaaacacaaataaaatcaataaagtctcagataactaacacgggaggaaaaaggtgttatcactataggttccatcacattagatcataagagaacaatttaatgctaataatcttgaaagtgcagatgaaatggacacattctcagaaaaacacaaattaaagcatcatactctgggctgggcacagtggcttccacctgtaatcccagcaccttgggagcccgagacgggtggatcacctgaggtcaggagtttgag

SEQ ID NO: 16647 - DNA, 475 bp, Homo sapiens
gggttgagtgaaggtgaagggcaaaaagctcagctggcctatcccttcaattctggaaaacaataatttcctgggaaatttcattttgtatactgtcacttacatagtattggggagcgcctaagtccttagctagaagagaatctgggttcaattctcatttagggggggctgaggtgctattagtaatgaagaaagggcagaaagtgagttagataggcaatcagtcatgtctccacactcctgctagatgtactccatgagagcaaagtctctatttctaatattcctggctttgtgcttggaagctagcaaatctatgaactatgtattgaataaatcaaaaagcacaccatgattttattttgccaaccattttatgtattattagaaccaccagaaataaatgggtgggggattctagaaattactgtaataatacagtagaaaatctaacaaattttgtgacccatca

SEQ ID NO: 16648 - DNA, 580 bp, Homo sapiens
tgtgtggtaggcaggcctgcctggaatttccgacagccctggacctcgcctgtggtggtctgcccttcccagggtgcctgttccctgcaggcagggcagccctgggagggcacaaatgtgactggcagagggaagagacccccatgcttctgcacaggcctcagcctgagtgcacttacaagtgagggagctctggctgcccaggccttgtggggagagcggggaggcctggcccagtgcccttccagctcaatgcgatggccctgctcctgctggacattgcccctcccccgcctgaacagctgctcccacaggagcctaggcaggcaaaaattcccacagtgctcccagttgaccgggggcctccccgtgcctcccccatttctattctcttttccccaggcccattgcagggggtagctctgaattcccagcttaatggggcccacagcccctcgggcagcctggagcccacagagggtgtcagcttggagacctgccctcctcgccttcatcagcaccaggatggctttgtcagcaccacgtggcaagagggacgagctgaacttctaggcaggga

SEQ ID NO: 16649 - DNA, 564 bp, Homo sapiens
gggggggggaactggatagataaaaattactctcttagcatatttattatgccaacaatgcaacttaatgcatctttgatgatgtgcaattaggtattaaaatttctcgtaactagaaatgttcttggtcagtgagaattactgtagataatttcaggtaacgtgggggtaatttggctggttaaaaggcctgggtcaatatataaagcactcaatttaggaaaaaaagattgttcttcacattagtcctctgtttagctatattgggaaatgcaacttcatataaaacatgaggagaaaaacagtaattatttcataattttaaataaatttctaaagatacaaaatggcaactagaaaatagtccttcaaaccataatgtactgatatttttttttctaaagggtcaattatctttgcacaaagttaaggagttttattcgctttaaattactggtttaatttagatttctgattcttattttaattagttgccctgatttttttttccttgattttctctctctcacaccagggtttccatagggaagtttttgggttgtt

SEQ ID NO: 16650 - DNA, 546 bp, Homo sapiens
tttatgaagaaatgcctccccctcccccttctccccaaagtacggtgtggcagaaaacagcgccaacaggtcctgccagtcagaagccactcccctgatttcatggctcaagaccccaactataaattaacccttcccaccttgaatgtgtacacacactactgagatggaggccgatccttgccatgggatgaacctgagaattgccaagacccgccttcccacgccacccaaccaaatcatgtggtatctggtacaagtcattttccccctgaaatcccacaagaaaactattttgaggccgggcacggcggctcacgcctgtaatcgatcacaaggtcaggagatcgagaccatcctggctaacacggtgaaaccccgtctctactaaaaatacaaaaaaaattagccgggcgtagtggcgggcgcctgtagccccagctactcagaaggctgaggcaggagaatggcgtgaacccgggaggcggggcttgcagtgagccgagatcgcgccactgcactccagccagggcgacagagtgagac

SEQ ID NO: 16651 - DNA, 542 bp, Homo sapiens
ctgatagaagtttggtgtgtctccccaaaataggccaaaaataaattttaaatatataaatgcatgaataattatgaaaattatttccctattccggactcaatatgcttacctaaaaaataaaccattcactagatctacggtttctaatccagttgctcttcaagaacatctggagaattaaagaaatgtaataactttattatacctcctttttctactaaatttctctatgtagattctaggcatgtgtatgtgtgttttgtatatatttatgtgtatgtaactatgtatgtgtatatatatatctctacacacatgcatatatatgtgtgtatatatgtatatgcacacatttatgtatatacatacctcatatgtgtagggctgtgtatatacataaatacacatatatataaacatatgatatagtagtaccccttgatccatgggggatgtattccaagacctccaatggatgcctaaaacttcagatagatagtaccaggccgggcgcggtggctcacgcctgtaatctcagc

SEQ ID NO: 16652 - DNA, 564 bp, Homo sapiens
aggctgaagtgcagtgatgcgatcatgactcactgcagcctcaacctcctgggctcaagtgatcctcccaactcagcctcccaagtggctgggaccacaggaatgcaatcataaacttctgggctcaaatgatcctcttgatttggtctcccaaagtgcaggaactacaggcatgagccactgtgcctggctggaactaaacagatcacactgtcctaaaagaaaatatttcccacgtattacttttagcagcagttacaaaattgcgtttagttttaaaaactatatcaattttaaaattccatttataacgttaaaatgttctcagaggaaaaaagagaaagataaaatgaggccgggtacggtggctcacacctgtaatcccagcattttaggaggctgaggtgggtggaacacctgaggtcagaagtttgagaccagcctgaccaacaaggtgaaaccccgtctctactaaaaatacaaacattagccaggcatcgtgacaggcgcctgtagtcccagctactcaggaggctgagacaggagaattgcttgaactcggga

SEQ ID NO: 16653 - DNA, 529 bp, Homo sapiens
ttctgaataagcagctgaggatttgcctattaattcctacaaccctctgtgtctggcaacagttttccaagttcttagagaagtgtttgctcctctctagtttgataactctctgtgtgtacatgctatttctatatcttattcatttattgagatgtgagtgggagaaaagttccatgatctcataatttttctctggaagtaaaataataaacatataccttttattataataaattataaaagaaaatatggattgaaaataatttagaacctttctggagggcaatttggcagaatctagccaaccttttttttgacctagtattttcacagtaggaatttatccaaaagatatacaggtgaaaaatggcacaggaatagggtaattcattgtagtattgtttgtaattgcaaaagatctggaaaaaaccatgaatatccatgaaaaggaaatttctcagataaatcctgatatatctatacaactggatgatacacagaagtaaaaaaaaaaagagagagagag

SEQ ID NO: 16654 - DNA, 532 bp, Homo sapiens
tgcaccatgactgagggaattggctgggacataaaaaggaaagctctggctatcatggtcagttagcaccaaatattggatctgataatatcggatagttcacttggaagcactgagtagtatattgagaactttgcatttcacctagtgagcagcaggcaaaggcagtatctgaactgggatgacatttcattcaagatttttatatgcactgttcacagtacagagtatatgcttcttgcatacacattcaaatgtttatcacatgacatcaaaagcataagcaacaaaagaaaaactatataacttggacttcactaaaaatttttaaattttgtgctccaaatgatacaatccgaaaagtgaaaagacaacccatagaatgtgagaaaatacttgcaagtcatatatctaaaaagagacatgtatccagaatatataaagaagtttataacttgacaataaaaaagacaaatagccaagtaaaacatgggcaaaggattggaagagacatttatccaaagaatatata

SEQ ID NO: 16655 - DNA, 572 bp, Homo sapiens
taattgcctaactagactccacaagaatataaaaccgagcaccttagtactgccacagtggccttcctcccacttacttggcccgtggccggtgtcacatatctggtcagcaccatctgctgcaaccgactctcacttagctcataccagccctctgaaccctaaatgcctacatctgattttcccaggttgagttgtagcctcaaaaccaaggttgatttctcaggctaaacttctgttaaaaacaaacaaacaaaacacccctggtggaggacacatcagcattttcctctagggaggatcttttaatgtaatgacccaccttttcttgttaggtcggccagtggttcctttaccggttcccctacatcaagctccaattcagtttctggccaggcacagtggctcatgcctgtaatcccacacttggggaggctcaggcggcagatcacctgaggtcaggaggtaaagaccagcctggccaacatggtgaaaccccgtctatactaaaactacaaaaattagacaggcgtggcagcacgcgcctctaatcccagctactcgggaggctg

SEQ ID NO: 16656 - DNA, 484 bp, Homo sapiens
gaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggaaacttctgggagtcgcacacaatacttccaattacatcccttaagccaacattgagtcatttgccactaatggcaaatgcaattctttagctggataaagaagtctgtgcaacagatatcatccttttttt

SEQ ID NO: 16657 - DNA, 548 bp, Homo sapiens
atctaaagtagcacctgcacccactccaactttgtatcacctcatctggctttacttttcttcacagcacttattcctacccaacattatattcttgtctgcaatttttttgtatttttattatctgtcttccctactggtgtataagctggatgacagcagtgattttgtctatttagttctctctagaacaatgctatctagaataagtgttcaataaatatttaacataaaatttatgtttcacttttagaaacctcaaactatagatttcaaaagtagtaaccattcctaaagtatctaatttgattagtcttaatttaaaaaaattgtttgggccaggcacagtggctgacgactgtaatcccagcactttgggaggctgaggcaggcggatcacaaggtcaggagtttgagaccagcctagccaacatggtaaaaccccatctctactaaaaatacaaaaataaataagccaggcatggtggtgtgcacctgtaatcccagctactcaggaggctgaggcaggaaaattgcttgaatctgga

SEQ ID NO: 16658 - DNA, 569 bp, Homo sapiens
atggcacttaagatttcaataagttgagaagtatagtatgacagttaagactaaaagagtaaaagtgtccacttcagtcagagccccaacagtgttttgacaagttgatcttaaaattatactgaagggcaaggaccacgaatcagctataattctgtaaaagaagaaggatgatccatactaccaggtatcaatgcttatttcaggctagataattaaggcataagatatttactgatgcaaggaaagacagatacagcaatgggacaaatacatgagctcagaaattaatccaaagcatataaagaaatgtgatattacaggaataatcatagaaatcaataaattaaaaatgggctatttagggccgggcgcggtggctcacgcctgtaattccagcactttgggaggccgaggtgggcggatcaccaggtcaggagatcaagaccatcctggctaacacgatgaaatcccatctctactaaaatacaaaaaattagccgggcgtggtggcgggcgcctgtagtcccatctattcgggaggctgaggcaggagaacggtgtgaacc

SEQ ID NO: 16659 - DNA, 553 bp, Homo sapiens
catggtagattttcagagaaatcagctggataaattccagtttaaaatgacatctggctagctattgctgcccgtgacacagcctctcttgatttccaattaacctctctaatgaagacacagaaacagtgcagccctgccatcgtaaaagtggagacgctctttccctctccctctctttgcattggctcagagacatagcatctgcagcaattaaaaaattggatggccatctctcaagtctgtgagttgctttttaaggcagccaaatcttgccatcctcaatatatttgttgaagatcatatgttttgtaaaatgacagggtagaaagttgtgaccttaatacatggatcctgggaggaatagatactataagtaaagttgtgtgatgaggacagagacaaggacagactgagcagcagggcctgctggacactgtagactttcatatgttctgctgattttgaatgttaaagaataaggcaagaaaatttggaagcgattccacctcagtagagcagagctccattagataaaaagctgaaaaaaaaa

SEQ ID NO: 16660 - DNA, 492 bp, Homo sapiens
ttagatctgtaagggtctaaagtatatcagacgagtgagaatttcatcaaacttgtaattttgacacagcacatacatatttttcacgtgggatacatattgttaacaggagaatttggtaacaagtgattgaacttctagagctggtgatttttttagcagaactttagatatttaagaaaaattatctgcatataacagtcaaatttttcccttcatacaccccctgtctctaacctacatgtgctgctctatgaccaggtctaaattccagatgttccaagtagctcttcatttagtcttgtcttctgatggcacctaaacaaatatatcaaaacttgtacaacatttagaaagtggaacttgaagattttctttctgttagacaaatagacgccatctggaaaaaataaccccaggcgcttggacacaggagcatgacgcttattggctggacaccatatgaataccttacactactttatttggctc

SEQ ID NO: 16661 - DNA, 471 bp, Homo sapiens
ggaacaaattgagagtgtagaaggtatgctgttcactgcagggacaagggatactgtcccttagcaagagcaacagacctgccttttatctgttatgttcttgagctatttcctgaaagcaatcaatacaacactcataagttaaattttattgaattcatagttacaaaagccaggaagtcgtttagttattaaccacatggtttgaaattgatggaattgagacagaaatcactttaaaaactgagagagggtgtcatagtctgttctggctgctgtaacaacatcccacagactacgtagcttataaacaacagacatttatttcttatagttctggaggccaggatgtccaagatcaaggtgccattagattccgtgtctgctgagggcccacctcctggctcatgaatgatgccttctagctgtttcctcacacagtggaagtggcaaggcagctctctgggactc

SEQ ID NO: 16662 - DNA, 568 bp, Homo sapiens
gtcgtacggtttatacttcaccgtacgactcctctcccccactcctttgtgagtctggtctcttgccagtttcttaccctgagtggtgctaagcagataactcgtggttattccaagatagcatctgagtggagccacttcaggactagagggatgtgtcctggatctttggtctgtctcatgccttgcaccaagcttgtgggtgacgtatcatgaccttgttggagtgattgaacttgatctattgagacgcaatccaggatccctagaaacaagcacggtagactgttactgtgtggcaggtgtttcagtgacctcccgtcatcaagaggtgtgtgtgacttgacaataaaaaaataagtgtcctaaaagaatttactggctgggtgcggtggctcacactggtaatcccaacgctttgggaggccgaggtgggtggatcatttaaggtcaggagtttgggaccagcctggccaacatggtgaaaccccatctctactaaaaatacagaaattagccgggcatggtggccatgcctgtaatcccagctactcgggaggctgaagca

SEQ ID NO: 16663 - DNA, 526 bp, Homo sapiens
ggcctaatatagttgaaaatacacaagcctagaactgtttcatatattcccaagagacactctttgacaggtgtaccaggaggtatgtacatgaatgtttatagcaattaaaaagaatgtagggcggtggctaaatctcaactttgaagttcaagcaaaagaaaattaaaggagaatactcagagtatgattactttgatatacaaatttaaaacgagtagatgtactcatccatggcaaaactataaagaagagcaaggaaaggttatcatgaaggtcaggagagtggttaccttcagagggcgtgcaatgaggaagggacacgtggtggcttctaagggagtagcaatgttctacatcttagcctaaatggaggacatatggatgttctcattattctttaaactgtacatatttttatgtagtctattatatgtatatctcaaaataaaatttttaaaagaaataaagattctacatatgtatacacatgtatgtatgtgtgtgtgtgtgtgtgtgtgtgtgt

SEQ ID NO: 16664 - DNA, 461 bp, Homo sapiens
tttctcaaaaaaattgatctgcaaaatggggatggtaaatgctgcacagcagtgatgaagatggtaagtcatcaggtatgatgaaagaactttggaaactttcaaggtgctatacaatcacatgagagtgattacatggtgattttaaactgtaaagagctctataaagccaggcatggtggctcatgcctgtaatcccagcactttgggaggccgaggcaggcggatcatgaggtcaggagttcgagaccagtctgaccaacatagtgaaaccccatctctactaaaaatacaaaaattagccgggcgtggtggtgtgcacctgtaatcccagctacttgggagtctgaggcagagcattgcttgaacctgggaggcggaggttgtggtgagccgagattgtgccattgcattccagcctgggcaacaagagcaaaactctgtctcaaaaaaaaaaaaaa

SEQ ID NO: 16665 - DNA, 484 bp, Homo sapiens
tcctacctttcttacggctgcatagttcaaaaattgccagcaaaccaaaaggaggtaagagagaggcatgggacaaatttccctctgacatacatcagaaggaatcaaccgtgctggcatcttgatctgaaccttgtattctccagaaccatgagacaataaatttctgctgtttaagccactcaatctgtggtacttggttatgtcagccctagaaactaacacagctaggaatgaaatttctccattatttttaactctaagtcttgtttttcttttcccaatgcgcagtggacgtgttggttctatggattatcgaggtattctccagctctttcactatataattcagatgaccctctgatttctgtttttccataggtagatgaaattgcttgtcattttgttagctttcccttcagttgggcaacaaattatttagattcttcactagaatatcatttgtttatgcttaggcagccca

SEQ ID NO: 16666 - DNA, 557 bp, Homo sapiens
aatattttaactaactgtgaaatagaatgaacttcaaatattccctctggagtcaacctgcaaccataaatatttataaaagcaattatttacataaggacagatgaccatttattattatttgactacagtgtactaaattctattcaagactaaaaatagtttagtataaataggtataagtgtggcacttctagcccccaggctgcttgctgatagcataagaatatgagtaaacaggctgggcgcagtggctcatgtctgtaataccagcactttgagaggccgaggcaggtgatcacctgaggtcagaagttcgagagcagcctggccaacatggcgaaaccccgtctctactaaaaatacaaaaattagctgggtgtggtggtgggcgcctgtaatcccagctacttgggaggctgaggaaggagaattgcttgaacatgggaggcggaggttatagtgagctgagattgctccactgcactccagcctgggcgacagagcgagactctcttaaaagaaaaaaaaaaagaatatgagtaacagaataatgt

SEQ ID NO: 16667 - DNA, 557 bp, Homo sapiens
tgctctcaaactcctggcctctagcaattcacctgcctcgttcacggacttttctgatcttgcttgtctctgtttagggtttctggagtcagaactgctgtcaggatgagtgggaagggcatcccctcacctgtctgtgcctcagattcctcatcttcaaaatggagggaataaaactacttaccttgaagggctggtgaaaggttaaaatgagatgtaattagtttagacattacattcatacataattagtttagaatagaaactggcatgtgttaagtgttaaaataaatattggcagcttttgttgctttatctctatgaatcctttgcagaagttagagatcacggattatctagaggtaggccatggtggagaattgagaatgagatgtggagtggtgattggatgaggaagtcatataagctgcaggaagggcgagtgactgaggaagcttttgtggagtcctaattagagaaacagagttaggctggcaggaccaagggaaagcaaagagagaaagcagataaacggccgggtgtggtggctcacgcct

SEQ ID NO: 16668 - DNA, 528 bp, Homo sapiens
agaccctgtcttcagggtgcggagtcaggaagatgtgggtgtagttgggcgggggggcagtggtgagggtatgggtcacatgacacactgaaaacagatgtgtggaacacggcacaatgaatgctgtgattgggaacagtatcagatgctatgaggcaaattggagagtggcacctgagccttcgtagatgaggaggtagttggggcctcctggaggaggagttgacttctaaggtaggacctaaaaaattattaatagaagttcttcaggtgaagaaggcatggagggggaagagaggtccatggaaaagaaacaacagtatgcaaaagtgaggaagcctcactcctggaatgtctgtggaactgcagggtggagtgtagtagcagatgaggagggagggatgaggctgcagaggtgagccggggccaggtcacccagggcccgcatgtcaggctcggggaattggacttcatcttgagggtcatggggagccctgaaaggtatttcctctggggagtgactcagtc

SEQ ID NO: 16669 - DNA, 586 bp, Homo sapiens
cgacagaagggtgagtccttgatgttcttacagctgttgctgatcactttttggggggttttgaggaaaaactatgaaattgattctagacaatttaggcttttgtggttcactggggcccataaaactactgagctggggaagtgtgattgggagaataatgatatttattcaacgataatgtgcttcacatacataaagagaactctgcacagcccccgatagaaagttacggaaacattctcaagttagaaacagtaaatgttttgaaaataaagtggcactgtcttagaaatgcaagaaggcagaagcaaaatattagatttgataattaagaatataattaatgatgagaaaccccatattttagagtaagactatatcccatttatcatggctttcagtcatttgaaaatttatgttcgttagtttgattgtattttccaccagctctaaggaggagctggaagggtgtgtacttttttcattaacattggattgcaatattcaggcacctatctgttcttactttaaacagaataatttaggaatgttagttctaaactcaagctgagacaagataaag

SEQ ID NO: 16670 - DNA, 533 bp, Homo sapiens
ctcccctcattttaaaaatggagaggtaatcgtgcctctcatgagcgaatagttttagtatgcttagaacactgtcctgtacatagtaagcattcaacatatgttggctaatactactgaagccaattgtaacagtagtattagaagccgtaataatattaccccagtcaaatatgtccataattggcaatagggaaagaattgctgccactcagcagtatttggagtattgaatgtcattgtttactttttctggaaggagcgtgacctaagacactgatctaaactgaatgtgcatggctaatggtgtggatagacagagattttaagtgggcaaaagtgaaggttgttttgacaagaagtttcaggaaacagtgatgtggatgaatttcccagaacggtcccagaatatgagaataatgtcccacgtgaatgctaatcgaaattcccactcttcagaggaggctatcagcaatcaggtacacatcaaccatatggctgtcatgtagtctcttcgtatcaccccacttact

SEQ ID NO: 16671 - DNA, 584 bp, Homo sapiens
acaattttatcccttagaacccagaacagctgggagcagataaaatcttcttgggttatgagctactcaggaggctgaggcaggagaatcgcctgaacccaagaggaggaggttgtggtgagccaagatcgcgctgtcgcactccagcctgggcaacagagtgaagctgtataaagcacattgggccaggcatggtggctcacacctgtaatctcagcactttgggaggccaaagcagtggatcacttgaggtcagcagttcgagaaccagcctggccaacatgttcccagatgatgctgctggcctgcggactgtactttgtgaacttatgctggagcagatggatcagaaaccccggccagaggatgctcaggacccatcaagcccccgcggggaaggactcagacccccaaccccaccaaattaaagcaggcaatggagaattatactgaagggattcttcggttgggcaaaaacatgattagatctgcattctaaagactgctcgcagagtagaggatggattggagcagggagtctactgcaatagtacagatgcgatagtgaagacttcatttaaagc

SEQ ID NO: 16672 - DNA, 574 bp, Homo sapiens
ccctgggttaggaaaatgctcaccaacccctgggttagatgcacccttccagaaacacaacccctttcctactgaccagccctgtggacatgctttctctagccagtgtccatcttgaatgcaggtaacggcctggcctcagagctgagggcacctggtgctgggcgcatggcccttcagaggctagcaaaccagtgcttccacagaaggctcaggaagatggggtggagggtgtggtgggcagctcctctccgctgggcagctcctctctgctgttgaccctcactggattcatcatctagggtgttctagtaagtaatgaagaaacaaagaaattcctttgatcagggctatataaatttcctagggctggtgtaacaaagtaccacaaacagactgacctacacaaaaggaacttatcatctcagctgggcgctgtggctcacacctgtaatcccagcactttgggaggccgaggcaggcagatcacctgaggtcaggaatttgagaccagcctggccaacatggtaaaaccccgtctctactaaaaatacaaaaattagccgggcgtggt

SEQ ID NO: 16673 - DNA, 565 bp, Homo sapiens
attccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatg

SEQ ID NO: 16674 - DNA, 574 bp, Homo sapiens
tcctgcttcaagatatggaatcaactctcctccaaataatcctggttccttttaatggagaatgctattaaagatcacaatctgagtgctggctgcatgtgagcgtggagcagggaaggtggggaaacggggtaagcgtgctgctttggtggcaacagagacagaaacatatttacttgtaaggttgtgttcatactactctttccaacttaacacagcgtgcctggtgggttccacccacatttctcacagtatgagccttcagaggccactaagaccttctccatgcagacctaaataagaagccataaattcagcctttaccttttctccccatcccttcctgtcaggggaaggaagctggacagagattattttctgactagcagaaacagtgccaccactttactcttgtaagaaggctgccctacaaggatttggttttcaactgctttctccagcatatattctatgggaatgggggtgggtgcatgatcaactttgtattttgcacggacgcccctgtagctgggtcaaggctggatgacaggacagaggtcaggacagagaagca

SEQ ID NO: 16675 - DNA, 554 bp, Homo sapiens
ggttgcctgcaggttggatttaggtgtgctctgcatgtctcactttctggggctaatagatacctgagatatgcatgctcttctcatggcagatggtggagcacaaggtctgcaaggaacccatcatgcctcttaaagcctccactgagaaacgtcacactggtgcattcaattgtccaagggtgggggcttttttggtggttaataaagggctaggaaagagtgaacatttgtataataataaaatccacatgaactactagcatattatatattagttactatgtcttaaactcaatggcttatttccatttcattatacttatttttataattttcattagtgaaatacatgtttgtacaaaaaacccttaaaaatcctcaaaatgttataaaatgaacacccagatccccactttgatgaagaaaacgctgaattttgttcatatttgttttctgtcatgaatgtaactaaaatatttgtacaactatacaatcaacattaaaaatttatatagcatctattgacttccaagtgtaagacacatggacac

SEQ ID NO: 16676 - DNA, 545 bp, Homo sapiens
ctataaatagaactgtcgtgaagatgcaatgagatgaattttagctcagagcctgccacctggtgacttacccatgttaggtattgtggttacagctctgctgtcaaaccacttctccaactctctttctagcctcagttcatttgtcaaagggtttggccccagtattttgctggatattcagaagtacgacctcacgtctgcagaatgccactgactttcacacgaggcctcccaggaagggatgccaggcctcagacactagctgttggatctcgggacttgccactccactttggcatttttcaggaccacacggcatacagttgatctaacagtctttcctgtcctcccagtggtcagctgcagcccagttctagggcttctgtgggagaagacaggagagggctgggagtcagggcacacagatgtgtcagatgaggctttgcttgcaaggagctcaccacttgggtggtggagaaggcccagaaggcactactacagtgctcccaaatcaggaaaagattgctaaatgcccgtatact

SEQ ID NO: 16677 - DNA, 561 bp, Homo sapiens
aggatatcccggatttattaccattttcttgaaaactttacttgaacatttttccattcatgtgaaagcttagtcagagtgcttcatagctgtattacatgaacttcttaaactttccttaatgtggatgttaagaaagtgaagatttaataaaaagaaattcagatatttttaaaataaagggatatcttatatacatttatttgaaattgattttcctgacaaaggccatcactgaatactgaactcgttaatgggctttttattaggtctaagtgctttcctatcatttctcagccatgcgacacagtgagataaaactggtggagtctctgcatctgcatgtaaaatgatagagaacagagagtaatcacataaagaagctaacaagaaaaagcctttacaaatagtcgatgctcaataaattcttgtggattgaatttcttaattaacaacaaaaggaaggagcccagaaaaagtgaatagtaattcagattaggagcacaagccatcatgccaaaatgaaaatcaagctaggttttaattaatggaaatttgaaa

SEQ ID NO: 16678 - DNA, 539 bp, Homo sapiens
ggtattgtgaagcagggctgatgcttctcctggccacatgtgggcaccacttatgcctcttccaactatacttgtcactctctttcgtagtttacaatctttttttttttaaattttttttcttaaattttattttattattattatactttaagttttagggtacgggggggcaatgtgcaggttagttacatatgtatacatgtgccatgctggtgtgctgcacccattaactcgtcatttagcattaggtatatctcctaatgctatccctcccccctccccgcatcccacaacagtccccagagtgtgaagttccccttcctgtgtccatgtgttctcattgttcaattcccacctatgagtgagaatatgcggggtttggttttttgttcttgcgatagtttactgagaatgatgattaaagattttaaacattggaaagtttaaagtcttttaactccaatgaaagacctttgactaccccttactcccaaaagtttacatttaaattttaggagtaatgtagcattattaaa

SEQ ID NO: 16679 - DNA, 566 bp, Homo sapiens
ggaggtgatccacccacctccttttatttaatattaaaccagagagattttttaagaggccatccagcatgataggtaagagaaggtgcctcacatctcgctctgtcatttccatgctgttgtaattacttgagttctacgtgccttagttcctcttctgtaaattaagagtaaaagtagtatctacttcatttagattaataattaaaatgagtaaatgtaaatataatgttcatataaatatcttagaaaagggcctgacacatgagatacccagaaatataagccagtgttgtgataaactattacactacctgattatatcctttttttctagattctatattaggcttgcttgaattttctaatcctattaaactaattttgtaggatgaactagaaggaagaaagacacataaaagtaaataaacatgattctcattgctacaaccacataaaccgtcgtagaaaaggtaacctgacctggccgggcgcggtggctcacgcctgtaatcccagcactttgggaggccgaggtggttggatcgcgaggtcaagagatcgag

SEQ ID NO: 16680 - DNA, 565 bp, Homo sapiens
tttcttattatggcgaaatagtattccattataggataacaccacattttatttatccattcatcagttgatgaatggataaatatggatgatatttaggttactttcactttaaactcttattatcaataatactgaacatttgtgtacaagtttttgtgtagacatactgttttcatttctcttgggtactggcagtggaattgctgagtcacatggtaactctatacttaacttactgaggaactgccagactgctttccaaagctgctacatcattttacattcccaccagcagtgtgtgagggttcccttcctccctgtgccctccattcttaatacttataatgatcaacagtgatgacaacccattacaacttcacatttctcagttggggcactgaaagctatgtgtcctctcttttttaatggaaatattataaattgctaggcgtacaaaatttctcatgagaaagtataaagactttgttgagcacctttcatttttgccccttctctggcttaactaagtaatctcttgagaatggtatggtaccatgctctt

SEQ ID NO: 16681 - DNA, 572 bp, Homo sapiens
attcatggttcaaaatagaaatcgtaatgaaaattataaaaatcttttaaaagaaaacccaacattaaaacctgcatggtgcagctaaaggtgtgtgtggagggaaactgaccttaaatgcaaatattagcctggaaatcagactaagaaatgagcaacagcaaattaaaccaagacataacggaaggcaggagacagcaaagggcggcagtgaacgcgcaagcacgcggacacgtggcagggaggactaagacgccgaaagttctttgaaacacaaataaaatcaataaagtctcagataactaacacgggaggaaaaaggtgttatcactataggttccatcacattagatcataagagaacaatttaatgctaataatcttgaaagtgcagatgaaatggacacattctcagaaaaacacaaattaaagcatcatactctgggctgggcacagtggcttccacctgtaatcccagcaccttgggagcccgagacgggtggatcacctgaggtcaggagtttgagaccagcctggccaacatggtgaaactgtcgtctctactaaaaata

SEQ ID NO: 16682 - DNA, 572 bp, Homo sapiens
actggactgtgaatgtcaccgagcttttctcagattttcttctctacccttaggtaggaaaggatggcgagagtaggctgggattgggtactatccttctcccacatggttggctagggtgagctttagttgagtatttctcttctcccacgtggaaagttagagctgactagaattaggttttacccttctcctagttcagttaggctctgataaaaccccagaatgttaggctctggttaactagcttctcctgagggcagagtttgtcaagaggagcacagtgctctgaagctttcagaatgattcctatttccgtctccctgctggaagctcaaggggattcttcttgagaaggtaaaattcacaaaagtatggggtcctcatatgagggagtccccctgaagtttttaactctcagacttgttctcacctagcctctaacaatttgttgattacagttcaggtttcctaactctggcaccggttcctataaagacttctgtacattgttctcaatgtttgcatttctgtctctgattatgggagcagtggtttgccctgtgacctca

SEQ ID NO: 16683 - DNA, 428 bp, Homo sapiens
gaggcaccacctctctctctctgtttctgtctctctctatctctatctctatctctctatctctctcttcctctccaccatgtaagggcacagcaaaaaggcagccatcagcggggcaggaaaaggaccctcacccaacgcaaccatgctggctggcatcctaatctgggacttccagcctccagaaccctgagtaaatcttgcagctgttaaagccacccagtgtgtggtactttgctgtggcggctgacttagccaggggctgaagagggttagctgaaacacagatcgaaaggctcagagaagaagacatgctagaatggatctaatcctgctggctgaccactatggggtcagtccttcctggagaacagtctattttccaaggtgagaaagagtgcactggtgagggaatgccaacaaagctc

SEQ ID NO: 16684 - DNA, 559 bp, Homo sapiens
tgagtgctcccttgggcaatacaagcctgatggctgtgccctatcagacacaactgggtaatgcttctgacagccaccagcctgctacagttgaagttactgacctccattaatatacaacattgcactgaaatacactcctctatataagaaactgagtaatgagcggagcactacaatacttataaatacagatgcgttaaatatgggggcacatgcacatgtatacacactcacataacaatttgacctatcaaatgtcaaaaatgactaatgctggggcccggtgcagtggctcacgcctgtaatcccagcactttgggaagctgaggcaggcggatcacgaggtcaggagatcgagaccatcctggctaacacgatgaatccccgtctctactaaatatacaaaaaattagccgggcgtggtggcgggtgcctgtgaacccggcgtgttcccgggttcacaagaatgaacaagaatggcgtgaacccgggaggcggagcttgcagtgagctgagactgcgccactgaactccagcctgggtgacagaacaagac

SEQ ID NO: 16685 - DNA, 572 bp, Homo sapiens
tgcggctccgagaggaggacggaagggtgaatatgtagaaacagggagtagaacagtgggtagcaggagtgggcagggggaggaagtggggagatgtaggtcagaaggtacaaactcacagttatgtaggaggaatgactctagagacctaatgcacagcatgaggactatagttaataatattgtaaatatactgaaaatttgtgaagagagcagattttaggtgctcttactacacaaacaaaaaggtaactacaccagatgatggacatgttaatttgcttgacttatataaccatttcattatgtctatgtataacatcatgttgcctatcttaaatatgtacaaaaatacataaatacatcacacagataatcacctcataaaagaaagtattatccttttctgataagatggaagaatcaaagaaaaatgcaagtaagtcatcttaacatagttcttgcagtttagttaatgctcatagaagttagctgctatgataataaaaatggcgatgctgattgttgttataaaacctggccaggctagcatcccaagacagtctgtgagt

SEQ ID NO: 16686 - DNA, 489 bp, Homo sapiens
ggggtttattttttgagcaaaatggtcatttgccaagaagttctcctgtcagaagttctccagaaaattccaagacttacctgggaacaaaagaaagcctgctagcccagaaatgagaattttaattttgatcagctctcaggagatctgtgggaacctcaatttgctcagtgtctttgaaacactgcagtcttgtgtatactgagtgggtggccatggtagtgtgccatacacaggtgcaataaaaaatagcttatcaactcctgacttcaggtgatcctcccgcctcagcctctcagccttgccaacatggtgaacctctgtctctactaaaaatacaaaaaattacctgggcgtggtggtggacatctgtaatcccagctactcgggaggctgaggtgagagaatttctggaacctgggtggcagaggttgcagtgagctgagattgcaacattgcactccagcctgggtgacagagtgagactct

SEQ ID NO: 16687 - DNA, 578 bp, Homo sapiens
gtttgccttctctccaggctggcccacttcatttggggtttcccatgccccctgcttcacatcctttgactctggcttttgttccctccctcccagaatagctctcagttcatgaagcacaccaaacgccggaagctgacggttgaggacttcaacagggccctcagatggagcagcgtggaggtgagtggggtgcaggctacagagggctcaggtggcatgaggccacttccatgtccagttcagggctggcgatgtggtgagacattaagaccaaacgctgccgggcatggtggctcatgcctgtaatcccagcactttgggaggccgaggtgggcggatcacttgaggccaggacttcaagaccagcctggccaacatggcgaaaccccttctttactaaaaatacagaaattagctgggcctggtggtacatgtctgtaatcccatctagtcaggaaactgaggcatgagaatcgcttgaacctagcaggcagaggttgtggtgagctgagattgcactccagcctgggcaacagagcaagaccctgtcccaaaaaaaaaaaaaaaaaaaaaaa

SEQ ID NO: 16688 - DNA, 569 bp, Homo sapiens
  misc_feature 154, 155: n = A,T,C or G
gggcacatgcactgccctcagcatagccgccttagcacttcaggacttaaaaggacctcagagtcactgaatcaaagctccctgagagtcaaattcctctgtgaattcctttcttgcagggagggtggggagaactgtccaaacctcagtcttnnaatttttgaaaacagcaaaacttcagacaaagccaagtctagtgaagaaggtcaacaaccaggatgaacacattaaaataaggtggggccaaaagatgacaaaactggtttgcttctctgacccacaaaatggttctgagaggtaattccagaagcacctagagtaacaccctcctcccactgctgctgccggcacaacctctccaagggtggatagagagctcatattaacatctttaaggctgggcacagtggctcacgcatgtaatcctagcactttgggaggctgaggcaggcgggtcacctgaggtcgggagttcgagaccagcctgaccaacatggagaaaccccatctctactaaaaacacaaaagtaatctggcgtggtggtgcatgcctgtaatcccagctactc

SEQ ID NO: 16689 - DNA, 519 bp, Homo sapiens
ttcttaatatggctcatttaatgaaataattggtttttgttagtatggtccaaatttaaaaatggtaagtttttattcatttatattttcaaaagaaattgatagtttacattcatgatctttcagagcatgttttcagagtattatatattttaactgcaatgataaagagaatttcttttaagcatacactcaaattgaggctcccaactcactagtacttttccagagattcagctgcaagtaaaatctgaatagaaaaatcttaaagcttcaaggcatttcaaatttattaaacataaaaaattgaaattgtaaatagagacatgtaagtgtttaggagatacatagatgggtagacaagattgacagatgattgattgactgattgcacctgtgctttgttcccatttctcacctactttatttgtcttcagcctcctcatcaaatggattctccatgttgtaaaattactcatgtctccctttaaaaagaaatccagcagactcaactcttgc

SEQ ID NO: 16690 - DNA, 546 bp, Homo sapiens
ggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggagcatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaa

SEQ ID NO: 16691 - DNA, 544 bp, Homo sapiens
cacaatttaggatcgtgccagatcacccaacaaaagatggctaatacgctgaaagcaggtctcttggcaaaaacaggagtatgaagaatgtggacgtacatttccaattgctcgtgggaggccaggtgcagtggctcacgcctgtcatcccagcagtggattacttgaggtcaggagttcgagaccagcctggcccacacagtgaaacctgtttctactaaaaatataaaaagtagccgggtgtggtgacgcctgcctatagtcccagctactcaggaggctgagacaggagaatggcttgagctcaggaggcagaggttgcagtgagctgagattgagccactgcactccagcctggatgacagagtaaaactctgtcacaaaaaaaaaataaaaaataaaaaaaaacacaagaaaacaaaaaaaaacccaaattgcttgtaagagacccctgccagcatagaaacatttacccatctaatgattattcaagacctgggaggaaatgaaggtgttttatttgcataccaaattcaattaacta

SEQ ID NO: 16692 - DNA, 471 bp, Homo sapiens
gttgcactctctttgacagtattttgttgagaatttttgtgtctatattcatcagggatatgggtctgtagtttatgttattgtttttgcttttgttattttgtatatgtgtatccttttctggctttgtcagtgtaatgctggcctcatagaatgagtttggaagaattccctttaattcagttttttaaaaaatattttgacatgaattggtattaattcttctttatacagtaaagcaacatgctaagatggttatttttagagagagctcttaggtagttgtgcaaataattaatttagcatgctggcatttatgttgttaattaaaggaggaggtcagttcagaaatcatggtttggattaggtactcctcaaattgtacctaaaagaaagatcacgaggtcaggagatcgagaccatcctggctaacacggtgaaaccccgtctctactaaaaatacaaaaaatt

SEQ ID NO: 16693 - DNA, 574 bp, Homo sapiens
ttatcagaaaacccaagagtaaagttaggcttgtgagtaatgctagtctacctaaagctgtctcaaaaatcctattatctacctgccttggaccacttgtcagtaggcaataaagaattcaacctggtatatcccggatatactgcaaccaagattatcatgggacaatttctctgccacaatatatacagatgcttctctggttcattaattttacactgcctttcatacatatttgctcaatgtcacaatataattataggttgtgatattttataatctgtataggttgaattaagtcttcaaaaaagtcttaatccccacaccttatttagaaataaagtttttgcagttataattagttatgatgagtttcatactagagtaggatgggctcttaatactataagactagtttccttataagaagatgatgtaaagacatgagggaagaatgccaaatgaagacagagggagagattggatttaagctgccaccagccaaagaacgcctggagctatcagaaagagacaaaggaggatcttccctagaggcttctgagaaagtatggac

SEQ ID NO: 16694 - DNA, 570 bp, Homo sapiens
tgtatagcttgagcagtctttagcagtcctgcattttcgaatcctgtgtcaaagacattataaagttggagataatcaatgtgcaaagagtaattgttgtctaagggcttgcaaatctgcacaggtagatgaagggaaaagcaactaatgtccatttaaaacctatacttcactagatgtttccctagcattatcttttttaatttgcacaagttaaaagtaaggaaactgggattcccacaggaaatgcaggtagtagattctggatatgaattcaaagttgggtttcctaactttaaaatcacacattgttggggcagtactaacaaaatgaaaagttgtccaagaggctaatacaacatgcaggttttaatatgtaatggtgtgattcatcctacttcattagagtaaatagtttgagagcaaagcagtgggtgataggacattggatgtttggggtgacttgtctatctgttggtctttaagtacactttctttcatcatagacatgtgtgaaaaacacttattttaatttaaatatacaattattaaccctagttgagactactt

SEQ ID NO: 16695 - DNA, 573 bp, Homo sapiens
agcctaaactaaggtagtggcaatgggtgtagaaaggaggtaagaaattcaaagagtgctatggaatatatacatattaatgttgctgatcactttttttgtacgctctggggatgtgacaaatatgggttagggggatctcagtctgtactttgatttaggcaactgaatatacataaccttagtagtaccattcactgagttttgttttgtgctctttttgggaggagatggggaagaaaaataatccatatgaagatatgttgcgtttcaatgcctatgagatactaagaagtaggtattcagtagaaagttgaaaacttgggtctgctacttagaaataaggcctgttttaaactagatatgtgtcagatgatttagagaaacacaaggaaaaagtcaagaaaagatagcatcaaaatttaaggcagcagttgggacacaaagggagataaagtgaataggcttataaggaactgtcagaaggaggaaaaaacaagataacgtggaacaacaggatgaaaatagaagacacacgtatagtgattattatgtggcaggcactattctaaa

SEQ ID NO: 16696 - DNA, 543 bp, Homo sapiens
atgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacggggagggttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggctttttttatagagttactgatgaaaatgccaaaaatagtgaacttgaccttgttggtatgatctgctacaccagccaacattattgtgcctttgcatttcacaccaaaagttccaaatgggtattttttgatgatgc

SEQ ID NO: 16697 - DNA, 570 bp, Homo sapiens
ggaagaacaacagagcaaagcacacaccctcccgggtaatgcacttgaatcaatcaaaagcgtatacttggaatctaactgctgatggtttgggtacatctaaacttgtaacacaataaggagtgcagaagagtttctcttacaaaacttactgcaaacaatagaatcgggacagggtggtgcaaatagcaaaacaaaaggagcattttattcttcccccctccccaatatattaaatggttactctcaggcagaaaaccttttagttccaaataaatctcaagtaatagaaccagaagcaaaccaagctttctaatctacaccaaaatttctgggagaaatcttctacagaatccattccctctgtgtgtctcttaagagctgtagccaagagaaacttaaagaaataaggcagaaatattgtacactgaacccctgccctgccaaacctgactcaggaagccctatgtatggaaactgcataatgctcttggcatttgcagagctgtgctctcagataccttccagaagaatgacagtgtgtgaagggggcaggtcatgactattttt

SEQ ID NO: 16698 - DNA, 583 bp, Homo sapiens
gttgccaggtaccttattttaccaggcactgttaggctgacctgatttgctggagttgctaagggcaagtagtttgtaaattcttttaacaattttaaaatacctttgcctctgagcacaggcataggtggcaaaactccatagtttatctacatacataaattctgttttatgagatgtttcttagacttgttttgtgactaaaagaaaaatcaataatataaatttcaaaaaaaaatggttctgcaagaaaaataaaactcttcttcccctcagattgaaaaaaagtttaccaaaagactggaattgatgaatggagctaacagatcagtgctcaccaacctgctttacattgtctttggtagtttcatttttttgcctaacaaaaaacactcttccctcccacgatggctttaatagaagaactataaatttctaatgtaggaatttacttaggatggttattgggaaggtgtacagaacttttttttcaaggtacattagtacaccacaacctctttatgctttaggtgattggcatctatcaacattcatccttttttgcaaagagagaattgagaat

SEQ ID NO: 16699 - DNA, 539 bp, Homo sapiens
gagggaaaggaacaaaaaccaagaagatgttacataggagcagagcagaaaaagggccaacaattccagcaccaccatcatcattcctgttaaagatccgaccaggactgcatcctcttgacagcatgctgcaacacagtagaacgagagaaacgaagacttggatcccaccctacagcttgatctactggctgtgatgctttggtttcactgcctgacctttgcctcagcttcctttttttccatttgtaaaatgaaactgacaatgcatcttaaattgattataaaaatcagttgagaatatgtatgtgaaaacactttgtagctgagatttaaaatgttatatatggctgggcgcactggctcacacctgtaatttttgcatttgcaaaatttgcaatttgcaaaatttgccttacatcacatctgtaatttttgcacacctgcatttttagaggctaaggcacgcagatcacctgaggtcaggtgttcgagaccagcctggctgacatggtaaaaccccatctctacgaaaaata

SEQ ID NO: 16700 - DNA, 579 bp, Homo sapiens
tctgtgcataaatggacatggattatatgtgttatagcaacctatcaccttggcaccttgttatcagcttactgacattcaaactccaagacagctagaagaatgactcttttccaccaaacagtattttaaacaaaacttaaacccaaagtgggatttggagttcacctctgagctcatggaaatgtgaataaggtctaagaccaggtcaaagtggtcaaatagcttggaattcattcagatattttttccttgtcaattaaaaaagggataattttctcttgccagtgagtagcctttggtttgggaatattgtataacccaagaaaccatcttaataaattagccaggaaatacactgcttgagcactcttgttgtttggcctatggggagaccatatggctaaatgggccaggggggataaaatggggcaggaaatatgcatgatgaacatcagggaattgcaatttttgtacattcacaatccaccacaattcattgcaccaaattcctttcattttttgtcactgatcacattcttatgaagcaacttctagtatgttgggtctataaaaacc

SEQ ID NO: 16701 - DNA, 444 bp, Homo sapiens
ttctcaaataaacattcagttttttctgttattgggggaaaacctttaaaattgtatctcacataacaaaattaaaatttatttgcctgattcaatgaaaggcctcttctatactttgaatgaataaactggccacggcaatcagaaatagtaaaaacaggccaggcatggtggctcacgcctgtaatcccagcactttgggaggccaaagcaggcagatcacgaggtcaggagatggagaccagcatcctagctaacatggtgaaaccccgtctctactaaaaatacaaaaaattagccgggcatggtaggggacgcctgtagtcccagctactcgggaggctaaggtaggagaatgacatgaacccaggaggcggagcttgcagtgaggcaagatcgcgccactgcactccagcctgggcaacagagtgagactctgttaca

SEQ ID NO: 16702 - DNA, 451 bp, Homo sapiens
ccaattaatattttgacccaaatattctctctatgaaattgcagccttggaggcactccacctctctgccagtcatttctttaaaatagtagaggagagagacaaggagattaagcaagggaaggaaaattctacaatggaaagtgatcagttgtctaagacccatggatcagagtcttcaatgaaaactgcagttatagttaaaactataggaatagataaataaggagaaagaataaaatgaagacatagaaaagaactgcaccctgcagtacaagtggatcatcaatacccttcctcaccttgtgtgttttaacatacattttgtgatgtgatttaaaaacaaaaacaaaatcattctgctgcaggtaagaggaatattatttctattttataaacgaggcaacagacagacaaaaagactatatggaatttattaaattcatttact

SEQ ID NO: 16703 - DNA, 311 bp, Homo sapiens
aagggactctggtccaagtctcaaacacatccataaccctgggtttgctggctggggtttcatggcactgcctggcctctcccttccagtctggcttccctttttctgcggcccaccactcttcctgcatctgtcacactcgtctccatacacccctgctgagaccccttctctcctggcccaccagtcagaatggaagttctactggcctccaacttttgaattccaacctggcctttactcaagcccacgccggggagcttttcctgactaagaactccttgagcctaaccttataccgagaattccct

SEQ ID NO: 16704 - DNA, 580 bp, Homo sapiens
aatccaagaaaacatcccagaaatattgatccataacagacatatttaagataaaacttccagagaagcaaccaattagaaagagtgatagttcttctatattcttgactaaagtgaagatgtatttcaaaatttgttagtatgctgtttaagcagactggccaagactactcactcacttatgaaaagatcatattagcactaagtggagaagcagtgctgtgaattaggaggctctgttagtatatcttgtatgttcgttaactctcagctgcaggaaacagtaccatccctagcagcaagcatttaatatgggaatgcaaatgcttacaaatcacttgaaggtcttttggcctaatattcagaatcactccatgaagaactggcttgccagtgagctgctgtctttttcggactttaataaaataccactgtggctattatctaggcacaaggaagacaccactatcaaaactgtctctcaacaaccactaaggtagtggctagacattagtctctgttatagaaaatctcaacatcactgtacttgtctgcagcaacagctaaagcaaaggaagta

SEQ ID NO: 16705 - DNA, 547 bp, Homo sapiens
taacatcttcagatgcccagaaaaaggagcagagaatttacattgtagtgaagtgaggatagtggttttttctaacagtttattatataaattttcaaatatgcaaaaaagcagaataattttacagtgtacaaccatatgcccatcaccttgtttctacaatcaacggtgtacttgctttaccacgtatctttcaagatgatatttgaaattaatgttttattatgggcattgccaatgtatgtgaaaatagagggaataatataatgagccctcatatattcatcatctagtttcaacagttattaattatggctaatattatttcctataaccatctgtctcttgtcacattcttcactagattatttaaaagcaaatggaattttgttgagtggatttgttagaagcaaaggaatacagcataatcacaggccctggagcaagagttgtttcgtgatcaaacatggaaacccaagttggcagagaaggacatggggccaggaggggactgataagctagaataaaatggaaggatcaaggggc

SEQ ID NO: 16706 - DNA, 507 bp, Homo sapiens
caaatggttcttatttaggaaacacacacattattaccttagaaaatatttcattatatttgcaagctacataaaatagttcttgtatgtgtataatttattttatcctatcattctagaaaggattttaattggttcttatttttaatgtatgttaactgaacaaaaggctgtataattttctgtacacatatgaatattttctaactcattttcattcatctcaactttagaatgtctcatttttcttgactaaaaaactctcagagccaacagttatgccctccaaaggaagcaatgcaggtgataataagtgaaaaaatgctgatacagacccttttcaggttctggcaactgagtggctaaaaatagccagctagaaaaatatgtacgttcaaaaaggcctttgacaaaattcaacaacccttcatgctaaaaactctcaataaattaggtattgatgggatgtatttcaaaataataagagctatctatgacaaacccaca

SEQ ID NO: 16707 - DNA, 557 bp, Homo sapiens
ggtgagctctacaaacttctaaacagaatgtgcaaaagacttccatacattttcacatttttcttcatccaactcatcttttaggtaatgaactagcaaatgtatcatgtagttttgaatttttcaagtatgtattttaatgctgcaagttcatgttttcaattcttttaaggatgtttatttaccattttgataataacttaaatcttcaaatatctggtatgactccatcaattgaaactctcttcataccagattgcaattagcatcatatggtataatgccaattagtgattcaatcacacaatggtatagctccatttctctctatatttataaatttcttctcatatattaggtgtatttgtaattatctaaaatagtcactttaagtacatttattaccaaatggtaatcgctgatatattcatgtaataatttaaaataacacaagacacataaacaatttccatctacaaaaataaacttattataaaaatataaaataatattatcttagagctctgaaaaagcaatccagagaaatgacttgctga

SEQ ID NO: 16708 - DNA, 461 bp, Homo sapiens
atgcaccaaacatgaagactcagtctgcttggtggaacccaactagccccaaagacccggtgcttgcctaacgtctggcaaagttacagctgagactgggaactcgaatttcattaatgttttctattaaaagcaccatttcccattagtatttggagggtaattgatctctagaagtgcatctcagggcagggctgaaggtgttaccacaaagggggaatgacttcataagtctcccactgagctgccacaaagccaaatgaaaatatctccagttccctggggaccagtaaggctattagattagagctcaggtgaagactatttgatgagtcagtcttcagaggaaaagccacggttgtaatagcattggcttgccaaagataaaacagcatttaaaaaccaggtaattttaaaagccccaaatcaaaggttgagatactttataaactttgaacagt

SEQ ID NO: 16709 - DNA, 573 bp, Homo sapiens
tcacctcccaccaggttcctcccccaacacctggggattacaattcaagatgagatttgggtggggacataaagccaaaccatatcagaccccattcctctctggacccgcccctcaccccatataactactctgaattgtccagttgaagagactgtcatcctccatcacacatctacggtggacagaggatgggactcacagcacaccaacagcttacgtaaacaaacacacagaaacaaaacaaaacaaaaactcttctaatctctggagactattattctaagtgaagtaactcaggaatggaaaaccaaacatcatatgttctcactgatatgtgggagctaaactatgaggatgcaaaggcataagaatgatacaatggactttggggacttggggggaaaggtgagaggggggcgagggataaaagactataaatggggtgcagtgtatactgcttgggtgatggctacaccacaatctcacaaagcaccactaaagaacttactcatgcaaccaaacaccacctgtatcccaataggaaaaaaaataccttctaatctcaacact

SEQ ID NO: 16710 - DNA, 521 bp, Homo sapiens
gagcagactgaacaaatgatgtgagaatctcttcagttccaaccaagtggcgggaaccagctaagagttgggtactgctgaggaaaattgatgggcagttggtaaaataggtgtgaatgagagaaagctttgttggggaaccatggtgggtatgtgggcacgttctacattactacaagtattgggaatttcccaggggaacagcaaaatcttgtcttatttatgtttaattttaaaaaattcccactgggtgcagtggctcacgcctgtaatcccagcactttgggaggctgaggcaggcagatcacgaggtcaggagatcgagaccatcctggctaacacggtgaaaccccgtctgtactaaaaatacaaaaaattagccaggtgtggtggcgggcgcctgtcatcccagctactcgggaggctgaggcaggagaatggcgtgaacccaggaggtggagcttgccgtgagccgagattgcgccactgcactccagcctgggcgacagagccagactctg

SEQ ID NO: 16711 - DNA, 570 bp, Homo sapiens
ttaacttcactctggtgtgggggtgtccttgatttccttggtgtcaggcaacaaacctcaggtattaccccagacaaacaatactgcttcacagagaatacctgatctcccaaaatttggttaagatctgaagtttattttgccgtacaactccattttttgaaggggggcttgcttccaacaaggaaggcaagatttcttgcttccatgatgatggaaggcaggtaattcctctatggagttggagctcgctcccaacagggaagatgagtttgagttttattcctgactctaggatggtagaggctgtcttcagcctgagacccatccctaagtaagttaacaaccagctgttcctaatttctctttaccattagagtgcccagtaatcatattgttgggtttttttattgttttttccagactttcttccatcagatttggtcaaatctgagtgagaatttcaaattttgggtaacaaagcctctctaatttggctaaaattcctctccactgcacaggaaggggaaaaaacaaacacgtgcttggtttctgagcttgcttcctgtc

SEQ ID NO: 16712 - DNA, 546 bp, Homo sapiens
tgagttggagattgcagtgagctgagatcgtgccactgaactccagcctggcaacagagcaagactctgtcaaaaagaaacaaacaaacaaacaaacaaaaaaacagcactagctatcagaagacaataaattttattgtttcacgggacaccagtaaacactaagtcaaatattttcatgtattgatctttaccatatcacactgttcccattttacaagctgtttcatgatttttaaaagtagttcacttttaattgacaaataataattgtgtatatttatgggatacaatgtgatgtcttgatctgtgggtacactgcagaaagagtcaatcaagctaaataacatacctgttacctcaccaccttatcacattttgttggtaagaattttaaaaatctgttagcaaatatgaattgtacaatacatcataattaactatggtcactacgcagtacaatagttttgtaaaacatcccacctatccaattgaaactttgtgccccttgagaaatatctttcttttcccaatccctcctcctct

SEQ ID NO: 16713 - DNA, 571 bp, Homo sapiens
ggagggctgtggcaagccatgtgcacaaagatgcctgtttcctgtcttcttggttaaaaacaaaaacaaaacactggaaggaaccccaaagccaagctgccatgggttgcagagtgccagcccttaagtagtgttgttcatgggtaaacaggagacggataagggcagggggaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggaaagatagaggagagttcattagcatcaaaccaccatggatttcataatcaattcctaatatctgaatagatgcagaaaagtcacaggcatctagaagtgtggcccaagttctgttcttcaatcggcccaccaattatccctatgtatctcgattttgttatctaaaagatcacatgatggaggatgtaagcaagtaatacagccaagacccagtttacagtgtctag

SEQ ID NO: 16714 - DNA, 562 bp, Homo sapiens
ctccgtcttgccaggcgagtggcgagtcttcagcggcagaacgtggtcctcccttcggggtccctgagctgcaatgcagccgcttgaggctggggacggctccaaggagcccccagtcaccaagaagcagcctccagaaaggccgctgcgggttccggggaaaggcgggctgaacgtgcattcccgtgagactgcctggaggggcgagctctgctgcggggcagggggtgcctgatgtgggctgaggcctgtgcagagaagccaagaggacacctggaccctccgccgagtccagccaccagagacccagagccccccacgaaagcagagcctcgggccgggccctgtggctcacgcctgtaatcccagcactatgggagcccgaggcgggaggatcacgaggtcaggagactgagaccatcctggctgacacggtgaaacctcatctctaataaatatacaaaaattagccgggcgtggtggtgggcgcctgtagtcccagctactcgggaggctgaggcaggagaatggcgtgaacctgggaggcggagcttgcagtgag

SEQ ID NO: 16715 - DNA, 555 bp, Homo sapiens
gttcggaggactcattgcgctgagcccataaagaatcctgagaagttctatccagagaaaccagttcattttgtccagtgtttcccaaacttatttcctcatggagccctcctccctttttccatggaatatctattaacctcctgcagggtgagattccaaggtgtgacttgggcaaacactatccgtaacttccatagattcactctcagtccccttcagggggggtttcagagcaattaaatgcctactgtgtgtgaggcccacagcaagtggctaggaatacatcaataaatcagacacaccccagcttgggaggaacctgcaggctgagcgacagccacaccttactgcttgagtctgacctgggcccaccaaggctgtataaccttgaccaagtcactcttctcctctagtcttcaattcctccaactgtaaaatgagagaatgcaatgccacaatccctaaagacctggccagccggagcaccaaatcccttaggctgccatgattggttccagagtgggtgcatgaaccaagctgagccaatgagcg

SEQ ID NO: 16716 - DNA, 486 bp, Homo sapiens
gacagaagggtacggctgctagaagacgagggaagggtcacattccttttccgactccaagcataataaagcataattccctctgcagaggaaaaatggaaagcggaaagagacaaaaagcttctctactatgtaggtaaagaacacctgcaaattcacattacctatgaattgatcatttgactgaacatttttctactaaagtattttactgcaagagcagctgtagacaatacacacatcaataagcaagttttgttccaacaatttacagaagcagggatatttggcccatagtttgctgatccaaatttaatttacagattttttttaaagtgccaatccagcagacaattataggggaaaccactattttaaaactcaaaaattcaaatatataaaagtgaatttagaaaaaagcctagaggtgggaaggcaaggaatatctgaaattgtttctttttatttatagatattaaagtaata

SEQ ID NO: 16717 - DNA, 565 bp, Homo sapiens
gaactttactaataatgaaaataaccactgtgctggtccagtggcaccacttcctttttcatctcctttgtattcttcaggttacatcttcagtgtcaggaagaaaagccttctgtctctctctctccttgggattaggttaaatcttatttgagttttctcataccattgcaactgcagttttacacatttagatatgactatggaagatatgaccttcatgaagacttttggtgtcatggatgtagatgggtgctcatggaatatttctcagtcgaatacacgagttaataaatgaatgagtttgggcttcacaattaaattggaggtttagataagaaaacctcagagaacaaaacatgtataatattttctaattgatttatgtgtctgccactctggcagatgatgaattcaacatgacctttgtacttgaagtgttcatgttaatctaaagcattccttattgttttcagggctacctgagaatcctagaacatttatgaatattataattgaaatacttaggaatgaatttctctcccagcaggttcttcatatcccc

SEQ ID NO: 16718 - DNA, 384 bp, Homo sapiens
agcttaaagtatgtgtaagagaagatgcctaggaaaatgaaagtagctccagagaaaatgggctgaaagaatatatacaagaagcaggaaagagtcatgggtcatcttcaagggtaaattaatttaattctacctttgaaacagtaggggcagcctcctccttacagtgaacaaaaggcagcaggtgcatttgattctaagctaaaatcagctaattttctgaagaaagtaaactgcctacttgaggaaagctcttgctgtgggtataggggcctcagagagaaacagagaggaacctgagttaactgcaaaattctaccgcagatataaagaaaaggaaacaggagaagtagctctgcaaaaaaaaaaaaaaaaaaaaaaaaa

SEQ ID NO: 16719 - DNA, 410 bp, Homo sapiens
tagcttctccaagtctctgttttctcatttacatatctgctacagtcatgaatgtatattgtctccctagaggattgtggggccatccgtgatgggataaaaattattaatgaggaaatgttctcaaacctaactagacggatagctggagagagaacttagatgtgtattttataaattaccatgtgcacatacaccctttttttggcaagtggtgggaggtatcagagattctgggtgggggctgtggcctaagcagctccttggtcattgggacggtctctgggccctgacgcatgggagggacagttggctggtaggacacttggaggtgggggctccagctaagccactgcagagatggggcgtgggccatgcaaggtggtgaagactgggtgtaggtatgtgtg

SEQ ID NO: 16720 - DNA, 381 bp, Homo sapiens
acctgattcatacccctcagccccccaggcatctgaagccacacagggccctgctactggtttgctggtgtgcctaggccttccctctgccttttcccaagcaggagaaagccatcactacaggaactcatactgaaccaccagaccacattcgcgcaggtccctgtactaaaggccagtccatctgagctcccagggtaggagagcagagctcagaggctgtgtcattcacatacccacccacctgcagagggcctctctgggtcatcagtggtcctccatcctatgaggggcaatgagcttccacagagcacaggtggaagctgctggtgtccctaggggctggagcactgagtttcatactagaatctgatatagagt

SEQ ID NO: 16721 - DNA, 172 bp, Homo sapiens
ctggttttgaactcctgacctaaagtgatctaccaccttcagcctcccaaagtgctgggattataggtgtgagccaccacactttgccaataagatatatttcatatggcatctaaccacaaatattccgaaggtttcagaaaggaactgaaaggaagaaatgggctggata

SEQ ID NO: 16722 - DNA, 323 bp, Homo sapiens
gaactcccaggctcgagtgattatcccaccttggcctcccaaggtgctcagattacaggtgtgagccactgtgcctggctaccataccctgtaagtgtgtttttatcaaaaacaagctatgatacaggccatttattttatggatgatatctccatatgacctaattggcaaaagcagtcctcaaaacttatcaaagcatatactactaagtactaacagattcacctgttggtaaatatttttttgttaaaaggatgtagaaagtgttaaatattttataaaatataaaaattaagaattgactatattttatcatgaaaag

SEQ ID NO: 16723 - DNA, 499 bp, Homo sapiens
ttattatttccatttagatttgtttttagctacttttttggctaattttcagattaattaatttacatgttagttagaatttgaatactgtgactagcctaagcaaaataaagatagtgtctaaatatacctgagctattaaaacatagtcgttatttgaagttggatcacattgtacatcagagcccatgtactgactgtgacctgtgttcttagagttgactaaaactgaagataagtttttgttctccacagggtcattttatgtgtaggtgaaaatatttcctagaaacattcttcacagtaatttgaaataatgaaggcaaatatcatatgcataatgtgaagaaaacctaagaataacaatttatctttaatatgcaaattaggaaaatgactttagtagttattaacctgttgactgtacaggtaaccttcaggttccgattgtgtgggacagcagatagctttgtcctcggagtccaaaagagaggcagga

SEQ ID NO: 16724 - DNA, 226 bp, Homo sapiens
ttttgacaaggaaacatgaaggacaggccattaaaagataagtaggaaaacataatgctgtccacagccaaataatcataataacaaggaacagggagcaaaagaatagaggggtgagaaggaaagcaccaactctatcttaagtttttaacatgctttcagtattttctaggattgcagaggaagcccagaaggacaaacaagtactgggatgttggatttgggg

SEQ ID NO: 16725 - DNA, 294 bp, Homo sapiens
gggtaacctggagacattcagaaaatatctgtggaactcctgcattttgtgaggcactgcccagggcattggagagagagatgcctttgtggtggtcctaaaagagttcacagtctggccaggagacattgtacaaacagactataaatggctgtgcttcttttttttctaaagaatgttcagcgggagcacttgggacctacctgtgagagctgaggaaggcttcacagaagaggtcttgcttaagaggaaacatttggggccaggtgcagtggctaattttttgtattttct

SEQ ID NO: 16726 - DNA, 291 bp, Homo sapiens
gacagaagggtcaccctttcacatttctaccagcaatgcactagagttcaaatttcaccacatccttgccaacttgtgttattttgttgtttttgtgctgttgttgtttttaataacagccatcctaatgggtgtgccttccttaggaggcagccacatatgaaatccatgtgcctgtgttaatgcaaaggtggaatttcctatggctggcatgctcactgcacagggatggaaggccagttgggtggaaaggatgagaaagctgaggtcctggagggctttgagggacgg

SEQ ID NO: 16727 - DNA, 415 bp, Homo sapiens
aggagaggttggcactttcaggaagtcacaattagttcagcatgagggagggctgaaaattccctggtggcccagggtgcagcgggcagggtgagggaagcttgaagaaccaaggccagaaaggtaagaacgaatgtcacaggaggagtcaggcatcctctgagttccatgagaagccacacagggtgtcaggctggcaaatgacatgaccagacagccatggaaataccactctagctggatagcagcttgcggggcagagccgttcttacctcccctttctgagcctccatgaggacatctgctcccggtgtccactgccttccgggatctccctcccttctttcactggctctcctgtacttaccctttttcctggtcctggactcttctactcctttcttcaaagtccctg

SEQ ID NO: 16728 - DNA, 437 bp, Homo sapiens
tgtgtagacaattgtagaatttcgagctaggagtagaagagaactaatgctgagattcctttctgttaattttttttcatgattctgataaaactcaggattctctcctcagaaacatgtacacgtaaaattttgcatataaattttggggcttggccaggagcagtggctcatgcctgtaatcccggcacttggggaggcctaggtgggtgaatcacctgaggtcaggagttcgagaccagtctggccaaccttggtaaacctcatctctactaaaattacaaaagttagccaggtgtggtagcaggcacctgtaatcccagctacttgggaggctgcggcaggagaatcgcttgaacccgggaggtagagattgcagtgagctgagactgcgccattgcattccagcctgggcgacaagagtgaaactccatctc

SEQ ID NO: 16729 - DNA, 468 bp, Homo sapiens
ggtattatctactaaagatgaatcaagagtgcaaaataaccaaaatcaaattcaccagccccagctaagtgaaggttattcagtacttttagaataactgacacagaggcagtgattcatcttgtcttccccacccgcctgtttttgagatggggcctcactgcagtagctcaggctcgagtgcagtggtgtgatctcggctgaggctcgagtgcagtggtgtgatctcggctcactgcaacctctacctgccaggctcaggcgatcctcctgcctcagcctcccgagtagctgggactacaggcgcacaccactatgcccagctactttttttgtctttttttagtagagacagggtttcgccatgttacccaggctggtctcgaactcctgaacttgagcaatcctcccacctcatcttcctgaagtgctgggattataggccagccttttttttttttttttttt

SEQ ID NO: 16730 - DNA, 122 bp, Homo sapiens
cagcacatagcatctaggacctgatacatagctgataccagataattatttattgaaaatataaatcaatggatatctatccaaactgcaattctaatgctctatataatttataacttcat

SEQ ID NO: 16731 - DNA, 461 bp, Homo sapiens
gtttgcctattagctgctttgtattgctattattataaatagacttcacagttttagacttgcttaggtgaaattgcaattctttttactttcagtcttagataacaagtcttcaattatagtacaatcacacattgcttaggaatgcgtcattaggcgattttgtcattatgcaaacatcatagagtgtacttacacaaacctagatagtatagcctttatgtacctaggccgtatggtatagtctgttgctcctaggccacaaacctgtacaactgttactgtactgaatactatagacagttgtaacacagtggtaaatatttatctaaatatatgcaaacagagaaaaggtacagtaaaagtatggtataaaagataatggtatacctgtgtaggccacttaccatgaatggagcttgcaggactagaagttgctctgggtgagtcagtgagtgagt

SEQ ID NO: 16732 - DNA, 140 bp, Homo sapiens
cttcaatgcttctttagaatgatttgtgtgtttttccagatgcatccgcatttgagattgaacttaagtttagctgagtggatcaagatggcccacatttgtttggaagttatgtttgaagtgttatgagaatagagagg

SEQ ID NO: 16733 - DNA, 345 bp, Homo sapiens
tatgttattggtaaagcttcaggtcaataaaaggctattactagttaagtttgggggcagttaaaagttttatgcaaatttttgaacgcacagggggtcagtgccccaatccccacatcttttaaaggtcaattgtatatgtttgtttgatctcacaagagagacaatgtttccacttaaatagggaattaagtttcatgacgacttcatttgattacttaatttcaagcctcgtctgcaactgtgaatatttactgagagtccgttgtgtaccagccactattttaggcactgaggatacaaagaatagagaaacagtccctactttcagatattttatggagt

SEQ ID NO: 16734 - DNA, 232 bp, Homo sapiens
  misc_feature 182: n = A,T,C or G
aaccagtaactagatggcaatcaggtctgttactgaagatggaaaaactatacttaagtttgtataacaatctttcataacatggcttcacagaaaagaagtataaaaaggattccttggttgaaaaagagtgctcttttcccttcattatttaagattaggacaaatttataaaacagganactctctttcataggaagtcaatttacagacttccatcaagcccttagag

SEQ ID NO: 16735 - DNA, 337 bp, Homo sapiens
acagggccctgctactggtttgctggtgtgcctaggccttccctctgccttttcccaagcaggagaaagccatcactacaggaactcatactgaaccaccagaccacattcgcgcaggtccctgtactaaaggccagtccatctgagctcccagggtaggagagcagagctcagaggctgtgtcattcacatacccacccacctgcagagggcctctctgggtcatcagtggtcctccatcctatgaggggcaatgagcttccacagagcacaggtggaagctgctggtgtccctaggggctggagcactgagtttcatactagaatctgatataga

SEQ ID NO: 16736 - DNA, 389 bp, Homo sapiens
agaatactaggtattaagtaaatattgtttgagtagataaaagacattagtgttaagcaataaccctacattcttaaaaaagagagagttttattaaattgctaggaacttaaaatttttggatctcacattccaaatgcataacacaagattttgctttcagtgtgtatcactcaaaattaagctagtaacaggtaaactagctatgttccctattcttatttcttggatatgaggagaggaaacacatgcagcaggaaagaaaaaggtgactaacaattactaaatttcgagagtaaattggattgttttgctctgtgcaactataaaatggtgattaacaaacaggtgctaaatgttaatgaagtatatgagattaaaaataaaat

SEQ ID NO: 16737 - DNA, 261 bp, Homo sapiens
aacccaactgatcccacagcataatcattgtcatattttgcaatatcaattgttaggtgataatttagtagtagggagatagcaacacctccagcagtgtctatgatagtatgagtgggtagtctagtttagtcccagattgaaagaggtctgataaccatgttaattagattaggcctcaggcaattttacagtactgttcattgtaagacccaatagatatagctgtgatctaacagggaatgataaagaccaacaagc

SEQ ID NO: 16738 - DNA, 114 bp, Homo sapiens
atagaagtccttttgagtgctggattttctttatttaggattcttttattccatcttggttccagcttttaacattttaaggacattgcatagaagttatttagggttaggctg

SEQ ID NO: 16739 - DNA, 434 bp, Homo sapiens
gacataagggggaggaggtgagtgccagatgcctccaatctgccatgttgaactgcctctgtatttctcatttttaaattgatatataacacatttacaacacagtacacaagtcttaaatatatagttcaagagattttgacatatgggccaggcacagtgactcacacctgtaatcccagcactttgggaggccgaggagggcagatcacttaaggtcaggagttccagaccagcctgtccaacatggtgaaacccgtctctactaaaaatacaaaaaaattagccaggcatggtggcatgcacctgtaatcccagctgctcgggaggctgaggcaggagaatcacttgaacctgggaggtggaggtcgcagtgagccaagattgcaccactgcattccagcctgggaacacagcgagactccgtctccaat

SEQ ID NO: 16740 - DNA, 253 bp, Homo sapiens
gggagaccgcctgggctcccagcctggctctcagtccagcggagtgaccttaagcaagtcatgcatcctgatgggactgcagatgcctccccaaaatggaactacgggggaggatggatggatggaatgaatgaatgaacgcatgacttattcaacaaccattagccaaggccctacatgctctccctgttccaggtgccagaaagggcaatggaaaaacaaagaggctcctgcccttgaggaacatgggacg

SEQ ID NO: 16741 - DNA, 456 bp, Homo sapiens
taggtagaggtttaccttccctgcttggaaagcttctattagtgccacaattcatgggcttatggaatgccttgttttatcaccatgtatcacaaatatctttgagcaagaaagtaattttattatgagagaagtgtggcagcagagtcatgcccatggaattaactgatcttacccatcactcaggaacagctagtttgataggatagaggaaagtatgcagaaggatcaatcgtggtgctggctgagagaaaacccctgtaaggatgtagtataggactcaacccagtcaccattatatgttgtcatctactcaatattcagaatgcatgggcctgtgaaccaagaggcagaggtaggagtggctcttctattattcctaataactctcttgaaagtttttttctctacaactttgtctctattatattgtccctataggattggacttggtga

SEQ ID NO: 16742 - DNA, 416 bp, Homo sapiens
agatccaaccttgctctaatatgacttataaaaggcttacgggaaatatggctggtttcactgttaatgattcccctctcctttcttccctctcttcatagcaggctttattgcaagaaaacttacaggaggcaaagtgttcaagtgtaaagaacgatacactgactatccagatatgagaataatttactctgtttccttgaagagattacaccacaaaatagataagttagtaggtaaagaactgctttcttccaaccaaaaaaaaggagaaaggtggtttttagtagttttagttttgccaaaactaccgaagttgaagacttcccaaaactactaaaggaagactgaagtggaaggactgcttgaggctaggggtttgagacccggctgagcaacatagcagggcagggagt

SEQ ID NO: 16743 - DNA, 502 bp, Homo sapiens
accatgagttactatttagtagccacttgaacagcagatttacatctgattcaacatgtaataatcattcaaaaccattaactacatgaatacaaaaataattattcctatacccagtaaaaactgacaattaggaggcattacaattcctgtctttaaattctgactccttgaagtctatactagacatgcccaggaaaatgctaaaaccggcctggacagctctggccatgatgcacatagtaacggccacctattttgccatcacggatgtgttgtaggattaaaaatagacttatgcaagtgacaattacaagccatttataactataaaacttaacaaaatagctgccagtttgctgaatctgaaaaagaaacctgtcacatttactgaattagtttaaccatagaattcagatgttaaaagaaactagactaaaggaagaacttctacaagctctcctgtcataagatttttacagtttctcttgactggaaacat

SEQ ID NO: 16744 - DNA, 507 bp, Homo sapiens
cggagcatttctttccttgctgccacctcaggaaggggcgtattctgccagggtcaaatgcaagtacgagcagccactccagcctgtgtgagctgtctcgagtctcttgctattaaggaagaggaattaagaggaactcaggaagaggtagttcactgaatagaagcctgttttgcagatggtgatatccagtcaggagtatttttaatcactgtctacagagacacctacatacacacacgggtggggaatgaacccaaagtttttaggtgaagtctctcagggcccacccgtgccacagaccttcctcggttgcagagattctgggcaaagcatctgtgctctcatgagattatcctggggagatttagaagaattttgtggccagtcccaagctgtgctgataatttttaacacctaatgctactaccaatacttttgttaatacaggaaagactggctgggcgcggtggctcatccctatctctacaaaaaaaaaaaaaaaaa

SEQ ID NO: 16745 - DNA, 192 bp, Homo sapiens
agctagtgttgtgccttttacatattagagcatcataaaatgttttgttcttgtgttttttatttaactctctgctcatagccattcatacctgactatagtctatttacttggatctcttttctatgtgcctgtattatctatttgtttgctttcttgcttttgagttgacttattgtactttaggattca

SEQ ID NO: 16746 - DNA, 337 bp, Homo sapiens
gttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttaaaaccactgcgaaaatttccccaaagcataggtggctttgtgtgtgtgcgatttgggggc

SEQ ID NO: 16747 - DNA, 471 bp, Homo sapiens
cgtagaaatcattaaccacaacccacaatatgactaaatgtaatttatataatgctactatcacagcaaggtatttcttaattatttgggcattttaaatatttagcctaactacagactaaatttgaggaactgtcctgaatattagcaaaatggcttttctaaaactgaaaatttcattaagagactagatatttatacatgtgtagaaactgtgcattttcgattgtgcccctaaaggaacacaatattcttctgtgagatgggttttagggtggcataaagagcaaatgaggccaggtgtggtggctcatgcctgtaatcccagcactttgggaggccaaggcaggcagatcaactgaggtcaggcgttttgagaccagcctgaccaacatggtgaaaccccatctgtactaaaaatacaaaaattcagccaggcatggtggcatgtgcctgtaatcccagctactc

SEQ ID NO: 16748 - DNA, 444 bp, Homo sapiens
cagcaagatagctgaccgtcttcttttgattctaaggcacgtattttaagttgcgagatttttgaaattagagtgtattttataattaatgtggaacattaaatttgtccccctctcccctgaaggctgtttttggtagacaggtcattttacaattagcggtgtcttagaactgagagaatatggaactgggagaataaagccttttatgtacccaggagaaaggactgggggctggctaggccatcgcagctcaccagcaatcccacagctagtgacatgcatttcctggcattggggagcacagttaacatctcttattcctattttcaaaaaatctggtgttataactgagcctcattcaaattgcagctgaaatcctcgataattctaactgattgtaaaatatgccaagaatctctctgaatttgtgggagggtaata

SEQ ID NO: 16749 - DNA, 550 bp, Homo sapiens
ccgccacccttccctcttctccagccagacgcccctgggctctcttccccttcccagtgtggacattcttgacctttattttcagccctcatgtggcactgtccctgtctattttctgcagtagcttcttgcatttagaaaaaattatgtttgaaatgttattatcaaagataggggagaggctcctaggttataaaaaatacttgaagttgcaaccagctattaattgaaaaccaaaaataggccagctgcggtggctcacggctgtaatcccagcactctgggaggccgaagcaggtggatcacttgaggtcaggagtttgagaccagcctggccaacatggcgaaaccctgtctctactaaaaatataaaaattagctgggcgttctggcatgtgcctgtaatcccagctgctcgggaggctgaggcaggagaattgcttgaatttgggaggcaaagattgcagtgagctgagatcacaccattgtacttcagtctgggtaaagagctgagatcgcaccattgcactccagcctgggtaaagagctg

SEQ ID NO: 16750 - DNA, 508 bp, Homo sapiens
aaatctttcatgaagggagtgagacggctacctcttccattttatacacagagaaaattatttttgctcatctttcacctatggagtctaccactacttgaaaaccagcttccaacctctctgagttttcagtgaatgatctgaagaggaaaggactgaagcaaggaggttaggatgcagcatgcttattttcaatgtaatgtaattaattaattagaaatctgattcggaatgtctcctgtgtacatcagaataaaattactaataataaatataaaaacctaccatctctctcctcaaatactgtgtcttcatagaggaattgtctgatctactctaaaataatcagcacccaaatttattcattctctttcctctttttctcctttaatgtctttgtatttctcatctaaaattatataatttatttattcttcttatctactgccttagtcgctggaatgtaaactccatgaagactttggcattgtctacattttttactcta

SEQ ID NO: 16751 - DNA, 483 bp, Homo sapiens
gtatcctgctggaagatagagactgtaaattccaaaaacaaaaacaagacaggtggggcgtggtggctcatacctgtaatcccagcactttgagaggctgagacaggtggatcacttgagctcaggagtttgagacagcctgggcaacatggtgaaatccagtttttaccacaaacacaaaaaattagctggctgtggtggcactcgcctgtagtcccagctacttgagaggctgaggtgggaagattgcttgagcctgggaggcggaggttgcggtgagctgcgatcgggctactgcattccatcctgggcaacagagtgagaccctatctcaacaaacaaacaaagcacagagaagaaagtatgtattaaatttttatctaaattaaaaaataaacgctttcctttttttgcatggagtcttttttatgtttcatattaccatattctatttaccactatcagtttattagaaattcatct

SEQ ID NO: 16752 - DNA, 307 bp, Homo sapiens
agacacagaaggggtgagttatgagctatgtggaggggtgatgggtagcaggcaagatgacaatgataataagcaggcaagggagaggggcaacgagggactgtggaccactcagggctagtgtagaagagacaaatgactgattatgacagaaggaggcttaggctaggattcctagaggggaggcctggcaagggactgagataacgttcttgtcttgtttgcttaatccttcagaggatggccccaatgtaaccagaactcacctctttcttccttctctcttaactccatggacctggcatac

SEQ ID NO: 16753 - DNA, 399 bp, Homo sapiens
catcctttaccaccacctctactttacctggcagtgagcgcttctttggatgtctgggaagattcactagagtacagtccatgagggctttcatgcactgccgattcttagtcctactcagacatctattctctacagatacttgtagaatgaatgaatgaatgagtgaatgaatgaagaaacaatcaaatatcatgagattctccgtagggaggaagatgtggggctatcctcagacactctctgcaccctgcctcagccatttcactgtagggaatccaagacactacagcataagcacatctgtgaggctaccaactcccatgattctggactgacagcaggccacaggtcccttcctgtcttgattgatatcccccacagcaccaaagggagaac

SEQ ID NO: 16754 - DNA, 507 bp, Homo sapiens
gtggaaaaggctgctagcgtacagtaggaaactgtgggaaggaggatttagggaattgtaaagactagcccatcttaagtagggttagtgctcctggtatgtggaatgcctttttattccttgcctaggagtgagtggcaatgctctgctatgtagatcagtatttcagtcctgaaccaccagggccaagaatttgccatcctgctggggataataaccggcaggatgtgacatattacaatcaatgtgcatagagtaccttccttatgtcagcatgatccaaacactttacatgatgaattactttattctcacagcaaccttgtgaggtggatgccatgattcattatttatagatgaggaagctaaacacagaatttaatccatctgtggaagatcacgcagctaatacatgatagaacttggatttgaactcaggcagccttgctgaaagtcatgttctactgcctgagactgaaataatattatatggatggagtgctcttg

SEQ ID NO: 16755 - DNA, 502 bp, Homo sapiens
aacataatttttcattctgattctaaagctttcacaagaaagacatttatcatatccagttccattaaaatattcacttcttttaatccacttcaatggtgaaaagaaaaagtaaattacatttttcacatttccaaacaccatccatttccatgacacacacaggtatctccttgccaagaaaagtcagtggttgtctgttttggaagggaagtaagaaagtggcattttttatttcctgaagaaaaaaaaattaaataggtcaaatacataaaacttccatgaaaagagccacacttcatttcagccattaaagaaaaatgtgtttaaattccccaaaggaaccctatgctctacactgggaaaggcttattcactgctgactttcaagaaccagacatgacttatcacaccgtgtaaccaaggcactgaatggaactgaaaccccaaggagtcttcttatctttctgctttctagataccaggaaaaaaaaagaagcag

SEQ ID NO: 16756 - DNA, 572 bp, Homo sapiens
ggtttgaaacctacaggaaaatattggagtaaaaaaaatatagaaaatcaaacatcaaaggaaatgctggaagtgtgggaattgataaaaggagcacaggaaaagtgtgcagagcgttgttacccaaagtgctgtgggaattttatacacatatgaatacagctcacaaaacacacaaatatttttgcttccctggatcatttactggagtcttttacatacacattctgaagtataaggtatgcagaattttctaagcgtatcatagaattccattccaagaatacatttcaggaaaactattgtcaatcagggaaacattggtgcagaatagtaagaaaagaaatacccattaagactagtagttacacagtggacatgaaaatactaggcagcaaggagttattaaaaagaaagcatgggctgggcattgtggctcatgcctataatcccaggatcacctgaggttgggagtttgagaccagcctgaccaacatgaagaaaccccatctctactaaaaatacaaaattagctgggcatggtggcacttgcttgtaatcgcagctactcg

SEQ ID NO: 16757 - DNA, 448 bp, Homo sapiens
gttgcccaggctggaatgcaatggcatgagagacaacctcattacaacctccgcctcccaggttcaagcaattctcttgcctcagcctcccaagtagctgggattacaggcacgtgccaccacacccggctaattttttgtatttttagtagagacggggtttcaccatgttggccagcctggtctcgaactccttacctcaggtgatccacccacgttggccaccaaaagtgctgggattacaggcgtgagccaccgtgcccggccttcagttgagggttttatgaggagtcaatgaaattattaagtgaggaacacagtgcagtttataatggggactcactcaattcgtgttggttgcctttgccctgctccatatgagttgaccaaggacccatgtgggcaccccactgtctctccagcacacttgactgctgtgctttctgac

SEQ ID NO: 16758 - DNA, 557 bp, Homo sapiens
gtaagccaaacgcaggaccttataaatccccactgaaaggaaagtagcaaaataacattgccctttgaatgccttgtccgctctaaacaccaactgtaaaagcttcctatctggcttcttcctgtaacttatttctttacttacttatccgtaccccctgcccaccaacccccatcccacgatttcctattgcctttatggagcatagcacaattatatgctctagcccaagatttgcaattaagtattctttaaaaaaatgcaatatattttcaaagtcaccctcaaaaatagggactttgctttatagtctccagctctcaaagaagacagttaccagtgggtatccatgacacctgatgtgctgggccagtttattttcttattttaatgcctacctttaaaacaacctaggttacgtgagtgcatagttagacttacgtcccagtgttctacgacaatagctgtatttcaacaaatgactaataagttgggttgtctttgtcttgtggatgctgaggcacttcagtcacagatgctcaatgctaccttactga

SEQ ID NO: 16759 - DNA, 497 bp, Homo sapiens
acctcttcacaaaaacatttattaattacaaaaaggaaaattataactttacagaagtcctggcagatacttaattcaaatgatcaaaatgaacacaactaatagggcaaattgaaatcatgagccactagatatgatgtgatgataataatacattatttctgtgatattctcggaaaagattcttgattataatcatgaggaaacaacagacaaacccaaattttaaaacattccacaaaaacacaaactgaggaacattccacaaaggaataatcttcaaaagtgacaaatagtggaagacagaccgctaggaacaccaataatcccttcccttgagttgggcagaacctacccacttttaacaaacttttaattacttacttttaaccagtaagatatgggaaagttgatgggatatcagtcccatcattacattatggcatatttaagattccctcttgctagcagagatgctagaaagactccacctcact

SEQ ID NO: 16760 - DNA, 518 bp, Homo sapiens
atagatcaaccttctcactcgtacctcaccttcatttcctaaaggaactttacaataatcttcacctgtgataaaccctttttaatgttagcatttactttgtgtaaccaaaatgaaaaccagtttgcaatatagtctattattaagcagaaggaaactctactgtcttaattactaactaaatccatgaaataaattgaattgtgttctaaaagctattcatttaaaaaataaataaaagattagagcaactataaaaattgtgcttaaaaccctatgaaaattaatttccaggtagttaccttgattacaatcaataacattgcaaaattccctgacgttgttttcattgatttcagcttgctttctttcaataaatgcagatattcgtctgtcaatctacaaacaacaagttttaacagcgtaaacataagattttttaaaataataccctctcgcccccgccaaaaaaccttcttacttctgctttccagcctttatctgaactacttctggat

SEQ ID NO: 16761 - DNA, 469 bp, Homo sapiens
attagaactatgaacctctacattcaggatttttaataaagatcaagagaccaaatagtgcttgcccttttcattcaatgtgcaagggcaagaagaagttaatgataaaggtaacatacacagtggctacttgaatgacagcagttcattcctgtgtactaagttcctgtttgaactgtctttaggtgaatcgctttgaggttttggcagtcagcctctaggtatttggcattaaaccaatcatagcttaaaacttgggaccaagcttgctattaaagtaggggttcaggccaggcacggtgactcatgcctgtaatcccagcactttgggaggctgaggcgggcagatcacttgaggtcaggagttccagaccagcctggccaacgtggtgaaacccagtctctgctaaaaaacacaaaaattagctgggcgtggaggcgtgtgcctgtaatgccagcactttttggg

SEQ ID NO: 16762 - DNA, 282 bp, Homo sapiens
tcattgtgtttgtggcaaaggaggtatgtcaaagcagggacctttcgttttgaccaaaaatgcatgcatgcttggaaaatctcatctgattagtaatgattaatggcacaaataaaatacatcattgtgattattatgaatagtattactttagctgttattattttggtgtttatgtttctcaaatatatctgcttatatatgtttcctttgctacactcttgtttgattgattctaatgaaatatatacacatacaccatttgcacatttttcacaattg

SEQ ID NO: 16763 - DNA, 145 bp, Homo sapiens
aacctagaaggtctactccttagaaggtctataacctagcagtaagacctacatccttggagtaaggaccacttccaaaagtctctaccacaggtacgagaactatatctttggattaagagaaaactggagaaataccagctta

SEQ ID NO: 16764 - DNA, 513 bp, Homo sapiens
gagggactgtggcctagttttaaatgattttaatcactgattgtattaaagtgatctagcacagatagtacccacaaccactattaagaaaaggtaaatcatctctggacaaatataatatcagcccaggcctcaaaattatctctataatttttcatagacaatgtttagaaaacaacttaaaatatctaggcacataagactgcaaatttaaaaaactatataagatatgacaaaacagacctacagggaagccagataatttagttaatcagacatagattttaaaataaccattgttataagagaaataagttctactgttagacagttctgtagaatgactatagtcaataatatatagtttcaaatagctagaaggaagatattgaatgttcacacacaaaaaaatggtaagtgtttgagatgatggataagcttattaccctgatctgatcactatatattatatgtaccatagcatcactatgtgtcccataaatatgtacaatt

SEQ ID NO: 16765 - DNA, 375 bp, Homo sapiens
agtgtattaataacagaacagctgtaaccatcaattcctagacatattcttctggtgactagaaatcctggtaccagggttctggttataggtttgtacaaaaccataggactttgggggtcttgtttttttctcacctgcgatttaaactacaatttctctagcacacaatttaggttaatataccctgaatccaagaaaaattaatattaaaatatgcatatagcattttttgctaactcaattttactttcgaacacaaatcattcaacccaaataaataatattcatgagtaacgaaatgctaacatgggttactaggataaataaattgttatttgcatgtcactgaattagttttcaatttataatcag

SEQ ID NO: 16766 - DNA, 464 bp, Homo sapiens
gtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctga

SEQ ID NO: 16767 - DNA, 370 bp, Homo sapiens
agcacattaaccagatgttatgctgagctgtatctgcaaaattttaaaactaaattggctccttacacatatgttattcaagatcagttctctaaatcttaatcacaagacattaccattgacaggaccaggtgttgcatcaagaaatctgggggttaaagtaaattttgattttaatgtgtgtgtgtgtgtgtgtgtaagaaaaattactttcatctccttaaaaaataataaagtggtaagtagagatggtctgtgcatgtgtgttatgtatatcaagtattaatcatagcatatataccagaatgcatgtgcttagtaaatgcttatacaaaagctgagtcatatatgaatagcacctcatcctagc

SEQ ID NO: 16768 - DNA, 395 bp, Homo sapiens
gacagaagggtttagacataataaactggcagtgatgaaattttgcttcctccaatcctcaagtattattaaagaaggcacttctcctgaggaagagttctgaggagcattggtaaagttttgaagtcatccaggtgggaaattcatgacaagccttcacctcttagaactggaatttggaatatcttgaattagaatttggaatattttaggattaaaatttggaacattttaggattagaatttggaactaaaatagttgtcatagggagttatgttaacgtatttatttgcattggaaaatgaagaatagagttacaatgttgcttctgggcaaagacttgaacagacatttcccaaaagaagacatatgaatggccaaaaagcacatgaaa

SEQ ID NO: 16769 - DNA, 76 bp, Homo sapiens
aagactcataatactaataaataaacgtaataatagaatccagggaatcataatagttgggctcagtgtatttttc

SEQ ID NO: 16770 - DNA, 550 bp, Homo sapiens
tagtcccagttactcaggaggctgaagcacaagaatcgcttgaacccgggaggtggaggtggcagttagccgagatcacaccactgcactctagcctgagtgacagagcaagactctgtctaaaaaataaaaaaagaaagctgctttctgaagacagaggagcttccacaactgtctttttccagcatttaaaaatcttccactaaaccatctggtctctcttagcccacaccttctccagaccgaagcaaaactgttagcactttttataagaactatcaagcataagaggttatttaccttgaagggataatcatcaggatatagtcagtgatcgtttattcacatatcaaactaaattcaacagatagctatgaaatataggctgggcacggtgactcaggcctgtaaacccagcactttgggaggccgaggtgggcagatcacctgaggtcaagagttcaagaccagcctggacaacatggcaaaaccccatctctactaaaaaatacaaaaattagccaggcatgatggcattcatctgtaatcc

SEQ ID NO: 16771 - DNA, 543 bp, Homo sapiens
aaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggatttttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctc

SEQ ID NO: 16772 - DNA, 462 bp, Homo sapiens
attaggattctagagctttaggaaattgtacatagtaacacaaatggtatatagcaaactaaggcttaaaatctgagttctctgactccaaagtctgaatttataaccctctcaccatatgtccatgtgaaagtaagaaaactcacacgggataaactgaacattaatcctgactgtcccaactctgaagtttgcatacatgtctgaatttctcaggcaaagtaggacacttcttgaatttcagtcatcgctccattttagacagtgatacttaaatggaaaatgtctaagttgaaatatagaactataaattaggccaaagtatttattaaaaacacaaactgaatcagttcaggatccttatataagccagctctagaaagcaacaaaagtacagctcacatatttctgcaggaagcaagatatattttgttctcccaaacatgaatagcaatactgcat

SEQ ID NO: 16773 - DNA, 396 bp, Homo sapiens
gaccaggacggcacatactgtatttgtatatggcaccaatggaagtgccacagttgcctccaggaaagggcagcatgccagggaaacagggttgagctgcctgcctaactcagggctaccaacacacaatgaaagaagggttctgcagaaaaattttctgctgccagatgaagccaaacaaacaaacaaaaacaaaaatacctctctggtcccttcctctacctctacttgtggaacaaaagcaaagcctattaatagtaaacttttccatttttctccatatttactaaatgattttttaaatggtctcataaaacccgcctctaatcccaatgccaaaaaccaaccaaacaaacaaaaataccacaaatctttctctataagaatgaacaagtg

SEQ ID NO: 16774 - DNA, 244 bp, Homo sapiens
agttttaagttgggtggccaggaatgctcgaccaagcggacttgaaaagctaagggctgaacatgagaatatcacagggaaatgcaccccaaacgctaggtctttccaccatatctgcccctggggtctcccatctcggtaatggcagctccactctcctccatcatccctgattccctgcctcctctcattcccccatccaaccagcattcctgccccaggacccttgcacttacccttacct

SEQ ID NO: 16775 - DNA, 500 bp, Homo sapiens
gttgctttccaattccctggacatttcctggaactatgtcggcagtacctggattatcaacacccttcatagatgccattgtctccctacccaaaccagaaactgctgctgaaataactttgacaaatatttgttttataatctcattctttagtttaaagatacaaaagctccctattgccaaagagattttttaaatgtaagctaacatacatctggccatttatgtaatcaactccatcctttcttctttcctgtacaaatctacctctggccaagtaaatctatttccaaactccaatcagcatgatttatgtagcctcacaagcatttctgtttttagctgcatgccagctccactgcctgaaatattccttctcctttcttcatcaatgaatattcactggcacttcaaaaacaaggtcaaattttctcttctcttttacaggatgtgctccttgacctatgcctcctgactgacaccactgctctaccctcag

SEQ ID NO: 16776 - DNA, 496 bp, Homo sapiens
tctttgatgtgtactctggcacttagatgacatttgagcatctgactatcctagtggaaactcaaaaagcggcagtgtttgctaactgattattatcttttgccttccaacaataaacacattgttatgccattgacccatagtaaacaaaaataaaagtaatagttgaagaaaataaaatgtaacaactccatgtcactgtgctatcataatcatgtcaaagacaaaagcatacacatctcaaatgtgtcctacaagatgttaacgcacatgtccaccactgtgctggctagtaccagtaccatctcaaaaggcatttgtcatgttactgattcttctatgagacagttcctaaataacagcaaggttgttaacctgcattattaatctctctggctaggttaacaataaactctgaaaatagaatgaagaagatattgtattagtttgttcttacactgctataaagaactccctgaaactgggtaatttggga

SEQ ID NO: 16777 - DNA, 92 bp, Homo sapiens
tgcatacaaggcttacctacaattgaccatttttgcactaaatgcttttttaaagtaacaagctaatatcttcttaatataataatatacat

SEQ ID NO: 16778 - DNA, 483 bp, Homo sapiens
ttctggtgagaggcaagcttcctgacaacgccatgctgagtgtttgattggccggccagacctgttcataaagcatttcacaaaccgtcctttcttacgcaaactagctgggaataaacaggccccctgtgggtcttagaactaaagcaaatatgaacctcaaagaacaaaggaaaatcattactggtggcaggaatatgagagtgcttccacaatactatttcacaagtcttttctacatgggcttcagtcacaaaggtggtttgacattcactgagcagcatgggaacaattctagaacacttattctatccctgagctatttctgggataaaaatattgttaaaatacggctgggcaccgtggctcatgcctgtaatcccagcactttgagaggctgaggcaggcagatcacctgaggtcaggagcttgagaccagcctggccaacatggtgaaaccccatctctactaaaaatacaaaa

SEQ ID NO: 16779 - DNA, 101 bp, Homo sapiens
atgagggacaacagttggatccataaagtgaaaagataaactttctctgccatttactaataaagtcagtggaatgaactatctgatgattatggcagctc

SEQ ID NO: 16780 - DNA, 210 bp, Homo sapiens
tttgggtatatccatctcttcctgtcctaagggatgctggtcagtgtaccagaagtaaaacaaattggcttctatggctgcacaccaggacaggtcttgattacatgaaggaccttactaaacacccttccatcctaacaaaaatatgtggagcatttgaccattgcacagggatgagttcccactttactcccacaaatgtgatttgtg

SEQ ID NO: 16781 - DNA, 538 bp, Homo sapiens
ttactttcagtgactgtgacataaaagataacagaaactcttctgcaccacattgcttacttttacaataattcaagtattgggtaccagaaaccattaccaacaagcaagttccagtacctttggaggcacaaacgaacaaatgacactctctggagtaacttccaatatatttgcaccatgaaaaatataagaatctcagaatatacataaatcaaaagaaagtttttatctacattaccagagattttaacactaaatctactgaatattttccttaccaacacaataatctatgccactgaacattactatttggctggtcactaatatggtggcctataatgcaaagagccattccaataaaaccttcccactatgactgcactgctcttaatggttttatttctaggaacattgcatggcaggagatgccacttccctcttcctcctatcagactttgcatttctttgatataaagcaccattcataaccatctttttgttttctcccattccttccctttgcaataacaaa

SEQ ID NO: 16782 - DNA, 298 bp, Homo sapiens
ttactaactgcagaaagcagtgtctgcacctcaagtaactgattatttagtgcccttttctgtgttttcttctatgtacaatggaattatctaaagctatcttatagttaatatttaagtgataaatatttttatatcatcatcaacacatttattgtggcttcattaaacaagactatgtcacactgtcttaaagagattataggtatcttagtgagagctagtgtttaaataataacttgtccagatcttccagtccatcatgtagtatcatttctctttgcatagaaacaaatac

SEQ ID NO: 16783 - DNA, 402 bp, Homo sapiens
aaattgtggttacactaatacaatttagaggagatcatcagtttgtcacaggttctcaagacatgaaaatccaccagagaggctctattagactcaatgcatcatttcacggaaggacatgtagagatccttcacgagaaaatcacttctttccttctttccttcctcttttcttttcttttcttcttttcttcttcctttctttctctttctttctttctttccttctttctttctttccttctttctttcttgacagagtctcactctatcgcccaggcttggtgtgcaatggtgctacctcggctcactacaacctctgccgcccaggttcaagcaattctcctgcctcagcctcccgagtagctgggattacaggcgcctgccaccacgcccagctac

SEQ ID NO: 16784 - DNA, 529 bp, Homo sapiens
aatgatgggttatagctatatgcccaaatatttaagcaaaacacgacaaaagaagggtgaagagaccttttatctaatggccaaagtagaaggtagcactcataaaatatactgttttgtgtaataagtgaatggaatctttacacaattttttgctagggttaattgtttaggaaacttttctaattggcaactacttcatagaaaaacttgatccagacctatatgtggaacttccctttatattaacttgctgaaattattaaagttaaaagcttgtttttccaggttgatactctcaagacctacaaagaccagcacattgaagcaatcagttgattaccgtcatgatgcctgcatatgtttgtttcatgtcagacacacctgaggtctgtaattgaatacataaagagtgcaaccatggaagaaacaaggttggcttgtggtgttcctatggcagcatcgacacagcttcaagtgcaccatgagcatgagcactgccaagaaaatatattggctctcaactctc

SEQ ID NO: 16785 - DNA, 458 bp, Homo sapiens
tttgataacaattaagagtgggtttccaggttccttgggactctattttagtgttcgtttccactccagattagacctttccaaatactctcagaaactttagatgtcctccaatcaaactctgctctcttgaaaagactgccagcagtcttttatacctctctatattgccattccagaaatactggtatttggggtcatgtttctaactagggaattgagagttacagatagcataaggagtagtataaggatattgcaacaaggattttgtaaaggatccctgagtaagggatctcaagccttagatggaagaaatatatcatgtttgcatgtgtgttagtgtgttagtgtgtgtgtgtgtgtgtgtgtgtgtgtctcatccagcttgtggccctatgagccctgtacagaaaatggtagaggctgagaacatagacattcccacatttaataat

SEQ ID NO: 16786 - DNA, 541 bp, Homo sapiens
gataggaggggcatgctgcttgccaccatcttacagggaaagaagctgagaaacctagtggttaagagactcgtcttgtgttgcccaatgaatgaaccaagcagcacctttcatttaaccattaatgtggttgtttggaaatagctcttgctcctaggaaagattggaggcagagcaggaaaactcacttttgtaagacgagttctcagctggagttgggacagtctcattctctctgtgtccggaaccgaactcatcaacttcctgccagagttcacaatctatctagctgctcaacttcgacctctccttctctctcacttctaatctagcaccaactcctggcaagtctactctctaaatgtctcccaatacttctccccaccccactgccatcgtcatcgctagagacccatgatctcttgcctggattacaggcatcccagccttcagactcgccctctccaatctactttgtagtctgttgtgacagtaattcttctaaagcgacatcagataaagactgtacttacttttctat

SEQ ID NO: 16787 - DNA, 417 bp, Homo sapiens
tggttattatttgtaactcacagggcagaataacagctctagagctcaatttatctggaggagattcagcacacctgcttctctttttccactggcatggctcttggtgcaaatttgtatttatgtaatagttagaaattaaacatcagcaccaacagaaaaatattcaacgccctttattaaacatcaaacaactttgtcaatgggaaaagctgccccaactgttttagatcttacctctcaacattgttgtcaaagtacctttccactctctggtagtgtctttgagagggtttgtctattggacttaaaactacatacacaaaggtaagataaaggttatttacacagccaatcttaaaagtagaatatcagcactctttaatcttcccatttttttgtagagacacgatctat

SEQ ID NO: 16788 - DNA, 474 bp, Homo sapiens
accacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcttctaaagagtttgtctattctatttgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagc

SEQ ID NO: 16789 - DNA, 605 bp, Homo sapiens
catcctttaccaccacctctactttacctggcagtgagcgcttctttggatgtctgggaagattcactagagtacagtccatgagggctttcatgcactgccgattcttagtcctactcagacatctattctctacagatacttgtagaatgaatgaatgaatgagtgaatgaatgaagaaacaatcaaatatcatgagattctccgtagggaggaagatgtggggctatcctcagacactctctgcaccctgcctcagccatttcactgtagggaatccaagacactacagcataagcacatctgtgaggctaccaactcccatgattctggactgacagcaggccacaggtcccttcctgtcttgattgatatcccccacagcaccaaagggagaaccaggtgagtgtagaccctgtacaaatgcaaaagagctgttcttcccctcccctacacctttcctcccaagctcagatgaccttggctagcgccaggtataggaaatgtaactcattcagcaggggttgtccccaaaatacttccgtgtgacacctagactccagcttttctgtcttaacttgaaattaaagaattgggagaagact

SEQ ID NO: 16790 - DNA, 551 bp, Homo sapiens
ttctgcttccacgtctacagcacgcgcctgccctggcatccatcatacagctcttttcctgtagcattattcaaagtaaattctgatacaagaaaattaggactaccttttcaagacaatcattttctaggttagataatatctgtgtactactggcattactgttctttccatctaaaaatcagccctcttaaatggtaccccttgaaaacaacttgaataaattaagtagtaccttgccagattctggaaatgcaaaacaaaaatgtcctagtattttagaccagtggtttccaacttttgtttatcccacagtcctagctattaaaaaaaaaaaagaaaaagggaagaaaagaaaagaaaagaaaaaggtccatctatctatggatctattatctactttcctccctatctatcaaccatctatcatccatctatcatctgtctatccacccattaactcatccatctagctgttatctatttacttatctacccatacatacatcatacatctatctatctatctacctatctttttatccatccat

SEQ ID NO: 16791 - DNA, 557 bp, Homo sapiens
gcttgacatatgtagtttccagaaattttgtcagtgtttcttagaacttgtttaaggtgccatgaaatatagcagtgaaatgtaaagtgttggaattgtttttctaggaaaactcattgtagatggagagcaaggtatctaataggatgtggaagttataaataaatacaagaagacatgaggcagcagagagaaagagaaagtagcagagagaaagtgaaagtagcagagagaaagtagccaagagaaagtgatggtccattcatttgtttatgtactcaacatcttccagttactgcctactatgtgccaggcaatatgcttgatgtttgggggatatgttggtgaatgacagagacacatccctgtcctaacggaggtttcaccctactgggacacacaggcaagaaattagtcccactgttcacgggatatttcttataatcagattgctcacatttcagtagatatacagagaatactagaagatgtttacatcttattattgctccttatatatcctctgttcttttaattctctagtaatcctatttcac

SEQ ID NO: 16792 - DNA, 576 bp, Homo sapiens
gattacaaccctgtaattaacaaatgcagctgcttgccactttcaagagatacactccaaacacaaggatataagtaaaaaaaagagaaaaatatatctgataaatattacgtaactatattaacattgaacaaaatagactttaaggcaacaaaaaagaccctgaggcaaaaagctgtaggagaaattgcataatgataaaagggtcagctcatcagggatatgtcacaagtcttaacttgattgcagctagtaacataggttcaatatatggaggcaaaaacaatcagaaagctgaagttctttatcaggagaagttgagtcctacagtcacatggaagattttaacacacatgacggtaactagtagcttagggagattgaaaaagaaaaacaaaacgcaacccaggatgaatacgaatctcagcaacgcaatttgaagcaataaacaaacacggaaacttgaacttaactacttgagaatacgcattcttttcaaatgttcagaaacttaaaaaattttttgaaataatctatgtttcaaagatgaaatcataatggaattagaatgataat

SEQ ID NO: 16793 - DNA, 483 bp, Homo sapiens
gaggagccccagagtatctcaagggacttgcaggaactgcagaagaagctgtctctgctgatagactccttccagaataactcaaaggtcagtttccaatcactatgtataatggaaaatcccaatataacactagcataaacaagatagaaagttatttctttctccagtagaaggaatttggaggtaagtcaagaatctttctggcttaccgccctgccatgtctatgctgtgaccttcaaactccttgtctgagatgactgcaagagcatcagccattgtatccatctttcaggcaacaggatttgaggaggggggaagagagaagtgcaagccacctacaatttaaggaaacttctgggagtcgcacacaatacttccaattacatcccttaagccaacattgagtcatttgccactaatggcaaatgcaattctttagctggataaagaagtctgtgcaacagatatcatcctttttt

SEQ ID NO: 16794 - DNA, 513 bp, Homo sapiens
gcaggacccatacctcatagacagccaggtcggtgcaggcataggggatgatgccgagcatattgggcaggtagccgcggtaaagggcgcgggtgccctctcgctgcaagatctgcctggcgcagtccagcagccccttgtactggcccgtccgacgcaaggtcaaccgcgtcttcagcacctgaggatggcggggaacaaggcagctcatttgattgaatcctgtcaatgaccctcggggtagccattgtccccaccctacaaacaaggaaaatgaggctcaggaaggcaaagagctgggtttcagacccggatctgtcagattccatggaatgctctctgaattttgagttctgaagcacaaatgctggcaaaggccaagagagtgagggaagaaggctcacgtctgtcttcccagccctttgggaggctgaggcgggaggatcgcttgaggccgggagttcgagaccagcctgggcaacatagcgagaccccatctttacaaaaaaatca

SEQ ID NO: 16795 - DNA, 603 bp, Homo sapiens
acattaccttattcgattattcaattccttaactaaaatataatttagttgtaatttaaatcataattccttgaaaaagattgtttttcaaatataaggtattatctgttttataactctggctcactcctggtttctatgcactttttcttaacagcattttaagacattaattttaccttattgataatgcttcctttttgaaatctttccagcagtgaaattaccatgcaaagtataacttcaagtgtcaagaacgcaaacatgactaaaaatatattgctttacacatacaacaagtgtatgtgtttctgttttactggtttagaagatgtgtcacttgaatattcaaaattcagtgactttctcaatttcggagaattttaggatgtagttgttcaaggcgcttatttgatagataagggaaatcaagtgccaagaagttacatgatggtacaccaccactcaggctagggccatgacccatcatcgatctgctggttcttagcgctctgcctcacatcaagaccagtggaacagccacctgcatcatttgctgagtaagcatttgaacgtgaaattggatggaccctaaaagaaagt

SEQ ID NO: 16796 - DNA, 652 bp, Homo sapiens
ttgagtagctaggactacaggcacgcagcaccacacccagctaatttttgtactttttgtagcgacagtatttcaccatgttgtccagactggtctcaaactcctgggctcaagcaatctacctgcctcggcttcccaaagtgctgggattatagggtgtgagccaatgcacccggacacacaatgtatcttttagggaatacagacatgtaggaaaactgtatagaaaggggatgatgagtgaatttcaggaagacagatacctctgagattagaggggaggatgagatcaaagaagagtacacagggggattcaaagtgatggtggcactccatttttaaatgaggtgatggatttacaggcttccttggatcattggtttgttgttggttttgaatcattagcttttataccatttgtattttataactattctctggcagctacttgtaataaaaataatttttaaacttgtaattttttatcattttccaattttttattataaatgtccccaaatttaaaaagtaatgtaagttacccagagactctggaggctaagataagaggatcgcttaagcccagaagttcaagaccagcctgtgccatgtagcatgaccccgtctccaaaaaaaaaaaaaaaaaaaaaaa

SEQ ID NO: 16797 - DNA, 453 bp, Homo sapiens
atttcaacaaacactcccttccttttgcaacatccatcttcctccctcccactacttcatcttggctaattcttactctttaggtctcaatctagctgtcactttctagggctgtcttcctcataggcaaaactagtagaaaatgaggctatctgtaaagtctaatgtggaccatgtgtcattaggaatgccctaggctgcaagtagcagaacagtgactaaagcaatgaagtcataaagtatggagagctgatacacggagcatggtggaatggtgggttggaaaaagttagggggcgcaggcacagaggctcatagcctgtaatctcagcactttgagaggccaagggaggaggatcacttgagcccaggagttcaggaccaacctggacaacatggcaaaaccccatctctaatttttgtattttttgtagagatgggggttttaccatg

SEQ ID NO: 16798 - DNA, 515 bp, Homo sapiens
gtgactcaaccacaatgacttctttattaaagctattacaaaataaatactgttatgggcaaaaagaaaaacatgaaatgtagctcttagcagtaatatgcttggctctcaggtatgctggatataaaaagaaactaagctctccttgttaatagagatgattcaaggtgggataagaaaaacaatcatctagctgattgagtttctgcccctcatccccatctcttgcctcatcatttccttctattttcagggttatttttcttgacagggaaaataaaaatcttccaggagaggcacagtaacagcagatgcaactcgaaaataaaaatcttccaggagaggcacagtaacagcagatgcaactcatgtccttattccagacttctttgcattttgaagattaaaaagaagaaaactactaaaagctttaagaactatccaccagataattatgatacaagagtataaacacggtcagtttcaatagccatttcctcaagtgcaacttggca

SEQ ID NO: 16799 - DNA, 368 bp, Homo sapiens
taatagtaagaaaattattgaagtgtgtttttataaagaatgactacaacttttagagatttttgcttgttgatgtttaaaagctctttaatttttttgtgccctgctaatggactgtctttttagctgccccaaagtatctctgtttgattactaaagaaatcagtagaaaacttttattgtttacaaattgaagtctcagaaatagacaatgcaatataattttcattaataaagacctataattagagtgacaatgtaatttattgcccaatttgataaccttgagaatgggagattgttttacatatatatacacacacatatgtatatatgtacaaacgtgtgttcattacatatataaacac

SEQ ID NO: 16800 - DNA, 307 bp, Homo sapiens
ctttgctaaatgtttgcaatttctaagtaaaccttttatctcctaaaatgagtgttaagtgtgattttgtttttacttttggtgctttaaacttgagtctagtctaccaagctttccattttatttgctttgatggtggtaggggggtggaggtgtgaactgttgtctaaatgaaaccaataattttatgacctacatttgtagaaagaataaaaatgccactatgtctagaacataaaagaaatgtcaaaaacaaattagagatatcgccacagttgtttttaaattgtattaacagtgactaatt

SEQ ID NO: 16801 - DNA, 301 bp, Homo sapiens
catctcctttaaaacaaaaagcaaagcacaaagttacacgttcacatctcttccttacaatttttcaatgggaagttacctagaatcagcaataagagggacactgacacctcactgagtgctcccttgggcaatacaagcctgatggctgtgccctatcagacacaactgggtaatgcttctgacagccaccagcctgctacagttgaagttactgacctccattaatatacaacattgcactgaaatacactcctctatataagaaactgagtaatgagcttagcactacaatacttat

SEQ ID NO: 16802 - DNA, 153 bp, Homo sapiens
taacccaaacttttccctagaacaactaaaactgcaacaaatatccttttaaatacatttgttgtacacataagtaactatatccttgggtgagaatcttagaatactgttttaaaaacatgtgaattcactggcactctccctaacagctca

SEQ ID NO: 16803 - DNA, 498 bp, Homo sapiens
gggtattatcccatctatgaaaggtagtcttaacaactggcacagcaaggggtatctagacaatgaccaccaccactgggggtctctcttcttatgtcttgccttgttaatttgttgtattgtcgagacaattatgctgtttgagtttttttctgcccactggcaagcatactttaacctgtgcaaatttatgctgcatttgctgagtctttccaagtttctgtttagaattaaatgaacttaatgcctggaagcatcagtaatatttaggaacgggagtttggtagtagctccacgtcatgtgtcttagcccagacctatctttgtgtctaatattgaatcaagtggttggtatccagtaagaaatgtggctgacactaggcacaggggaataattcctactgtgtgatcactggttgtatgtctcaaccatgcatcagcccccattctacagtgtgtcctaggaaaaatacctgttactttgtgcactatacaggt

SEQ ID NO: 16804 - DNA, 372 bp, Homo sapiens
tttcatctctctggtcctcaacgtcgtcatctgtcaaacagggttaagagacattcaaaagatacaagggtgaaggcgtgcgggtgggcagggggttgggagcgcacactgtggaaacggagagaccctacacctctactcccatttcccttctcgtcatggatgggggcctcccacagtagcaaggtgagggtgatgagactgcctaagaccctgaatgagtggaaggaaatcaaacaccaccatgagaaagaaaaaaaagcaagatacactaccaggaaaacgcaaaaaaagggtgactggagacaacggcaggagttcaaacatctcttgatgtcagaaaccaaggtgagatgtgggtggatggagtgc

SEQ ID NO: 16805 - DNA, 570 bp, Homo sapiens
accatgccccccacgctcaccccatggagaagcctttctgtgcaaagacaggagggctagggacatgaagagaagcagagtgtgaggctcaaatctcatcagcctggcgaggctataactcaattaaatgcaaatctcggtgttgctgtgcaggtgttctgtagctgtgcttaacatctacaatcaattgactcaaagtaaaggagatcatccctggtaatgtaggtgggcctcatccaatcagttgaaggcctcaagagcaaatcagcttccccagagaagaaattctgcctcaagattgcagaataaaatcctgcgtgagtttccagcccggggcctgcccttccaatttcagacttgcaaacccccacaactgtgtgagccaattccttaagagaaatctagctgtctcctttccgtgtcttctattgattttgtttctctggagaaccctcactaatacacagaggaaagaaggaagagaaggagaggggatcctgacagtgggaggccctgtttcctcttgtcctggaggccaccacctcatttgtgcaccactgggtggacact

SEQ ID NO: 16806 - DNA, 536 bp, Homo sapiens
gctaacggtattaaaaattaaaaaaatgagagagtgagtaagctaggacactttgaatacttcataagttatacctatgctacttcaatttaaatccttcaggttaaaacaaaaaatgattggaccctttaacagaataggtgagatctgcccacactgtgtgcaggatttgggtcaggatttcctgaggccattcttcccacagcaagcacgttttggatgccccctatgttcagcccctcaggggtgctgattgtcctcttttctcctttccctgcctgcccctacccccatccatgccctcacttgtgaaatgtgagtgtgtaggtcttatactggcccagaatttaatttgatttgggaaacaatttaagtcattacatgctcaagattttcttcccccttcacacccacccaaaaagcatcattgactaaaattttaaactaataaccaacagggtattgataccaaaagcagctgttaaagaaatagcacttcaggccaggcacagtggctcacacctataatcccagca

SEQ ID NO: 16807 - DNA, 535 bp, Homo sapiens
agtcaataaatggaaaacaaatgagtttctgaagtgtcttcatcaaataatagaattatggccagtagtaaaaaaaagaaaaaagagttatggccagtaattacaatataatttataaagtttctagtcactccttcactgatagaatacagtaatatgtaagcacgaatgtgtttattaatagcctgttgatataatttatgaaaaaagtacagagtttacaacttttttttgaaattggctcctgagtaataaaaagtttcttgacattgattatctaatgagagctaagtatgtgaattatctaacagagttcaatattatttgggaataggttttagagcccttttaagttgaaaattgagaatgatcaaaacattcctaattctcttaaatcaccagtaaaatacgtatcactttatgcatagccttacaccttaatatgcatctaaagctgggcgcggtggcacatgcctgtaatcctagcactttgggaggctgaggcaggtagatcacctaagggcaggagtttgag

SEQ ID NO: 16808 - DNA, 473 bp, Homo sapiens
cggtgctataaaatgtatgtataaaaggttaattctgttatgacagatgtggtccaaggaagacttttgggttctgccccagttctgaaccctgagaattacatgtagaagttagataggtgttgaaatacccacttaagactttaaacgacttaagcaagtttgaagaatgaaacttggaacttctggcctttgcagtcctcctgtccatgtgaagacctgcggtttactgcaagagagtaactgagtctgcagagtgaatattcacctagccagaggtgtgactacagccggcctccccatggcaagtgctaaacagcccagaagaaggaggtcccatgaaaccatgagctctagcatggctgtccaccggagcaagggggcgccctaatgctgtatattcttgccttgtacctcaggagcactgagttaggggagaaagaggtattccctcctgggaatgacgtctaagt

SEQ ID NO: 16809 - DNA, 538 bp, Homo sapiens
tagagggctggcagtggtttgggaagagaaaaatgagagggatatgttggaggaagattgcacagagttgtcaacttactgatgtggatggttagggagaaggagtaggaggagtagtcaatggtgattgagagaatcatgatatccttggcagagagaggggtctgaaggtggtttggagattaaaggtgatgtgcatgatttatagcagagtgagggactagttggcaaccaaaaatttctactcagattgaggctggagttatgattttatgaaatgttgctgatggcagtttggaaggaatgaatgtaatttaccaaaaagagatggcagagagagaaaagaaaagggacagaagataagacattgatggttacactttgagtcagaagaattaagggagccactgagaaggtgtacacagagctgctggagggcaaccagaacagcttgacagatggagtccaagctggcgaggctggagtgaggcctttggaattgatttctatgaagaaattatgtgaggctgtatcacat

SEQ ID NO: 16810 - DNA, 460 bp, Homo sapiens
tgtctgtttgtttggttttgtttctgtttttttgttttttgggggtatttttttgttgacatggagtctcactctgttgccaggctggagtgcagtggtgcgatctcagctcactgcaacctccgcctccctggttcaagcgattctcccacctcagcctcctgagtagctgtgactacatgcacacaccactatgcccagctaatttttgtaatttttagtagagacggggtttcaccatgctggccaggggatcaggatggtctgacctcaacccgcctgcctcggcctcccaaagtgctgggattacagtcatgagccaccgtgcccggcctaaaaactttaaacaaggatggctgaaacatcgatccaacacataataggaacccctttcttctatcttcatgtccccattatctccaggattcttagaggattttcttacatccttattacctct

SEQ ID NO: 16811 - DNA, 509 bp, Homo sapiens
taaatatttgcttaaatgactttttctcttctaattgctgatcacaatggatctcaaacttttaaaaagtatagcacacttttcgtcagtaaataaataatgaaattaaaattttagcaaagcagagatgctattctggtcgaaggggtttgtgagtacagcctggatctccaacctccatgacctccaggaacattctcacaggtcctgagagattttgggatattctgtggatcagaaaaacaattagtagcagccacctctaccaagggaattctctgcataacagaatgttgttaagttttcatatgcatcatcattttgacactcatattattataagatttattattgttattattagtttcagtattagtatcagcattatcatcccccttctgcagaagagtacacaaaggctgaaaaggtttaaatatcttccttaggtggtagagcctgaatttaactctaattagtttgactctgaagccatcattcttaaccatcat

SEQ ID NO: 16812 - DNA, 459 bp, Homo sapiens
ttgatcagacactacctgtgagctctctttttcttagttctaataaggaaatagatactaagtcttagaaatttttaaatactttgggcacaacaacatttttttaaacaaagacctagagcaacatgttgctggactttctgagcaaagaaagtcaagtgatatagaaaactgactcctgggccaggggtggtgtctcacgcctgtaatcccagcactttggcaggccgaggtgggcagatcacgacatcaggagttcaagactagcctggccaatgtggtgaaacccatctctactaaaaatacaaaaattagccgggcatggtggcatgtgcctgtagtcccagctacttgggaggctgaggcagcagaattgcttggacccgggaggcgaaggttgcagtgagcagagattgtgccattatattccagcctgagcgatagagcaagactccgtct

SEQ ID NO: 16813 - DNA, 482 bp, Homo sapiens
tgaaaattgtttgattctaacaataggtcatgcctaggagattttttttgcccttttcttcatattgtgaatttcaaattatgttattaaacaaaaatattaacatactatttataaaattgttgatttgtgttcttttctggattaccttgtgctgatggtttcacaggaataacttctcagatgtctttacaatttacagatggctttacaaatacagcttaactttggaacctgctgaatgtgtttactgccctagattctaaacacctgtatcttgaaagaagctgctgtgcaaggcacaacctactgagtcattttcaaaacactgagtacagggagcaggtgttcagttgtcagtaatggaataaaacaaagttacaaactgggttagttagtaatatgaggtgcacaaactatatttccagacttgtagataaatttctctatttaattttcaaaattattaaaatactctactc

SEQ ID NO: 16814 - DNA, 341 bp, Homo sapiens
gagagattctcactgctatctggctggcagggaatccaattacagaatctcatttcaacatctcttttccaaaccaccctggcatcaactcttgaaagctaaagtccctcagaagaaggccctgagatagagactggcaagcaggaagcttattagggagcacttttaggatcaaaaactttgaaaggaaagggagcagaggggaagggaagggaaagaagtaggattgtaaactggaacccatctcccatcatatacaaaaaccaactcaagatggattaaagactaaatgtaaggcttgaaactataaaactactagaagaaaacacagagaaaacaat

SEQ ID NO: 16815 - DNA, 274 bp, Homo sapiens
agaagaccaaagggccaaaagagtcaacttctgaagaagcgcaaaaagaaagttgaggaaatcttaaaacatgttattgagcttaaagttgcaaaaataaactcatgtaccataattcatgagtagaaaaatagactagtggaataacataaaaataaaaacaatgcttacataaaatgttgtaactgatttggatgtcattagaaatcagtaagtaaatagatggacaatgtaatgaaagatgctaggcaaataatgtggtagggagaataat

SEQ ID NO: 16816 - DNA, 522 bp, Homo sapiens
cttgggaggctgaggcatgagaattgcttgaacccaggagacagaggttgcagtgagccatgatcccaccaccacactccagcctgggtgacagattgagactctgtctcaaaagagttattaccaaaacaatagactataaaatctgtagtcttaatttgcatatcatggtagacaggaaaatacctttagcatcttaataaaagatgaatcaaactctctaataaataccctagaaaagacaaacaatacactaaatataagattaaagagtagtttctaatacatcattctaagacaaaatgagggaaaaaaccccatttcaaatttaagtcaaaagaaagggtgaaacataaaggagtctgggtgcggtaatcccaacactttgggaggccaaggcaggtggatcacttgaggtcaggagtttgagaccagcctgggcaacatggtgaaaccctgtctccaccaaaaatacaaatattagctgggcgtcgtgatgcatgcctgtggtaccagctactc

SEQ ID NO: 16817 - DNA, 423 bp, Homo sapiens
catccacattttattggaaaaatattattttataaatggagaaaagcctggaaagacctctaccaaaatactaaaggtgctttttctggatggtgcatttataaatgttgttaacttctttatgttattcaatggacatgcattttgtgagcaggaatgattatatttaaaaatctgagtttgaatgccaatttgatcgtgtctcagctgtgctatctttggcaagccacttcttttccagagttccaatttctacacttctaggactggggtaataaagtcattttcatagcattgttctgagaaagaaaatgagatcatgtgtatgtgtattgtgtgtgtgttgtgtatgtgtgtaccctgaggctagatctggcacacttttagagcaactccagtatgatggccacacacagacactct

SEQ ID NO: 16818 - DNA, 479 bp, Homo sapiens
tatatttatttatttatttatttatttgagacggagtcttgttctgttacccaggctagagtgcagtggcgcaatccccactcaccgtaacctccgcctcctgggttcaagcgattctcctgcctcagcctcccaggtagcttggactacaggcatgcgccaccacgcccagctaatttttgtatttttagtagagatggggtttcaccattttggccaggatggtctcaatctcctgaactcgtgatccatctcagcagatcacgacaccccaagtgtctcctgggggacaaaattaccctcttttgagaaccagtaggttaaacaacagattagacagataaggagagaattagtgaagggaaggatagctctagagataattcagcacattctacatcagacagggagagaaataaaagtaggtaagagacacagaggatagatttccagaagaatatatctaatcagaatttcag

SEQ ID NO: 16819 - DNA, 504 bp, Homo sapiens
actggactgtgaatgtcaccgagcttttctcagattttcttctctacccttaggtaggaaaggatggcgagagtaggctgggattgggtactatccttctcccacatggttggctagggtgagctttagttgagtatttctcttctcccacgtggaaagttagagctgactagaattaggttttacccttctcctagttcagttaggctctgataaaaccccagaatgttaggctctggttaactagcttctcctgagggcagagtttgtcaagaggagcacagtgctctgaagctttcagaatgattcctatttccgtctccctgctggaagctcaaggggattcttcttgagaaggtaaaattcacaaaagtatggggtcctcatatgagggagtccccctgaagtttttaactctcagacttgttctcacctagcctctaacaatttgttgattacagttcaggtttcctaactctggcaccggttcctataaagacttct

SEQ ID NO: 16820 - DNA, 252 bp, Homo sapiens
ggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtg

SEQ ID NO: 16821 - DNA, 512 bp, Homo sapiens
gtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagccagcctgtaaggggtaggtgagttagcaaacgtggaggcctctgcccagcacccagctcacagacggagctcaccctccagaagctagaatcatgtaatataaaaatacattattctggccaggcgcggtggctcatgcctgtagatcatgaggtcaggagatcaagaccatcctggctaccacggtgaaaccccgtctccactaaaaatacaaaaaattagctgggcatggtggcgggcacctgtagtcccagctactcg

SEQ ID NO: 16822 - DNA, 524 bp, Homo sapiens
caagtagagaattgggaccaggaaaaataaagccatgaaataatgagtctgctgtattagagtaatgtggaacaagtgacaatttcattttttaagaatgctgtttgtacaaacaaccccatcaaaaagtgggcaagggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgccggagagggtgtggagaaataggaacacttttacactgttggtgggactgtaaactagttcaaccattgtggaagtcagtgtggcgattcctcagggatctagaactagatataccatttgaccctgccatcccattactgggtatatacccaaaggactataaattatgctactataaagacacatgcacacatatgtttattgaggcattattcac

SEQ ID NO: 16823 - DNA, 488 bp, Homo sapiens
ggggcaaggtgggctggaggtaggtgacaaggtttggctcccaaacgggcactggccaaaaacaaatggaccagcagggccaagtgacatggcagaagaccaggtgggtgactcggtcaacactttcaaacatccccaaagttatagtaagcatcaagagaccacttactagagtctcactgttaagagtaaaaagagattgtgtatgcaaacaattagaaaaatcagaaataactaatgtttaaacaaaacctaacaccgtaatacttcaagacctttgggctcatagtctgcctgacacataggaagtggacaggatggctcagagcactgtaaaggacctcacttgacctcctgcaagtcagttcttctcaggacaaagtggacttttccacaagtttgcctttagcaatattataataaactgcacttcaactgtcttgaacaaactcacagctccacaccaatgcagtcttaaaaatgagact

SEQ ID NO: 16824 - DNA, 572 bp, Homo sapiens
tcttagaggtcaccacaaggtcgctggagaaacggggaaacaaagatgccagtggaaatcttccatttagttttagcctttatttgttaacattcttctgtcacaaggtcttctcacccttgccaattatagaaagccattaatttgaaacccattataagccaccttatgatcaagaaaggatcaagctgaattaaattttccagcccaggaatattgatataactgaaacacaagatggaaaatctggacttgaagatcccaactagcctgcgtgttctcaaagccatgtgctgagaaaagaccccaccctgttcattttaagccttgtacttgtactttcctttgaaaacattgaactttagatttatttgactgaaaaacagatcttaaattttcccctcaaagatttttaattaggatatttccaactaattccttttattttaggaatggaagtaaaagcaaatgtatactaattctgtcattgcttgtttagaagagaatgagtagatgcttatctacatcaatagaaaattaagtaacgatataaaattataaacacagctact

SEQ ID NO: 16825 - DNA, 432 bp, Homo sapiens
caccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaactt

SEQ ID NO: 16826 - DNA, 602 bp, Homo sapiens
ttacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtcccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaccgctagaccaaggagccctctggcggccctgtccgggcataacagaaagctcgcactcttgtcttctggtcactcctcattgtcccctcagctcctatctctgtatggcctggtgtttcctaggttatgattgtagagcgaggattattataatactggaataaagaataattactacaaactaatgattaatgattcatatataatcatatctaagatctatatctagtataactattcttattttatatattttattatactggaacagctc

SEQ ID NO: 16827 - DNA, 376 bp, Homo sapiens
gggagaactttatttctaaagccattgttagaaacagtggagatcttggtggatagcagttaagagaaggctggtagcttcataattggacaaagtggcagagtagccagaagtttaatagaaagaaataggaaaagaagaaaccatgaagagtattaataagattataataaaccatggagaatgcgaatgttgtacacagctgctaagttgcacctacaagggattaatcagggcagtaaggaagtctcactggcacaaggggcttacacataacctgtcaccgaacactaccagaacaataagctctgctgatttaagggtgactcttggaaagccaggagtaaaaatattaacctagtcatccccagcagtc

SEQ ID NO: 16828 - DNA, 450 bp, Homo sapiens
aatctaagtgaatagtcctatatgacaagtataattcatcaagatttgattaacatgacactgttcgaatacaagatagattctctttagtaaagacaagcatctgagtcagaaatagtgaacacacacacattgaaataaagaaaaaccttaacgtagcatatgctagaagacaaaggaaaactagcagaggatctctgtagtacttaaacattttttgatattttgtggtgctcacaacccttgttaaaagaaagagtacattatctgtagtacttagttggaatattgcagatgtttctagtctttgtaaacatatcacagcatcttaattctttgtttatttgaattgctccttagtcatgtctctttttcattccattcttaatcaccgagtctgtgattaaaaatggcaaacatgtgttttgagaagaaactaagctatgattt

SEQ ID NO: 16829 - DNA, 446 bp, Homo sapiens
  misc_feature 88: n = A,T,C or G
tgtcggtattcagcttgtaaatatctatcattgtcagagcttgcatttaaggaataaattcctagtcacagccatagtcatattttgnggatgtcaaaactggcctcagaatacagaataagtaccatttcccattgttgaaagtacactttgcttctttattacatttgtttctttatcttctctatagtctatgttaactgtatttcttcttttcaggctggctaaagttcaagaaaatactattgcttctttaagaaatgctgctagtcatgtaagtaacctttaaacaactttagactgctgaggtagagaaatatggatcagggagtctcctccagtttttattaatagttaggggaatatctcttggcatttatattcagatccatggtgaagatcggaatgaagacaatagaaccataagcatcttttctttttttttg

SEQ ID NO: 16830 - DNA, 369 bp, Homo sapiens
ccagtgaatttcatattctggatggggtagtacttacagcacatcattgacaatgttcaggttctctgaatatatttaaggacaacaaacacagcatatggagagaggctacagacacgcacaataaaggaagcttttctgatctttgcttttatgatagcctagaggtttattatcccttttctgaggcattcattatcccaagcataatcaaacaattatagtcatatgtcgcttaatgacagggatgtattctgagaaatgtgtccttagcctggattgtgtagtctgttacacacctaggctataccgtattgcctattgttcctagcctacaaatctatacagcatgttactgtactgagtact

SEQ ID NO: 16831 - DNA, 448 bp, Homo sapiens
ggagtactctgtactgcgggtatgggctctctccagcagtgacaactcagcatctctctagtggccactgcttttgcttcctaaacatgctgttttgagtagcctcaccttacaaatagatttgcagaacaggaagaagattcttgaaagggaagattgtgatgaaaccgataaaaatctctgtattaaaatcttgtacagccttctgttttaatatcttttcttctggatgagacattagtctttaacttttgaggaactctgtaactgaagacaaacaataaaataccaacagagaggaaattattaaggattatatgtatttaaattacttttatcagtaacccactctagcctcagaaggtataaagctaacggagaaggggacatttaaaaccaatgtatttttattctgtaaatctttaacttaaaatagtattttgaattc

SEQ ID NO: 16832 - DNA, 478 bp, Homo sapiens
atttttagtctttcccttcatcaaaatggagaattatttgtttgcatgtagattgtggtagagttggtatgtttcagatttaatgaaatgcagaacagaataaatccctcgggaaagaaaggaaagaggggatacgccagacttagtatatgagagtagtcaaaagcctggttttaaaagtcaaagaaaccccaaagttgacacctggtccctatgctaactagctgtgtgacctcctccatgttacttaacctttccgacctcccagtttctttagtagcaaaatggagatgttattattaatataacagaccttgttgaaaagatgaaatgagacattgtatgtaaagcactttaggaggacatgtctgtcacatggctgtgctaaattagatgttattatcctgtcaacaggctgaatagcaagggggaaaagttctaaactttggaatcctgtcgtaatacacacagagatctc

SEQ ID NO: 16833 - DNA, 318 bp, Homo sapiens
cttccacatgcatggacactgccagggctcccacatgaccttccaatggtggtgcaaagcacccagggtctgcatccagcagcttcagtcaaggcccctgctctattgctctggcgagtctcaatgacttgattcaagaggcagcatgggcccgggcttaaaagagccgggccggttcctcgctgtgtgaccctaagcaaacaatatcacttctctgcttcctcatctttttttaatttaaattttattttcttttaattgagacagagtctcactttgttgtccaggctggagtgcagtagcgtgatctcggctcac

SEQ ID NO: 16834 - DNA, 426 bp, Homo sapiens
cacctacacacctgttttctaattaacctggtcctgggtaatcttgtccagcaataaagcccaccccctcccacagcaaggattgacttggttatgcagttggcatttttacttatgcttactgctggctatctcctcaaatccttaaatcttgtctttccaaataaagtgcgattccttgagggtaggaccgtctcttctgcagccactagcctaggggcccagaaaaagaaaatcaggaatagctaaataagtcatgtatgtgggatataataaactaagcagtattaatcatattaacaatatatagtgtttactagggggtcagacactgttctaagcacttcagatatattaacaactgttaaatgtagctagtgttacatacgtgtgtttcactaatgagaaaacaaagtcacagaaagc

SEQ ID NO: 16835 - DNA, 410 bp, Homo sapiens
aggatagtgattacagctcatttattaaaatagcaacattggtacatatctgagtcaagcctggaactccccctccctctcaactagacaagttaggctttaaaattactgtaaaaattaagtcaaattgcctgtgaaggtaagctcttagaagaattttttaggtagatgatctacataacaagacatgcaccaaccaaatctgcagtcaaatattgggggaaaaaagcaacaacagtaggtttgtgtttattgcgatgtctggaatattttaaaaattaagctcctggcctcagcctagggatttctaatcaattccaggaaatgtactgtatctttccttgaggccagcaggaaagccccttggcaagggtgtctggaatggccacttgacatccccagcacacctc

SEQ ID NO: 16836 - DNA, 437 bp, Homo sapiens
ggagctggcagggcatggtggctcacacctataatcccaggactttgggaggccaaggcgggaggatcacttgaggtcaggagttcgagaccagcctgaccaacatggagaaaccccgtctctactaaaaatacaaaattagccaggcacagtggcgcatgcctgtaatcccagctactcgggaggctgaggcaggagaatgaaccctggaggtggaggttgtgatgagccgagattgtgccattgcactccagcctgggcagcaagagcaaaagctgcttttttagtttatcttacctgcctgatctctatggggttagagtctgtgtgtactagtgcacataataaactcaaaagcaaagatggctagaaaatgatggttattatgtattggctgacttatttgacactcttaattatttgtcctgtggggtcat

SEQ ID NO: 16837 - DNA, 371 bp, Homo sapiens
aggagacagaagctgctatacctctttcaaataagcagatggaccggtagtgactgactttgcagaggaatcacacagtacctgtaagtgcacaaaaatacctgtaagaaatgcagtactgtgtttgtccgaagctcccaagagtctcagcatttggaggcaccagatactaaggaagataggggtcagaaatggagctgaaaacaggggagctggtcggaaaatctgtgtacactgacaggtggacccctacgattttctccctatgtgcccttgtggatgggtgagtcccttcactaccaactccctggcctcaggagaacaaggtttattctttgcaaaattaatgaagagctgtctggactttgaaa

SEQ ID NO: 16838 - DNA, 291 bp, Homo sapiens
gagttttattctctcggacaagatgaaccaggaggactctagacatggatcagcaggcacactgatgatgggaatgtgttactgaaaacaaagagaagtaaataaaaatctacgcacggagcagtgatatctcagggtcccttttcctattcatgaactctgatagatctggcctgtgccccttccccacaccaattaagaaattgctgaatttccctctgacagaggaaaaaaaccaacttacccatggaacaaaagcccatgaaaaaaagacttaaagatttttaccac

SEQ ID NO: 16839 - DNA, 418 bp, Homo sapiens
tagcactcaccagcagacaagaagtagcaggtgcaaaaaaggctcaaaaattttggcaaagaaaagcttaaaattgtgaaaattttatccattaagttatattttctggaaattgcaacacccctgcaattattccaatttagtgatggaacatatccgttttgcagactgagaatctctaaactagttctaaaaatttaatactacaagttgtcccgtaccagaaaggctgtgacttgtctattaatagatactatattaagagctcatttttgctttggtagagggctgagaggcttcagttttgctgtttgcactttccatttcctgttaccacatgcaaatgaactattcaactttttttcctttctcatattaacttacctaaatgtttgtgccatatacaaaatggtatcta

SEQ ID NO: 16840 - DNA, 412 bp, Homo sapiens
agtgaggactataaatatcactgaattactatggaggtgggctgctgctatgggctgtgtggaaatacttttgatgatgtgtttgcatgtatatttcttgggaggaactcctgtttaatatcccatgatgaaatgctgagaatctgccaggcgctgtggctcacacctttaatccctgcactttgagaggccgaggtgggcggatcacctgaggtctggagttcgagatgttagaaacaaatgctcgttcctcagtgcggaaaagaagaactagcactcagacaaagaattttctcagcaaggcaattttactttctgcagaaagggtgcttcttggaagtctgattgccatgagagcaccttgaacaaagaaaagcagaggtttttatccctgctgcattgggtccttact

SEQ ID NO: 16841 - DNA, 383 bp, Homo sapiens
caatgtaacctaatgagctttaactttgtccccagatactcttatttattgttactaactgctgcaatgccttcaggtcaatatctgggacaatccaatctgattttgaatccagatacaacatcctatctctcctttcctctctttttctttcagaagcagtgtaaattactggcattagcaatgacagcaaacagaaattctcaatagcaaaggtaggttttggttgcaataagaagtagatgtaattttcttatatgagttctctcatcatgaaactcaatctctttgtgtgttaacgctggcaccaacacttggagtatctaactttcagcatgattgtctcacaggtattggacaattcttactctcttctattaact

SEQ ID NO: 16842 - DNA, 437 bp, Homo sapiens
gaagaaagcctgagtatggtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtggagagcaactc

SEQ ID NO: 16843 - DNA, 338 bp, Homo sapiens
aagatggatgcattacaaccacacccacccaaaaccctgaactaaacagcccacgtgaaacttctttcccaaaaagcattccaggtgtctatggctctggctatataaccctaacataaaaattgtcaaatgccttccttgtgtgactcagtgtagatgacaaccctatgtaggttcactacattttgaatatttcacctatcagaaaatctggacagaaaaagagactatttgtcaggataggagaccatacgcattatggttcatgcaagagaaagtggttataaaacaatataaatcaaaggaaacatatttatttaactttgtacgaatatact

SEQ ID NO: 16844 - DNA, 403 bp, Homo sapiens
  misc_feature 239, 240: n = A,T,C or G
cagaaggggtagaaactcagaaagagtggaaaaaggagaaggccaattatgctactgagacaggattcagatatatcaacacaggtaccaagcaagggcaccacaaagcaggtggcagctgggactcaagccccatgcacactagggcactgcatccttgattggaaaacacaaagagcctgattctatacttattggatagggatgtcattaggagtcaagttcagtgcctgggccanncatgtttctctctttgctcagtttccaggaagcttaaaaccaagctgatgcgcaaaagacagaggctgttcctttctctcatctaacttcatattccctcctctaccacctttttaattgcttaaattttattctcttttcatttaattggaacttgcatcaa

SEQ ID NO: 16845 - DNA, 369 bp, Homo sapiens
gaactggttttctttgattaataactccatgccatatctaatttttaaatgccttgcatccacacttatcacaccaaaatactttaacattctttactttcacctttgtctctgatgacagtcagtgcaaaactactttatcatcccagcagggaaggccaatacattcccagcaagtataatttctaccagaacaactcatgaaatgtggtaagaaatagtgtgtgggtgtcttaagataatactttttaaaaaaaaatagagaagagagttttaaaaatctttctttttaaaatgagatctaaaagggggaagatgaaagaaaaatgtgcagaaaaataaaatacaacaaagtatagatattatata

SEQ ID NO: 16846 - DNA, 457 bp, Homo sapiens
tgcccaggttttgagtgggtgtaagttttcagctcattggggtaaatgcctaggagtgcaattgctgggccatatggtagacctatggttagccttgtagaaactgccagtctgcttttgcattctcaccagcaatgaaggggagtcactgttccacatcgtctccagcactgagtgttgtcagtgtctcgggtgtgctgtgcttttaaactattttctttttaaagccgggcagattggaaagtatgcatcatttttgttgcccacaagaagcttgttttgaactgttttatgttcacagtttgggatttttcaggcaatattgctgagctttaacaggaactttgcagtcctgtcaacctgaatttgagcccttcatttgcaagtaaccttgccgtgtgactatgagcaaggtacctaacctctccattgttcagtttctttatctgtaaaatgc

SEQ ID NO: 16847 - DNA, 511 bp, Homo sapiens
ggttatacctgacagatgtccttccaattaatattttgacccaaatattctctctatgaaattgcagccttggaggcactccacctctctgccagtcatttctttaaaatagtagaggagagagacaaggagattaagcaagggaaggaaaattctacaatggaaattcatcagttgtctaagacccatggatcagagtcttcaatgaaaactgcagttatagttaaaactataggaatagataaataaggagaaagaataaaatgaagacatagaaaagaactgcaccctgcagtacaagtggatcatcaatacccttcctcaccttgtgtgttttaacatacattttgtgatgtgatttaaaaacaaaaacaaaatcattctgctgcaggtaagaggaatattatttctattttataaacgaggcaacagacagacaaaaagtgctttatcaatatagcacccctcacctttatgatgcagttcattcctggaagtcacactgaaaaaa

SEQ ID NO: 16848 - DNA, 475 bp, Homo sapiens
gtgaattagaatataacccataaataatatctggccacatacaaagtaattgaagatcaatttaaatagccattggattaagaaatagagactgaggtaaatttacagggtcagggaggatttaaggaggaagcactgacactggagcccaaggacctgggattacagaacagattctaccagtgctaactgactgctccagagaaaacatcaattctgttcatgtgcagctactattcatcaagaaagggattacaacttcagaaatgtgttcaaagtgtatccatactttgatgtattaatgaagtaatcacattctacacataagtactccatatggaatattggggagggggtgttccaaataaagagattgaggatttttcatgagaactcagtgtctgctagaaaatatctaagtaaaatattttacttaagtggaaagtgtggatgtttgtgcatcaaaagtttcaag

SEQ ID NO: 16849 - DNA, 441 bp, Homo sapiens
gatctagcattatattaaaggaacaatatatgattaaccaataacttccagaaattcagagatgacttgatatgagaaaatatatcagtgtaattaatcatgttaataattgaaaggagaaaaagagccagatgctgaaaaagaacttgaaaaaatcaacatctattttaaaaaaagatctttacaaaacttagggtagaaaagtaagtccttatcaatatgttatgcaatgtttattttaaattgtttatatgatacttaatagtatcatataaactttatacgatacaagcatccctgtcgaaatcaaggtccgaagaagagtcctcgttagcatgtgtatcatttaacattcttctggaatgtttagcctatgcaattagatttcaaaaagaaatcagaaacataagacagattactctttgatggtgatttgactac

SEQ ID NO: 16850 - DNA, 400 bp, Homo sapiens
cacttctgtcactttgccatagacgaagaatacatagttacttaaacaaatagtgaatttaattgatcacattgtgtgtgtgtatgtgtgtgtgcatgtgtgtctatgtattgcccatttgtgcatatacaattctggactagggctataagatataatatagggcttcatgagtttgtttggaaagtaaaatatatacatatgtatatataaaagacagtagctatatatatgcaatgcatatgtatacacacatatctgtatatctatattaacagacatatagacatgtggacacatatatagataaatagataaaggtatactacagaagataatacttggtaacagaatatgaactgcataatgcttgaggcattgcgaaggtgcgtcacaatga

SEQ ID NO: 16851 - DNA, 451 bp, Homo sapiens
gaattgtatgacattatcagttagtgtgttgtgcacaaccattttcaaacaccaattctttttaattgtatgaaccttgataaatcaagccaacagtctacctatatttaccatagtgtttccttcacttattcactaaattttggagttaaaaaaatttctgtttgggaaacaatatctcattattcaaaatagaatatattaaagtttgagggcacttgatttgaatgtaataatacatttctaatgtgtatgtatgcaagtttgtatattcattatacacaggcacatcaaaatacctgattttgaaccaggcattataaatgtctagaaaatatccaagggagatgatggtatccaatacagaactgcaggaaaatcattacattattttacataatcattacattatttcattacattaatagaagtaaaatatctattaaaatac

SEQ ID NO: 16852 - DNA, 397 bp, Homo sapiens
ttcatgaaataatggctgttataatatatgaaaagttaggttaatataatccactttagaaggtaattttgaagatgtaaaaagaccacatatattgttaagtgctagtcagcagaagctctcttaacaccatgtcactgatttctgcaattaacctgccaactgatgccaaggaaatggtgaccacactgagccaatggaccattttctagcacctctgtccatttctcttctcatcagtttcttgccaagaatcaggtgtgtttgcttccaaacctgttttgtcaactgcacttgttattgtaattacataatcaatgaaatatcatgagaacaaatgaactgtatgtgtaaaagaaaatcaaattatgtctggaaaaaaattcttgataaagga

SEQ ID NO: 16853 - DNA, 260 bp, Homo sapiens
gaaaatctaagacctgagtaactattaaatattacttactcatgcatcaatcctctgaccactgtatgtcccctgacatgagaatggtagaaaagggtgtattagtaaggcagcaataggccgggctcagtggctcatgcctgtgatccaagcactttaggaggctaaggcaggcggatcacaaggtcatgagtttgagatcagcctgatcaacgtggtgaaaccctgtctctactaaaaatacaaaaattaaccgggca

SEQ ID NO: 16854 - DNA, 492 bp, Homo sapiens
caataagttttcattttaccaaagaattaaaggaaaaaagaagaaactagttactaattaaggaatagttagggaaattccatattgctgggagtgcaagtggtaaaaattctctggaaaatgatgttgcaatattaatccagatcttaaatatatttatatacgttaactagataattctccttctacagttttatcccatagaaaatattaaaaatgtggacaagatttatgtccaaagatttttttatctaaattctgtttaattcatggcaaatgtctgtatgttcaacaatagaatactatgtttaaaaaaattaaagtgtatttatgtgatgaactattatttcatggaacttgtttcctgtcatcagaattcatgggtacagacctaaatatactttataatctgtgagggtttgtgatcaggggaggatggtagcaaagattaaaatgaaatatataccaaaaacttaatagtaattatctctc

SEQ ID NO: 16855 - DNA, 289 bp, Homo sapiens
taccatgagtttataactgggtgattgtacctagtttgaggaaacatggttttgctttggcacagtgaattcagtaaacgagtgagtcaaggaacaaatccttatgcaagaaataatgcttgtgcaaggatatgcccaacagacttaatatactttatttactaattaaatccatatgaaacacaaagagaggaactactaatcataatcaacgaaaaccataaattaaataatttgattggaagtaactttagagatcatctaaagcagtgcccttaaaatgtcagag

SEQ ID NO: 16856 - DNA, 338 bp, Homo sapiens
atacaagaacagctggatttggcccgtgggccctaacttcccgaaagcccctggttaatgtagcctgccccttgtttcccactctatataactataggactgatcacctgaggtcaggagttcgaaaccagcctgaccaacatggagaaaccccgtctctactaaaaatacaaaattagcctggcgtggtggtgcatgcctgtaatcccagctacttgggaggccgagggaggagaattgcttgaaatctgggaggcagaggttgtggtgagccgagatcatgccattgcactccagcctgggcaacaagagcgaaactctatctcaaaaacagcaag

SEQ ID NO: 16857 - DNA, 302 bp, Homo sapiens
cacacctaactgcaccaatgctactcctccacacatcatctcctactacacacccctcctccaatttccccactcaccaatgctcatttctgggctattagcaagtaaaacagttacccccagtttcctacgcatttatttacatcaaacatcatgttctatgctgtgatccattttcagcattgcagttttaattaatgtctaatgaacaaatctcgtctttgcatgtttcacaatccacagacaagttaataaatgagaatgtttcattataaaaatcattgcttccattatctatctac

SEQ ID NO: 16858 - DNA, 426 bp, Homo sapiens
gggaagactgaggcaggagcaagtttaaggagggaagatcttgagtttaacataagtttgagatgcttattagatatcaaactggaaatgttatgtagagagttaaatatatacatctgaagttcaggggagaatttggttagagatttaagtttttcagtctacaggtggtatttaaagcaatgacactggataaggtcactaagagatccaaatgtagacagaaggactgagacttggcacactataatatgaaggggttgaggaaggaacctcacttattcataacacacaaacacatataaattatgtattttgtgtaccgggagaaaaccataaactatttactgcttaggagcatgtctttcttatctccatatgctttgtataagcctggcacacactcaacaaacatggggagtgata

SEQ ID NO: 16859 - DNA, 422 bp, Homo sapiens
gggttggagtcagaaagtccatgcttttgggggatgactcctttgggaaaggggatagagtaaaaccagtcaagagagataaggtgaagggttcaaggcagctctatatggaggacaagggtagggacaagaggtagtaagtaagaggagaaagatgaacttttggtttttcaaaatattcctagtcactgtcctaatgttgataccaatggtacattcatagcatgggatattctgcagccgttaaagaagtaaggtagatttatgggtaaaaagaaagtgtaccaagacaaggatgccttctctcaccactcctattcaacatagtattggaaattctggccaggacaatcaggcaagagaaagaaataaagagtattcaaataggaagagaggaaggcaaactatccctgtttgcagat

SEQ ID NO: 16860 - DNA, 496 bp, Homo sapiens
cattatgaaccccaaaggatgtaaattaatcaaaagattagagatttcttctcttcaaacacacataacctagaaatatgttaggaaacttttagtaaaaataacagtagactacagcaagaagtgcaagaaagtcactctctctgaggactagaacaaatggaagccacaaaaccaagagaagagaaaaaacagggacaatagagaaattgcatgcctctactgcctgtaggaataagaaacatcaaacagcccaactcttaaaggcttatttaatctcagtatttactaccccacacaacaaaaaatttacaagccatgctaaaaaggcaagaaaaacacagtctaaagagacaaaacaattatcagaaccaaacaccagtatggcatagatgttggaataatcaaacaaacatggaatgtgacatgacaatgattaataataatatgttaaagaggttaaaggaaaaatatagataacacacaggatgagata

SEQ ID NO: 16861 - DNA, 446 bp, Homo sapiens
actgttttttgtcttttttttagtcaaggtctcaccgtgtcacccaggctgaagcgtagtggtgtgattttaattaatttctgccttgaactgggctcaagtgatcttcccgcctcagcctcccgaggagctgggactacaggtgtgagccaccacgcccagctaatgtttttatttttacagagatgaggccttgctgtgttgcccaggctgggcagatcctcagcctcccaaagtgttgggattacaggcatgagccactgcgcctggccatctcatgtttaagtaagcttgggaagtgctacctgtttctgcaatactgattggagtgcttgctccatcacggtgctgagcacagagacagctctttaaaatttatcacacttaatcgtcaccacagccctgctaagtcacgggtcataccccccctttacagatggaaacac

SEQ ID NO: 16862 - DNA, 441 bp, Homo sapiens
cagtttagatgcatttgtcgtaccgtcaaggggtaaaatattaaggctgaaatcgtatctccattggcgactgtctgctggtgtcccactttctgtgttgattgagtcagatgacagagcaacaattagtattcagagacaagcgctgcccccttcgaggccccagaccaggcaaagtggcaagtccaaggggcttctcactcaaatgcagtcatgtcagtggtctgtcattaacagcaagatcaccagtcaactagggccagccaaggttgcttgaataaactaaaacagaagctggcagaatgcgataaagcagctaaattctgcaaaactaccaagtgactgtttaccaggctgctgaatgcacctagtttattttatgcaagtcagactaagcctgcatttggaggtcaaagcaactaggctagaaaagccaccatt

SEQ ID NO: 16863 - DNA, 374 bp, Homo sapiens
ccatttgagaacttacagcaagagaaaactctcaaggaaaacaaagcttgatctgcaaaggtcacgtgtgtacctacgctgggggaagagacctttccaaagctctttttgtgtactggaaaaaactcattacctgttcttcagtatgggaatagtcaaataaatgaggacccagccccataataaaatactatgtagtcaccaaaaagaatgaggtaagaatgtaggagtactgactgggaacaatgctgatgatacagttttcaatgcaaaaagcaagttccacaacaatatacagagtacaatcctgattttcgtaaaagaaatacaatttaatcaggatacatacatatgtatgtaattatacatatgca

SEQ ID NO: 16864 - DNA, 454 bp, Homo sapiens
ctgagctccctttgctggcctaggaaaagctagctggccaaaatggtctcagttttcaatgggatgcagttggacaagagaggatgcatcagacaagatcagtttgaccttggctgcaagaaggagcagaaggcaaatgctatcttccccagtgaaaaacatcactagccatccagggaggaaatctggttttctcaactggagaagatagctacagttcaaaagtttagagtcttcttcgtgaatacagttcctggcatcagttgagggatcagcgtagataagtggaagttcccacttatagcatgtttgatttctttcccccaatgcagtttattacctctaagtttatcctgtagctcaactcggactaataaagttttctctagtacagaaggtccatagaggatctactttattagtttaagtgggttttaattagtcaattagagaa

SEQ ID NO: 16865 - DNA, 375 bp, Homo sapiens
ctaataaaataaatatagaaacaaacctcacagaacactcattcccctccagctttccagagcaatcaaatttctgtcctacctgtgagaggcaattcaacacgatgtcgaagagcacagatcctggtgccagcccacctgaacttgaagctcaaagctttactaagcttctattgtatacgtacacattaggggctatagaataaaaggcaacgacaactgatttgaaattggactaagtgcttagcatatacacagcatctaaaatcctcccacacaattataaagttattccattatcttaactttacagagaaaaaatcaaaattcaaattgttggttgtaacgttgtataattgacaatgtttttaaaag

SEQ ID NO: 16866 - DNA, 455 bp, Homo sapiens
ttactgattaaagtaattttacagtgtattctgcaagaacagtttttcttagtttgtactcagcttaaagatacacaggaatgcaaatgaaattactcactaaggcactgctccctatttggaaacaatacttctctctttcccaaactgtgtgaaacatatttcctttcaaaattagattaccactttcttttattttgagatctttaaaataattctacaagttcttgaactactcagaaatgaacttgtaataaaatcaagattgggaaatactgttttattaatttgagcattaatttcatgattgcatattacttagcctctaactagccactatggaattgaccaaaaatggcttatctccagtagttattctttctttaattaatttttaataaaaatatattagcatggtaaaaatcacataatacaaaggacaggcaatgaaaagt

SEQ ID NO: 16867 - DNA, 491 bp, Homo sapiens
caggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggc

SEQ ID NO: 16868 - DNA, 120 bp, Homo sapiens
tctctcatcttcctatagtatgcggacactgtgaggaccagcatactattctttggctaatgataggacaatgtgagttatatgcaaagacacacacacacatacacacacatacacacg

SEQ ID NO: 16869 - DNA, 592 bp, Homo sapiens
acttgaggtgagttgtacattattcctatttaggtatgaaattgtatttgcagttatgtttcaaatctatcttcaatagtatgtgttaatgtcatttactttatatatcaagaatgcaggataatgcctggcacacagtaagctttgaatgagcagagaaaatggatgattagctgaggggttctgaaacaggcagtatcatattgttgagtggccctgcgctctcgaccatcagcagtggtttcagtggtgttcatgccttttgagtagccttttccctgcttatagaatcccagaagtctgacagtctttcttcatttcatcccatatttgccccctttatttcaaggggattggggagatgttggttaaaggaagcaaaatttcagatagataagagcaattagttcaagaaatctattgtgcatcacggtgactataattaataacaatatattgtatacttgaaaatttccaagagagtggattttaagtggttttaccacacaaatatgataagtatgtgaggtaatgcatatgctaattagcttgatttagccattccatgatatatacatgtatcaaaacatca

SEQ ID NO: 16870 - DNA, 617 bp, Homo sapiens
ggcctgaggccctcagtgactgcagccttcgacttagaaacggctaagcctgaaatgatggggtgtgccccggatgcctcagacaacagataaagctactccagccaggaagacacagaagtggaagacggagataaaactgcatgaaacgaagggataaaggaagagcaggatttctaaatgaagataccggttcctaaaggatgcaacctgagagaagcataatgaccatatcagcctatttataagcaggcagttaactcattcatcactctgtagctgacgcctgtgcccccagctgcactcacatggcgtggtgagctttcacctgagtgcggcagttacggccccagtagcagtcaggacgggatgttacggccactggaaaaagagaaggggtacgcatctatgagatgtattgcacgcacccactcagctacctgaatcccagcagagacccaacgacagacgctgcggtggaaacgcacggcctctggtccctccataactagtttcctcggaccgttctgagatttcaggaaaggaaacacatgtttaactaaaaacccaactgagggtcaggtacagtggttcatgcctgtaatcccagcactttg

SEQ ID NO: 16871 - DNA, 578 bp, Homo sapiens
  misc_feature 471: n = A,T,C or G
caacaaggctaggcactttcctaaatcagactcttacgaggaaaaacagctcacatttgttttctctcttcactgtggaaaatgttgcccacagcaccagggggatgatacccacttgccctgtgggcttatctggctcttcagggataaagaaagatgagaaaaggccatttagttaatgaggcctccacatccagttagaatttccttcggttccttcttccctcaatcctttcttctaaggctgtaagtggcctgagggtttgcatcactttgtgagtgtaaaatgttaggctcataaatgcttagtgagaacacaccttctctgtttcagacactgtgctctgccttgggcatacaaacatgaataagacactgtgtctgctttcctggaactttagactggcaagagaggtggattattttagcactacattattggtcttctgatagacacatggactctactgngggagcccaaaggagcagttcctgactcaagagagtagagtcagattttacctcctccaggaagataaaacctgagatcagcattgaagaatgtatcggtaggagtc

SEQ ID NO: 16872 - DNA, 451 bp, Homo sapiens
gaggcaatgcctcaccatgcttcggctcacgctcggtgtgctgcacccactgttctgcacccactttccgacactccccagtgagatgaacccagtacctcagctgaaaatgcagaaatcacccatcttctgcatcgctcatgctgggagctgtagactggaggtattcctatgtggccatcctggctctgccccgatacatttactttctacaacttagtagaaccaacttacctcatttatatgagaagcatgcaagaagggcatagaaattgtccattttagtacacacttaaggaaaatgacagtaaagatgagtatcccaaagcaaatttaaaaacttaaaagataggaattataagtgagtgattcaattagatcataactttttacaatactggaataaacataatagtacacatgcatataaaaccaagtattagagaatata

SEQ ID NO: 16873 - DNA, 492 bp, Homo sapiens
agaactgtttgtttatttatttattgagacagcctctctcttgcccaggctggagtgcagtggcaccatcttggctcactgcaacctctgcctcccagttcaagcaattttcctgcctcagcctcccgagtagctgggattatagacatacgccaccacgcctggctaatttttgtatttttagtagagacggggtttcaccctgttggccaggctgattttaaactcctggcctgaagagatctgaccatcttggcctcctaaagtgctgggattacaggcgtgagccaccgtgcctgcaataaggaggcttttaatctaaggtctgaatgacaagaatctaaaccatgaagagatcaggggagaaaaatgcaggaaaagaagacaaggacaaaggccttaaggtgagtgtgagccccaacaaaagtgggggagtgggggctggcacatgctgggttagagggtgaaggaattagatgaattttgaatact

SEQ ID NO: 16874 - DNA, 363 bp, Homo sapiens
gcaaattgaattaactaattgcaaacccagtttgctctagctgaagtatgtggaaaagattggattaactattatatctggaaagtcaaagggttttctggcctcaagcattgatgaatgaagggtatcaagctatatcaacaggatggatctctctcttttttctccactttcctctgtgctgtcttcattctcagaaggtactttccttgtggcagcaaagatgactcccatgatctctggatctgcatagttcttactatttgcaatctaagaacctatctctttgcgtccttattgctctttcagaaggtctctgcttgacgctcttagataatgtgtccacccttgagtcaaaagaag

SEQ ID NO: 16875 - DNA, 395 bp, Homo sapiens
aacagcataaattctactttattgtatgtcaaccatatcatattctttttttttttaagtaagctacataatttatcagctctttcaggacagcagatgtcttcctcatgatatgaaaggttttttgttgttgttgtttattaaacaaatgtttgaattctgccatgtgctatatgctgggaaagcagcaaggattggagtgatcattgtcccctgctctcatggagcttatgacctaagagtgaagacaagcatgctacatgtacttagtatctgtatccaagaatgattacctgctgatgctacagttttgcccctgcttaaaatccttaattcacagaagtagaacaggaaataagaaaagctttaaacacaaaactagcaaattacacatt

SEQ ID NO: 16876 - DNA, 534 bp, Homo sapiens
gactaacggcattttcattcgtgaacagttcagattaactcataaacaacagaaacattttcacagccagacaatggcactctgtccgctgtcaatatttctcatgttttggaagaagcctgaccaaccaggatgacctcttgccatagcagtgtggctattcaggctagttccaggacgcagtgcttgtcccaatgtaattacatatgctgcttgacattagggagccactggagaagtttattaaaagtaatttccggctggccacagtggctcacacctgtaaccccagcactttgggaggccgaggcaggaggatcatgaggtcaggagtttgagaccagcctggccaacatagtgaaaccccatctctactaaaaaaatacaaaaaaattagctgggcatggtggcagacacctgtaatcccagctacttgggaggctgaggcaggagaatcacttgaacccaggaaaccgaggttgcagtgagccgagatcacgccattgcactctagcctgggcgacagtgtgagac

SEQ ID NO: 16877 - DNA, 542 bp, Homo sapiens
ctatactaatttaagaaacctatgaaacattgatgtacttgaaattgactttggtgcaagtatttaaatgagctatgatattccaccaatcacaacaagctgtggttgtcaaaatttacaaataattttaactttacttgtgttttgttaaaaaatttttaaatctaaattgtacgtctaatctctaccaattaatatacttgtagatgtgttgtcaatggggactttgtcactgctttgaggtttaaacaactattctcccatagggaggctttgtgtgtgtgtgtgtatgtgtgtgtgtgtgtgtgtgtgtgtgtgtgttgtcttttccagttaatgtgcttagggtttgcgacaggagaatctaggaccaagccacatcagttctctccttaatccactccatctgcctactcttccagttgtgctaccatagtgctcagtgcatttctaagagcaacaaaaatgaataaatctcacatgagtttttaaaaaataaatacataaattaaaatattttgcatcaaaatgttccacaaatg

SEQ ID NO: 16878 - DNA, 616 bp, Homo sapiens
tgacagttccttctatacacacgatctctcctgccaccatgtgaagaatgtccttgcttcctcttcaccttcctccatgattgcaagtttcctgaggcctccccagccatgtggaactgtgagtcaattaaactgctttcctttataaattacccagtctcgggtgtttctttattgcagtttaagaaaggactaaaacagaaggcaaagctactttggaatcataatgtattctgatactataatcactcaggataacctatcactgagacaaacgtgtgcagtgaccctgtcttttctgggatgagtccaccttaatcattttgattgaaatgactacctacagtggcattttaccaggtgggaaaaaaaaaactattcaagattgttaatctccttacagataacagaagtttgatatctcaaggacatagaaaatgagcctaatttgaggttcagtcacaatatctcaatttatttaaaaaccagtcaagtttcagttcttttttgatgaacactctgtgtgatctgatatactgctatgcttgtgtaaatgtcccttctcaacttaaaagcttttctggcctggcataggtcaccaaaatagatggattta

SEQ ID NO: 16879 - DNA, 522 bp, Homo sapiens
gttaaagtgttaagtgaaataagaccttgaatggtgaggaatggtcaaacaactgctgtaagaattacgagggatagaataccaagccaagagtcatgcaaatcagggatactaaagaatgaggaagcagagttggttttatgtaagcaaaagcaaatagcaggaagtgtagcctttttaaagaaatctcagtaccacagcctgttgggagagattatttgtgattgggagaaatgggagccatcagcaagcggaggggcttggaagtgatggatttttttcatggtttttttcttctgactccgttcgagattataggtccctagaaggtaaaaatctggtctttcattccacaaagtgttttttgttttgtttttttgagacggagtctcgctcttctcccaggttggactgcagtggcgcgatctcggctcactgcaagctccgcctcccgggttcacgccattgtcctgcctcagcctcccgagtagctgggactgcaggcgcccgccaccacgcccg

SEQ ID NO: 16880 - DNA, 501 bp, Homo sapiens
gcttttagccatctcaattattatgacctaagtttctggttccttcttttgctcttttgtgttacttttactctcttatcacttccagaaatagaatgccattttgatgtgtgctgatgatgaaacactcatgatagttgctcattattagtggtctctggtcacacatttcaaataagcacagaaatgtaaagaatagccatgtgtagaaaaacacatagaaagtaaatggtgctgttgatttgttctgaaataaggactcttcttcctgcaaatgtactcattaagatgttgtaactggctacacagtgttctggttaaaattggttaaattttcaccaaagctatgcatcctctcaattagtatttcagaaaactttattcaaataatccacagctgaaatgaatggtattttaaaaaccatacagatatgatgatatatatctatagtaccatacacacataatacaaaatttttggtcagaaacaaccaatgggga

SEQ ID NO: 16881 - DNA, 563 bp, Homo sapiens
cagtaaagaactagtttaagaatgtgacaaggcactgaacctaatataataccagggagtcaagacaatgagaggaaactcatactgagggtgggatatcaactggtggaatccttcagagaatatggcagtaagaatcaaaggtttatattcataggcttgatctagtgatatgcatttagaatctcagacttagtctaagaaaaatctgaaaaacacacaaagattcgggtacatggatattaacctaactgccaacaatagattggttaaaaaaataggaatatcatatagccataaaaaaatcatgtttttgctgaaaattaaaaggcacaggacaatgcttacaacttataaagggaaaagagcacttgcaaaatggaactaatcagttctttacttggatccatatactgtttcaggtagttgatgatatatcacaaatgacatgtatcattgtttgtgtacacatatatacacacacagatacacatattcatacatatatacatacatatatacacacacacacacacgggagaaagagacaggaagggagaaag

SEQ ID NO: 16882 - DNA, 567 bp, Homo sapiens
aaacagaattgtgggctgccagtcatgagggagggagaggagtattgcatggaaataaaactgacacatagtgtggatgggatccaggggagaaatgcggagcatgcaaaggagtcagctgaggacggagccacgggacctctgcactcgggaggctggaggaggaggaagatggcgcctagaagagcgagttccccgggagagaggtcagggagcgaggagaggtaggaaactgcagggaggcaaggccggctgcaggaaaggagcccggaaacctcacacgctcataagcaaactagagagtccagaaggccacagagaagacccaggtgggctccaagggcaaacaggtcccagacctgaaggaccagacatctcttaggaagcccctgtcccagcagacaaggagagagagcctgtgccaggggctggggagaaacccgcgcaggcagccacacagccagtttggatgccaagcaaaaacagccaaggtcatccgggccaagtcaaatcacaggccaccaaccatggcatggccaccctgtgggagcatgagcaggaactctg

SEQ ID NO: 16883 - DNA, 500 bp, Homo sapiens
cttccttaattgtattccattatctaatatgtttatgagaaaatgactactatcaaaggagctttctctgatcctgatgattgtatctgaaatggcacctccctcttttcaatctctacctgcttatcctgccttatcttttgttgttattaatagtgcaacacagtattttaaatagtatagttttatcaatatattagatgcacttatctctcttagcacatattatgatgccagggccattagattaggaaatttgttttattcactattatgtctccaacacttagaataatgtttgacacaaattaggccacaatcaatagttgtttgagtgaataaaggctgggatacatttacctccatctcacttcaaagtctattgaagtggcagaaagatgtaaacaagaacaataaagctaccacccaatatacatatacaaaacaacaacagaaaaacaaaatttatagtcacaacagagcagagaaagagttagccc

SEQ ID NO: 16884 - DNA, 297 bp, Homo sapiens
ctcctgtcctcctgtaggatccaggctaagctggagaggcctcactggtgtggagctcgatgacgtcatctaatctattagtttgtttggggcccatgagggcataatccactgatggcctcatcgccatgccgtgggtccacactaccctcaagctgaggctatgcttcctatagcaggaataccaaggctctttcccaggagtcctgatgagaactttgtctcaaggactcctcattggcctggccggaactttcttagtgctgcctttagtctaagactttttctgtcccacct

SEQ ID NO: 16885 - DNA, 268 bp, Homo sapiens
cttgctatgttgctcaagctggtcttgaacttcttaagggatccttaagggattctctggccttggcctcccaaagtgctgggattacacgtgtgagccaccgcacctggcctctcttcctcttgatagtgttatttatccctaggaattgggaggaaacctagctttctaggacccactgagcggatctttgtgccctgaagagcacctttaaatgttagattccagccgggcgtggtggctcacgcctgtaatcccagcactttgg

SEQ ID NO: 16886 - DNA, 660 bp, Homo sapiens
atgatttaatttttttctttgtcatgcaacaaaactggtacatgtagattcttttgaatagcatgtgaggtgctagcatttattttaattctttaatatttatctttatgcttataatagttaaccatgagaaagtaagttttctgacatcaaaatgtgcttttgtataatgactaagagaataatataatctcatctattgtaagctataaccaggggaagatatattataataaaaaataccaagacctatgagactctagaattgaattggaaaagtaaatgctgtaatactttgaaagagaaatctctcagagtattcaagaaacttcaggaaaaaggtaggacttgattcagattttaaagaagtgtagaattttgaaagtctcaaataactgcagtaaccatattaaaggactgattgatagtatgaaaaaccctgtgaaaatgctaccaaatgcagtgaagatggaaggaagaaggtagagaacgtgcccataatactggattaacagcagaaaagattagaagttaacatggggttagagttaggaagcaagcttagaacatcaggcagacaaatacttaattgatgatacaatacacaatagtcgtcggtatgtttttcagcaagtgtaagatatgataaaacctgaattt

SEQ ID NO: 16887 - DNA, 412 bp, Homo sapiens
cttcaccattcacaggatggtcttgatcttctgaccttgtgatctgcctgccttggcctcccaaagtgctgggattacaggtgtgagctaccgcgcccagcctctcctaggtgtttctttaaatgtagatacctgggccctacctgtgccttacagactcagacgcaggtagtgggtctcaggaacctgcattttaacttcctcctctatgcatcatttgagaagcatggctcagattctgacacaggaactgctttagttagggccttctgttgtgtttgaagtgctgtgttcctattataatggatactgatctggctaacatttaacaagaatcacagccttaatgaaaaacgtggaaaacatttattttcttttaaaaaataatattttcttttgtttttgatagaat

SEQ ID NO: 16888 - DNA, 679 bp, Homo sapiens
ctttggaaccgaacctgtggtatctctgggatatacctcagtctttagactaaagtaaggagctgagtgagggtttcatagagtaggtggtgatttcctgattttctggagaataagtgagtacttaaatagtaggcacagaaagatgcagagagggaattctcaacagcagtggtgcttttttttttaacagaaaaacaaagttagacattgaaaagtaaaagtttctcagtatgggagatcctcaagaaattcagaaagtgattataaacaaagaatagatcataaactactatgaacattatgctgtagtgtttaggtattacaagacaattgcacatatgatcaaaattttatttagaaatattcctgtgatcaaaacagagggatactttcaggggtgagtgagaagggatttaaatagacactataacactatggggatattttaaaataaataattaaacgagtaatgggaagggagaaaagtgtttggataatatttaaacaagattaataggacttggggttgcttgggtgtaggtgaaactgaccttaagaaggagtacaggcatacttcagacacattgtaggttcaattccagaccactacaataaggtgagtctcacaattttttaggttttccagtgtatataaaagctatgtttacattatact

SEQ ID NO: 16889 - DNA, 669 bp, Homo sapiens
agagtgcttaacaaaactgtgatcaaaagaatccttaaaattgcctgtaaaaatatcttaattcagagatatgtgtcaacatgcaaaccattctttgatactgatctgcttggttttgttcacagaatcaaacacaactttactggaaattaatgataataaatatttttgtttcctcaatattgtagaggggtagttagaaagatagtttaattcactgctgtggctttccaaatatgttccttggaaatgtggatcttcaaggaccatttggaactcacagtgttgaacatatgtatagcctatgcttggagtcatgtttttgtgctttacttctaatggtgaattgggagcctgaagttacaatcacagcatagaaacaaaaagagagaaaatttatgggtaggaatacaaagatactaatcttacagatataacactgtgttagatatagaggaattaatgataatctcagtttggttccttgtacagcagcataatagataaaaatatgctttttggaggcatgcagcaggttttcagatattgaatgacgttttctatgagcaacatttcctatgactcagtttccttaaacataaaattgtgttaatatgacttaatcatcaaagggaaaatgcaataataaaaatattcgaaaaatctgag

SEQ ID NO: 16890 - DNA, 357 bp, Homo sapiens
ttggatctacttcattggtgcaacattccaggtttgataaaacaattgaaacacagacatatacaactatttacttcacacacacacacacacacacacacacaccccttaaatgcatgtgaatttacttcttttataggtaaaagaaccatgactcagattttcctgcctccttacttttcttattctctttactgttccctaatttctttctggtgaaatttgctatctctcattctttgcccctccttgtagccttacctcaccctggcttcatgtggccttgtgtcagctcatcattttatttctatccaggagtcattctaggaaatcaagtaagcacgtaaaaaatcaaaa

SEQ ID NO: 16891 - DNA, 433 bp, Homo sapiens
ctagcatacaataaggatgtcatcacaagtaagtgagaaaaatgaagcttttaatttttatatggttaaaatgatcagtgttaatttttttcatgactaccggattttgtatgacagttagaaaagtctttcccaatctgaagttataaaaaaactagtccagggtttctgtctcatgttcattaaaaaaaaaataaatttattactggtgttagaacaattagctagcatctggagtaagttagcattgcacatcttacaccagaataaatcccaaattgattaaaggttgaatttaaaaaataagaccatgtaagtacaagacaatatcattgaattcttttatgtccttggaatgaggaagacctttcttaataaaatacaaaatctagaagtcactaaagatgaaaaggataattttaactacataaaa

SEQ ID NO: 16892 - DNA, 569 bp, Homo sapiens
atgtacaattattatttgtcaactaaaagaactttgaaaaggaaagaaaagttttttacattattccaaacactcttcatgaaattcttacataaaattgttccacctgtgtcttttgatatttggttacagaaaaactggacatatggttccttctcaggaagataaatgtaaaggtttaaaacagaccccaaccaaatggagtgtcacattctgatacgaacgcaaagtcaatgtgtgctgactgcacaagcagtgaataaacacctgaccttgtgacactggaatgttgcaaagtcatgaagtttaaacaactgatgatgtacaatttttgacattccataggcagactatatcccttgtagtttttcttaaagacagtgtttactttcattttaataatcccactcttcagcctcctagatgtcacctagtttatatccttctggtgcacagctgaggctcaaaattcccagcaatattgtatctctgcagaaaacttgcttgcacaagacttttattcactcaacacacatttattcaacagtgaataagagtgggacacaagt

SEQ ID NO: 16893 - DNA, 572 bp, Homo sapiens
ttactgattaaagtaattttacagtgtattctgcaagaacagtttttcttagtttgtactcagcttaaagatacacaggaatgcaaatgaaattactcactaaggcactgctccctatttggaaacaatacttctctctttcccaaactgtgtgaaacatatttcctttcaaaattagattaccactttcttttattttgagatctttaaaataattctacaagttcttgaactactcagaaatgaacttgtaataaaatcaagattgggaaatactgttttattaatttgagcattaatttcatgattgcatattacttagcctctaactagccactatggaattgaccaaaaatggcttatctccagtagttattctttctttaattaatttttaataaaaatatattagcatggtaaaaatcacataatacaaaggacaggcaatgaaaagtgtgcctgctgcgtagtccagattcccatccagaaataatcactatttgtactttcttgctgatcttttcagaaatgttccatgcctacatagcattcatgtgtactaaataaatata

SEQ ID NO: 16894 - DNA, 439 bp, Homo sapiens
ttttggattcagttactttcatgttagagtcttttctcagttattaggtgattccttgttttctgaccataattaaataaataattagctaaatatttcctcacatccaggcttggattctgtttctctgggtcagtagttactgtcatacatctgctttgcagcttttaaaagtgtactgacagaattagaaaaaaaaatcttaaaattcatatgcactcaaaaaagaggctgaatagccaaagcaaccctaagcaaaaagaccaaagctggagacattatatgacctgactttaaattatactacaaggctatagtaactaaagcagtgtggcactgttataaaaatagacacatggatcagtgaaacagaacagagaagcaagaatgaagccacatacccaactgatcttcaacaaagtcaacaaaaatgtacatt

SEQ ID NO: 16895 - DNA, 154 bp, Homo sapiens
tgcaaatctccgtggcccatataccagtcaagagtacctgacgagcccttagagcccatttttattcccaagtaagtgattggctggatgacttcccttacctactttgtccagaggctgttcacctgggagacctgctggtatatgggccacg

SEQ ID NO: 16896 - DNA, 465 bp, Homo sapiens
ctgacattttgcctcttaatgtgcatgcttgagcccactagcccaactccagagatcttgttgggaagctgctgatgatccgtttcaggtgttttctatctggagactgcctttcgctggcgctggctgtgaccagtgattcttttggagaggtagttaacaaccgcctgatcatcacctgatggtcgcctgacattctggtatatttatgaagactgtaagggtgactacagaaaggaaatgcaattgtatttctattttacatttatggccttgaaagagtagcctggattttatgaaaagactggtatttaatgcaaggaacgaactctggagtcagatacctagtgtgtccagggacaggctgcccttagtttgagcaggaagctatatgtgcagtttgaggcatcttggcagatggacagcagcccatttcgggtactgacaccgggcactgagtgctat

SEQ ID NO: 16897 - DNA, 643 bp, Homo sapiens
tcttagaggtcaccacaagttcgctggagaaacggggaaacaaagatgccagtggaaatcttccatttagttttagcctttatttgttaacattcttctgtcacaaggtcttctcacccttgccaattatagaaagccattaatttgaaacccattaaaagccaccttatgatcaagaaaggatcaagctgaattaaattttccagcccaggaatattgatataactgaaacacaagatggaaaatctggacttgaagatcccaactagcctgcgtgttctcaaagccatgtgctgagaaaagaccccaccctgttcattttaagccttgtacttgtactttcctttgaaaacattgaactttagatttatttgactgaaaaacagatcttaaattttcccctcaaagatttttaattaggatatttccaactaattccttttattttaggaatggaagtaaaagcaaatgtatactaattctgtcattgcttgtttagaagagaatgagtagatgcttatctacatcaatagaaaattaagtaacgatataaaattataaacacagctactagaaaaacacaaacgtcccaaataatcagaaagaaacacacatacgacaaagaagaccacttattgaaaga

SEQ ID NO: 16898 - DNA, 451 bp, Homo sapiens
gtctaacttcttacagaaacttggttctgtttctggtccctctagtttgttctgtttagttgtctctacattttggcacccgtaacatgttcttttatttaaggcggggcagctcctcttatattattcttcctttttacaattttcttggctagtttcacttatttacacacacacacacacacacacacacacacgcacacacacacacacacaggttcagtgacctgcgatagaaaataaaaccattctttgtcttccttcttcacatctggctctgatgggaagtaccatatcacctcctctccttgaaaaagaattgttgcttcttccatcacgatatagtgtagtggatgtaacctgtcattagcctgctaaaaaacattttgcaacttaaatgctgtctaggaggacgaggcagataaatgtaggaaaaatctcaacaacactg

SEQ ID NO: 16899 - DNA, 269 bp, Homo sapiens
tggagctgagtcttaatggacttcttctaagctccagatttctagactctctctcgtcccttttattttggtcacaaactgactaattctttcctgagctcacttctctttttttaataccttgttcaaaccagagtgccaaagccaagacatattattgtttccaaccatttcccctagacgtgtaggatcattagatacatagtctgcctcctaaattatcccaagtacagttttatcaaatgttttcccacaacttaacataaatc

SEQ ID NO: 16900 - DNA, 270 bp, Homo sapiens
atgcagcatgcttattttcaatgtaatgtaattaattaattagaaatctgattcggaatgtctcctgtgtacatcagaataaaattactaataataaatataaaaacctaccatctctctcctcaaatactgtgtcttcatagaggaattgtctgatctactctaaaataatcagcacccaaatttattcattctctttcctctttttctcctttaatgtctttgtatttctcatctaaaattatataatttatttattcttcttatcta

SEQ ID NO: 16901 - DNA, 444 bp, Homo sapiens
gaggcaccacctctctctctctgtttctgtctctctctatctctatctctatctctctatctctctcttcctctccaccatgtaagggcacagcaaaaaggcagccatcagcaagccaggaaaaggaccctcacccaacgcaaccatgctggctggcatcctaatctgggacttccagcctccagaaccctgagtaaatcttgcagctgttaaagccacccagtgtgtggtactttgctgtggcggctgacttagccaggggctgaagagggttagctgaaacacagatcgaaaggctcagagaagaagacatgctagaatggatctaatcctgctggctgaccactatggggtcagtccttcctggagaacagtctattttccaaggtgagaaagagtgcactggtgagggaatgccaacaaagctcaagatgcatgttcttt

SEQ ID NO: 16902 - DNA, 387 bp, Homo sapiens
aatgcaccttcaccctgagactgtctaaaaaccaagcttggctgatatttggaggatcctaggccaggcgagcggagcagctgagtcacaccctgtatgatgtgtctgcaaatagatctgggtcaaaatgaaatacccccttgcctggctcagagagaggcaatggactgtgtgaactcactgcttccctccatctgggcacagtggttgctgaaaagaggaagtcacagcctgggagagttgggtagcacagacaattctcgagttttgaaagctattggcctcaatgagccccgtgctccatgggaataaagggcacaagatcctccaaccccattttgcatttccatgttaaaaggtgtgtgaattcagtgcaaagagatgtag

SEQ ID NO: 16903 - DNA, 414 bp, Homo sapiens
tagtaatttaaagaaaaaaaaagaaaacatgtttggagcaagagtacacatggtatgattagggcagcaatgactagtttgctccagtttggctggagcagagatgtggcacagtaggcttgtggcaggcaagaggatcacactgtgaagagccttgaatgcatagctaattcatttggtttcgtcatgtaaaaaaggggtccagtgaccacatctttgaggacaaaactcaaccttttgctgagaatacatttatacctgtcagatcacgtgactttgctttgatgccgagaaagatttcaccatggcaatggggagcccctgaaggtttttgagaatggtgccatgtgtgattataaaattagcctccagtgtggtggctcacacctgtaatcccaacactttgggaggctg

SEQ ID NO: 16904 - DNA, 331 bp, Homo sapiens
ttcccacttttgagatgaagagactgaggttcttagagaatccaaggccactccatatgatcgaggactcaggtccctcaaagtcagtgcttctgacaacattcttttgctttttgttcttttctttcatggttgaggctttcactacatataatggataaatggtccagttagcggcacaggtttcagtctcactgaacctttaatcaggcacatcccccttttggatgtaatggaaataccagttaacttccatcaataaccatcttagtttcttcttccataggtctagctatatgaccttgaataagtaacttaacactcctgaaca

SEQ ID NO: 16905 - DNA, 549 bp, Homo sapiens
tgacaggaattgataagggcacattatgtaaaatctggagggcaagcctttcccttttaggtcaacactcacccgcaagctaaaaaggctaatcaacagaagcattttctgtgttcattccagagaatttcccaggggcacaataaatctagcctgcctgtttacaggaacattgttatttaacaagctagtttccaagcttaagagttttcggtttcatcaaatctaacccagcttgctaaatgcctgacattcattattgtctgctccggttcctctgtgtattataagataattttgcatacttaatataaagatagtttttacccacaggactaaccttaaatttattagaaaactattctaaactcttggatccctttctcttttttttcttaaccatttacctatgattccatcctgtctttaacctgcccactagtacttctagctagctagtttatctgatttacacattcagtaatttatttgttcatccatctaatgttattttgagcctctgctctgggctatataaatgtgatatta

SEQ ID NO: 16906 - DNA, 629 bp, Homo sapiens
aaaggcaaaaatctcataaatctagtttaaaacacagcaaaacctggggggtggggagaagctggcaaaatgcatataaggcattaatagataatacagaaagacctccaagaaatcaatacaaaacatttttagaagtccattttaacttctgtcaacattagcaggacatctaatttgaatacccactactgtgctcattcgagaaagttcaataaatatcttttcatgcctaacatgtactaagggctagagagatcagtataaacacaacagatgtgtaccactctctcaggtaacttacagtttggatttgattcttacgtgataaaagcattccattataggatcatctctctgtgcccacagtactaataaataattctaatccatttgtttatttatttctccatagttctattatgttttccattgttttggaaatattataattctcatgctacagggtcccacaatggggtaatgtatatttttaaggaatatttcctgtttcttaattcatcatacttttaaccaacttattgggctcacattctgtaccagtctgtaatatatgctaggactataaaggtcagtaaaggtgattcctgttctcagggaatttacag

SEQ ID NO: 16907 - DNA, 286 bp, Homo sapiens
ttctaactctgaaaaaatcactagttgtatctggctttagttaagtcatgtgcaaaacaaaggtggattatactaaaccctactcataacatcacacaaagtaaattgagttgaacagagttaacactgaatttctctcaaaatggcatagtgatgaagaaagtaaacaattagcacaagtgacgaaacattttattaccatctataattttgggaatttctttagtaattatccattctccaggctgtagcagagactgtccataatacatatcagactctgcac

SEQ ID NO: 16908 - DNA, 477 bp, Homo sapiens
atatcctaagctaaatatgtaggttattcattctattagaggaatatgaagtccatgttcttagtgaactggcacattgagacatactgcctgatgagatgggctgccaaattagtaattgtacttttcaatgagatgaagaaacatctatcttttttttctcaacttagtctgaaaaaattttatgtcattggtcactgaaataacacatattctttgtacaatacaaaaaacacataaagaggaaaacaaaagtcaactagtatcttattttctgttcacattattttagtgttttgctttttagtgcatcttcaatgcctttgtatttgtttatatgataatatggtataataatatagtatcttgagctgggtatggtggttcatactggtaatcccagcactttggaaggccaaggtgtgaggattgcttgaggccaggagttcaagaccagcctgggcaacatagcgagac

SEQ ID NO: 16909 - DNA, 632 bp, Homo sapiens
ttacaaaatgaaaggcctaggagaaagcttagcatatgacacacgaaactttgtgtactcttattctgccatgctggaatcctagtttcaagtttctcatgccatctttgctcccatgagcctcataatgtcttttgggggtattcacagatttccagtcccaaaacgcccgtctgtgtaagcacagcctgcagctgacatgtcaaataaactctctccctaagtcatgacattctcaatattgtctttcctgttgttaacacatcacttcatcaaggtgttgggatgggatggaaaacaaggggttaagccagcccaccagtgcccaggctggttcctgacagccgacgctaggtccacccttacattctgtgaagaacactgcccttgagactgtgggatgattcctccttagggaggaaagatgtcttcacctccccaaagccttcttgtccaaaggcttgccaacttccaccaggcccactaattagatgttagttcacatcgatccagggctggccataacccacagaactcctggcctagccctgcagatggctccacgcaactaacgctgtaagaatctaattccatgttttgaattacttttcacaattcttttcacttcatat

SEQ ID NO: 16910 - DNA, 606 bp, Homo sapiens
agacaataaggtatggtggagattgtggcaaagtagagaccacatgccctctactcagcactggccaattgttacctcctcttccaattttcaagtctaatgggaaagctatatttttatatgaaacctctgaattggcatttctctcagcatttttattttgtttttacatcatgtgtggataagacaaaacatgtctgcaggtaggcaatatctcctgaggcagtggaatggtccactgagttttctccttcagaaataaaacctatagctgtggcttgtctctgggctggggcaagacaaggctgaaaaagagaggctgaggcaacttctgggagttagttgataattaatgctaaaacttttataactgataaatttacctgtcaaatttcatggctttgggaatatgaaaaacacatctacaaacctcatctaaggccgggcacagtggctcacatctgtaaccccagcactttgggaggccaaggcaggcagatcacctgaggtcaggagttcgagaccagcctggccaacatggcgataccccttctctactaaaaatacaaaagttagccgggcatggtggcaggcgcctgtagtccc

SEQ ID NO: 16911 - DNA, 626 bp, Homo sapiens
atttgaactgggccaggaacaaggttctctttccagagaccacagaactccaccctaagaacatatgcagtgaaaacttcaccttcacatctttcttatttgtttaaactgttccaaccttccccctttactgatagcttttttggaagataatcttactttcttagttcaccttttatttggttttgaaattctgggcattttctagacaatagaatttcatattggtatgtgcatataaattaaaggattaaaatgatttatatgagtgtgcatttttgtaaggatatgcatatgatcagttctttttgagagtctatattgttacaaaaataagaattgttccccacctccacatgaaaacagacaattctaacagactgaatttctaaactgagtggcacttggtattttaaatttgattactattgggagaaaaaagcaatttcctatttcttaataaaaaatacttggaaaaattcttacagcattcttaaagctttgaacttagaaaaattctatataaatgaaaggcatgtatttatgtgccacttaaaattaaagttttaaaataaaaaaagagaatttacagctgaattacctaacactgattccgtcacaggaca

SEQ ID NO: 16912 - DNA, 405 bp, Homo sapiens
gagtgattacgccctggcaccaggcccactttccttcgctctcaaagataccgctattgacacatctgagccggactgggaactttgagttgtcttatggctgcaatcactgatttgtgttaatcacccctttcttcccttgattctcacttactgtcccacatgactcctctatcatagatagtaaataaaagcttgaatgcacgcatgaatgaacggaagactagactggcccaatgtgggatctaggactgtgactacatttttttatttgttgagccaaagaagtcccataaaagaaggggtcttactcccatcaatcaaagttaagactgtacctggggctttttctacggcatgagtcagcctttacagtgaggtctgctttgcatctcctcacccatc

SEQ ID NO: 16913 - DNA, 401 bp, Homo sapiens
acattctgaacttccgtttcctcatctggaaaataaagctagtactgggaaatagtcataatttttacaaggattgcattcaattaaaacatctagaacatactgcagctcttactttaataagataagaaatcctctccaggtgggtaggagtgaccgacagcaaggagtcatggactggagaaatgcctggagtccacagggcagaggagcttccaaatatttggtttaggacagagtcagacagtcatatagcctccagtcgcagacaggagctcaagtattgaacaggaaactgaggcagaaattccaattctgaacaagatggaggcgacagggcacggatttggcatgcagataccccgggctccctccgtctccatccccatccccccatccct

SEQ ID NO: 16914 - DNA, 540 bp, Homo sapiens
ttttgttccttatttattagaactctttcctttttctcaactatgaatattcctatcagtcatacatgagtactccaaatagccacattgtcttataaatagtactccaaatagcctttcattgtcttctaaaattctgtaatactttttcttagagcatataacacactgcacagaaatagcttgataagcattacataattttaatatgcagaaagcacaaagaaagtttaaaggcatgatattaccctacacaaaataatttagtgctatttaagttaaaattaatctaaaactgaaaaaggctgtttgtttttagtttctgtactattcgctaggagcacttaacacatatgaaattttattggcacatttgtctctccactggatgatacgctcttggaaaatagtgacaatgtcttgccttattaatcttagtctataaacccagcacaggtctggaagaaaatacatgctaaaatatttgtgcatacatgaatatgtactttagcaaaaataaaacaaaaattaaatacattc

SEQ ID NO: 16915 - DNA, 562 bp, Homo sapiens
cctgacctcaggtgatccactcgcctcagcctcccaaagtgctgtgattacaggcgtaagcaaccacgcctggcaccctaggggtttattttcagaaaaataatttgaaggaaaagaaattttatttattttagaatattttataatagtttttccccatactaaataaaaaattaaaggaatgtctcaaatgtttaacagtagagaaatgattaagccaattatgccatctctacatgatggaattatatagtttttaaagataagactcatgatgagaaaactcatgcaacaacatcaaataaaaaagagagtataacaaatttatatgtatatatatttggtaaaataacatcaaatcaaagtagaacacaaatttgtgtgtacataaactgtgattacaggccaggcgtggtggctcacgcctgtaatcccagcactttgggaggccgaggtgggccgatcacgtcaggagtttgagaccagtctggccagcatactgaaaccctgtctctactaaaaatacaaaaaaattagccaggcgtggtggtgggtgcctgta

SEQ ID NO: 16916 - DNA, 543 bp, Homo sapiens
acagcaggactgaatggagatgcatgccgagaaatttcacctatttggatctctccagagcctatgtggtcttatcaataatcatttaatagcaacttatattattttactatttacagagagtgtccacatatgttaacttccttgatcctcacaaacaccctatcccttgggtattttctaccagccccatgaggctcagagagatttacatgactttttgagggtttgaacccaactctttggtctcaaaaacatctcattccagtacacctcattgcctcccaagccctgtatccaggaagacctgactcaccagcatgctttctgtgcgaaaggacaccagagctgagaagtaaatcgacaccacccccaatccctgcaacttcctcttctctgtcctgtcattgagaacaccagcctaagggcacgtttttctccttccacgttctattaaagctcagtagtctaactcctactattgaaaatgagagaaacaggaaggaaagtctcaaattccaactttggaaaccacgttgaaag

SEQ ID NO: 16917 - DNA, 376 bp, Homo sapiens
acagaaggggaaatacttaaaaacatagttaaatgtttaaacatcagtttaaagaacagattaaaggaagtgatagttaaaccaaaacattatatagtccagcaaagtaatgggaaaagagaaaatatcctcccaccattctaagcacattaagagtttttcaaagaatttcgttcactttcatttcaagaaccaaatatgaatgttgccaatatctcacttcacttccttgcagcctaaccacggatagcatcaagaaagcattgcttccagctcatcattctccctcccttagatacattaagacaattttgatacatcaacaaccagagacaatgtaaaataatgtcagagttaaaaatcacaaggcttttgg

SEQ ID NO: 16918 - DNA, 435 bp, Homo sapiens
gaaactgggtgctgatgttttgagaagggaacccttgagtggtctcaggttttatttaaatttttaactgacaagtattgagctgctttcctggtatttggcacagacagttcatgtctctgagctttgtttttccgtgactctgtccctctcagagacatttgacaagcgttatcagcattttccgctttttatctaatggctttttgggtctgtctgcatgatgataacattcaaaagaatctacacatggtcaggtgtgatagttcatgcctgtaatcccagcactttggaaggccgaggcaggtggatcacttgaggtcaggagtttgagaccagcctggccaacatggcaaaacctcatctctactaaaaagacaaaaattagctaggtcagacgtggtggctcatgtctgtaatcccagcactttggga

SEQ ID NO: 16919 - DNA, 83 bp, Homo sapiens
tctagactctctctcgtcccttttattttggtcacaaactgactaattctttcctgagctcacttctctttttttaatacctt

SEQ ID NO: 16920 - DNA, 504 bp, Homo sapiens
tttacaaagctatactcatggactgagcaatatagaatccttctcatcgtatcttgttacagtctaaaaccttgtagtaaacgctgtctaatattccactcagtaataattttttctttttgagacggattctcactctgtcgcccaggctggagtgcagtggcacgatctcagctcactgcaacctccgcctctcgggttcgagcaagcaattctcctacctcagcctttggagtagctgggactacaggccacaccaacactcctggctaatttttgtatttttagtagagacagggtttcaccatgttgtccaggctggtctcaaactcctcccaaagtgctgggattacaggcgtgagccaccgtgcccggcctccactcaataagaattttcttaccaattctccaaacttttgaccatctgtaccatataagtaatgctgaaataagtgttcataggcatgttacttttcctgtatttggaatgactaactatactac

SEQ ID NO: 16921 - DNA, 503 bp, Homo sapiens
ataaagccctttccttccacaacttggtgtctgaggggttcttgtctgcggctcatcctgctacagtttctgctaatttttttgacttttatttttcttgtccatctctgatgcttgctttgctactccactttgaggattttgggcagcttcaccctcagccattccaacagtccatccatttgcctcaagctctaggcagtttctcctggttcttctgttcctggcatctaagatttgtcagcagggcctggtttccaggaaccatgcatggctatggcctcctcccacctggagggctgctcctgcacctctgactggcaatggttccagctgcggcccagctgagcacagcaggaatggcagcagcaactggagcatccatgcccagggtcacctagcccagggacaccttagctacaacccagggttgatgtccagctccatgcaccaaaagccaaggccaaccagagcatttcctggacaagatctctcggtctgca

SEQ ID NO: 16922 - DNA, 415 bp, Homo sapiens
ttttgacaaggaaacatgaaggacaggccattaaaagataagtaggaaaacataatgctgtccacagccaaataatcataataacaaggaacagggagcaaaagaatagaggggtgagaaggaaagcaccaactctatcttaagtttttaacatgctttcagtattttctaggattgcagaggaagcccagaaggacaaacaagtactgggatgttggatttgggggatggaaggccctgagaaagtcaaagacagcacattcagaaaagagcacgctttcggaagaccaagtccaaagttgaatgttgtgaccaagaaatgaattccctgaactcattcctattctttcccagactcctaggttgatctttgaagccacccagtgtatagggcctagtgggtgagccattcagc

SEQ ID NO: 16923 - DNA, 448 bp, Homo sapiens
atacctttgtattctttttaggaatataccataagcgcagatttgagatgaagtgtatcagagcttttcagtttttctctaagaaatgagcaggctatttgcaataaacataaaaaaggaagtactgtagggataaaagaggaagtgaatggaggcaggagtagttcctgagactatcaatgggtcagttcaccaagacagaaactcagaattaaagtctaatgtatttataacttacttggctagtctatttaaggaggatatactgatgctgagaactgtctatgccacaaggatttaaagcctatatatcagagcatgatttgtactgagtagcgaagtcaaggttaagatgcggcacatgttgaatgtggacaatctgtcactaaatcacacaatgtccaagatttatggtaatgttatgactctgaagggcaaaaatataacg

SEQ ID NO: 16924 - DNA, 112 bp, Homo sapiens
tagtcttttggatatacatgtgctatatttttaaggttatattttttgacttaagtaatttatgctgtaaaagacagagggattttagtcaaaggcctcttttcctagtata

SEQ ID NO: 16925 - DNA, 586 bp, Homo sapiens
gtagtgagttaggatgctgtcagcagccaggaactgaaaccccatctcgcattggcttagatcacgaagtcactggttgtccccatttcacagaaatccagagcacaggctgtgggaggagtcaaagatgccatcaaggacccaggttttcccatctctctggactattttcagcttgggccccactcttaggctagtaacaagtctcatgtggacacaatgatatttaaaggaagaaggaagaccatcctttctgtggcttttctccagaaagctccctggcagatgtcccctggcagtccattggttggaaatgggttgcatgcctctaagccaatgttgggaataagaatagaatccgtggatcacctgaggtcaggagtttgagaccagcctggccaacattgtgaaatcccgtctactaaaaatacaaaaattagccatgcatgcgtggtggtgcatgcctataatcccagctatttgggaggctgaggcaggagaatcacttgaacccaggaggtggagattgcagtgagccctgatcatgtcactacactccagcctgggtgacagagcaagacttcgt

SEQ ID NO: 16926 - DNA, 437 bp, Homo sapiens
aaaaccacagtataggtaaaattgggtttaaaataagtcaaatgctctgatttgaatactgattaggataacacacactcatcaataaacatggagccacaatgacctcaggaggacaaggagcttgtgatgtgcatcagttgtgtttggcaaatagcttttacttatgactctgaagtctgcttaaatccaggttcccaaatgttaaggacatgaagcttctacctcaactgccagcactgcatcaggcaaagcttctatttttgttaggaagtcaagcagcataataacaacatagtcagttctctagatcatctttctcgtcttcctactccaaattgctttttaggggttttaggaaaggttttccatcctggacatgcacttagggaggtaatgaatcattattcctaagccatattcttattctattgcac

SEQ ID NO: 16927 - DNA, 581 bp, Homo sapiens
ttatcagatagcttaaaataactacgattagtatgacaggctctaatggaaaaatgaaacaacatgcaagaacagatgaatatgtaagcagagagatataaacttgatgaaagcatcagaaaaatgtactagaaatcaaattcactgtaaatgaaataaagaatgccttggaggagtttaaccagtaaactggacacagcccaggaaaaaaatcagtgagcctcaagatttatcaataaaaacatcccaaactgaaatggagagaataaaagagtgagggaagaactcacagaactgcaaacatgaacttacaaatatattattcttggagaattaaacataactctaccagtaattgtcagattaagcatgcagaaaatcagtaaagacatagttgaactgaatagcaccattaataaagtaggtctcattgacatttatagaatataccaaacctaggttataaaacagacattaataaatttaaaaaaaggaaagcatacgaaatatgctcttagactacagtggaatttattgaaaattaataacaaattatagctgtagaaacccccaaaatattt

SEQ ID NO: 16928 - DNA, 216 bp, Homo sapiens
gtaaattgcacaatgcagcgcttttgactttgcactagatattagggatcagtaatgtaaaccaggaagagagaatgtttccttgagagctcccactcaccctgataatttttctagtttcaccttgagacttactcttattctgcaaatactgtgactgtatcttgagacccaaacatttaatgaggcttaaaaagaggatggtctactttgctg

SEQ ID NO: 16929 - DNA, 426 bp, Homo sapiens
attgtaactcaaaaaggtagattgctgaggccaaggaaatgaaaggatgcaaagagaaatggcaagagaaatagatgtatgcttcaggaatgaaagaaaacaagaattgtaaccagtcttcaaaggcagaacaagtacttacaagacagatcaaggggataaaacttagctctatagaatctctatgttataatctatattatcttaactcttaaaaaggctgggtgtggtggctcacacctgtaatcccagcactttgggaggccgaggcaggctgatcacttgaggtagggagtttgagaccagcctggccaacagggggaaaccctgtctctaccaaaaaatacaaaatttaactgggtgtggtggtgcatgcctgtaatcccagctactctggaggctgaggcatgaggatcacttgaaccc

SEQ ID NO: 16930 - DNA, 579 bp, Homo sapiens
tattgctcagtgtcatacaaggataaaatgaccatggtgcaaagggaaattgaaaagttgtatgcagaagacacaaacaaaaagatcatggagaatcaactgatggggcagggtaggggaggagtccataggccatatttcctaaaaagacaacctatgaacaaaaattttacagtaaaatttaaagacttgttatgttcttagaacttacaatgaatattttgtttcacataattccaaccaaatccccatttcaccagtgagaaattagaaacttagaaaatgggtttgctagccaggcatggtggctcatgcctgtaatcccagcacttcgggacgctgaggcggacagatcacctaaagtcaggagtttgagaccagcctggccaacatggcgaaaccccatctctactaaaaatacaaaaaaaatagctaggcgtggtggtggtcgcctgtaatcccagctactcgggaggctgaggcaagagtatcgcttgaacctgggagttggaggttgcagtgagccgagattgcagcattgcactccagcctgggtgacagaacaggacactgtctcac

SEQ ID NO: 16931 - DNA, 413 bp, Homo sapiens
cctgggattttgccggatgtcattcaatggctttcaaggatgatgcacagctaggccataggagagtaagctcaaattcccaccctgtcacccatacacagaaactcattctggtttttctgccatgtctaggccatacaatgaaagtcgctgaagaagaatatgaattttgcctgcggatttgctaacactcgacaatcctaggaggtaaaaggcaaaagaggggctgggtgtggtggctcacgcctgtaatcccagcactttgggaggctgaggcaggtggatcacctgaggtcgggagttcgagaccagcctgaccaacacggaggaaccccgtctctactaaaaattagccgggtgtggtggcacatgcctgtaatcccagctactcgggaggctgaggcaggagaatc

SEQ ID NO: 16932 - DNA, 540 bp, Homo sapiens
aaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagtagctattagtactttaaggaaaggtggtttttatccacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattcttt

SEQ ID NO: 16933 - DNA, 215 bp, Homo sapiens
ttgtaagttggtttcaggctctgttgaataaaagtgtttgaatctttttttctctattaatatttcttggtagtacatatggtcaaatgtttattaaagaggaaaaaactggtaggctttaaaatgctgttaaaagttttggaaacttccttgacagaaatttcatttttggtgttgttgaaggttaacttaaaaattatgtgtgtgtgtgtgtg

SEQ ID NO: 16934 - DNA, 545 bp, Homo sapiens
aggcagggtttcaccatgtgggccaggtgggtctcaaactcctgacctcaggtgatccacctgcctcggcctcccaaagtgctacgattacaggtgtgagacacggcacctggctaataaatttctatcatctataaattacccatgtctaaggtattttgttaccacagcccaaacagacagcatttcatatcagcacatacagaactttctcatttttttctttcactgtgtttagggttgcccgataaaatacaagatgcctacttaaatttgaattatttgcatttccaatacagaaaaagaactttttagtgtaagtttgtcccatgcaatatttgggacatacttatgctagaaagttatttatttatctgaaattcaagccagctgttccgtatttgtatttgttaaatctgaccacccttgttaccttatatgggagctccttattttaaatcactgggggcttcaggaaccaggtgcctggacttggtgggtgtccattctctgactgtattctgaattaggctctagaggctcca

SEQ ID NO: 16935 - DNA, 280 bp, Homo sapiens
agggttcatagggctggtgtgagctaagtgagagtcggttgcagcagatggtgctgaccagatatgtgacatcggccacgggccaagtaagtggcagcaacccaccaggcagccctaggcacacaagctcacagagaaccagagtgtgctgccttcccctcacccagtttctctatgaaatcaaaaggcaccttggtaccaattaattgcctaactagactccacaagaatataaaaccgagcacctttagtactgccacagtggccttcctcccactta

SEQ ID NO: 16936 - DNA, 493 bp, Homo sapiens
tttacttgataaacatcttaacatgttaaagatgcttccaaatgaaacaacaggcaagattttacaagtcaacataaaaggaaaatatagaaaggctgataatactggcatcacataagatttaagaaattagcaaatgaaaattatagtactttggttaaaatataccaacagcaatactatattgagtggagaatattaacaaattattactacaatgccatattgaggaaacaaaaaataaggatataaacaatttgaacacaattcatgattaatacctacgccacaaaattacatgttaccatgctgttccctaaaaacagggaataaatctttacaagattccataaactacttacaaacactgacgaaacaacaggaattccaaagctcaatagtttctaaaaatcaaatgttgttacaatgcagtgtaattggaaattaaatataattttaaaatcaaatttttcttaaagacaactttttaaaa

SEQ ID NO: 16937 - DNA, 497 bp, Homo sapiens
tctgtatatcaaacctacttgacttggtcagcccagagatgtttcttcactcccccatgaagccaccaatagccttgaggatattggagagcttctgaaagttgtcttcaaaattcgatgtgcgtatgagttctttgtagagaggatccattgtttcatttgattatccaggtggctcatgacccaaattaaatccaagataaaagttcctctctttggtagaattgaattttctatatcaggatgtttattagtttgctagagctgtttaaacaaaatactacaggctgggcacggtggctcataactgtaatcccagcactttgggaggccaaggtgggcagatcacttgagctcaggagttcaagaccagcttggccaacatggcaaaaccttgtctctaccataaacacaaaaattagtcagatgtagtggtaggcacctgtaatctcaactacttgtgaggctgaggcacaagaatcactggaacctgggag

SEQ ID NO: 16938 - DNA, 291 bp, Homo sapiens
tctttttttttaaaaaatgattacccagttgttgggtatgtctttattagcagcatgattttattctctaaataaaaatatttagaaaagatacatttacttgatacattttattttcaatatgttggaagcatgcctcctttatgttttgctcatcattgactggatagttttgtactatatatcacacttttttcagcttctatatctgatactcaggcaatgcatgtgcaagagctctctacatcttgatgaggtaatactttctatcattaatatattaactagtat

SEQ ID NO: 16939 - DNA, 439 bp, Homo sapiens
tctaacctccaccttccagtgattctcctgcctcagcctcccaagtagctgggattacaggcatgcaccaccacgcccggctagtttttttggatttttagtagatacgaggtttaccatgttggccaggctggtctcaaactcctgacctcaggtgatcctcctgcctcaacctctcaaagtgctggaattacaggcgtgagccactgtgcccggcctaaagtaccatttcacaggtgaggaatacagacacattgacatgatattggtaaaggtgatgaagtccactatgctgctagccagattgaactaactggtaggacatctactggtgaaatgtgacttaaggaattatccttaaagtataaatctaatgaggccaagtgccatggctaaccctgtaatcccagcacttcagaaggccgagtcaggcagattg

SEQ ID NO: 16940 - DNA, 578 bp, Homo sapiens
ttggagttgacacagcagaaaagaaaaaaagaatgttcccagaagaatttataagaaaaacacatcttatactcaagtctcaaagtaatagagaagaggagaaatgtcaccagcagaattgacttttcatgatgtccttccaagagtcttatgttctcagaccacaggaaattcatatctgcagatctaacagtaacatgaaagagaagaacaacagcctcactcactctctcctgcaaaagtgcaaagatttctgtttgacacataataaacagtaaatcccaaatgttgaggttgagggtgtcactgggggaaaactactgctctaaaaattaataataataataatagtaatattggccatttttcattaaccatggcctgagtctcagccttaagtattcagaaactcatttattcattcattcattcaacatgtattgagagctgactgtgtaccagacactgtctgaggtgctaaggaaataaaaatagggcaggtgagttaacaatctctgctaccatggagtttatattctagtgggatagaaagccagcaatagttgaacaaagaaatg

SEQ ID NO: 16941 - DNA, 398 bp, Homo sapiens
atcttgactctctgcaacctctgcctcccaggttcaagcgattctcctgcctcagcctcccaagtagctggaattacaggcgtgagccactgcactcggctaattttgtgtttttagtagaaatgggtttctccatgttggtcaagctggtctcgatcaccacctcaggtgatccacccgcctcagcctcccaaagtgcttgggattacaggcatgagccaccgtgcccggcccattctgaatctgtctaccctagcaaaacgatcctttattttactttcttgccccattcgtacactggcatgactgcactcatagggttcttcacattttatatcctatttaacatcttataataagtataaaataggattttgtcctaaagaatgtggtttaag

SEQ ID NO: 16942 - DNA, 550 bp, Homo sapiens
aaggagggctgaaaaggtgggcacatagcctgggagtaatgaaaggggacagatctgggaagtcagggtcaaaggacaaccgagagggaggaaggagaggcctggcattctttgactcctacgttcccccaccccctaccgtcctcctaccgagtcactcaggagtcgcttgctggcatctccaactgccctcagggcattatccacatcgcgctggccaggtaggcagctgacacagcggttcagagcctgggtcactgctttagccacctggggtgagaaaggagacagggttgcccaagtgaaaagaatttgagagatcgcctccattcacgcgacatgggagatgactagctctactgcctctgaaagtgaaaaaagaaagggggcgttgtaggtgaacaggctgaggttagggtttcaagtgacagtaattaaacttccccaaacttggtgtttagctcagcccatgactgaatccaactgagacacttctacaagaccaagagggccgggcacagtggctcacgcctgtaatcccagcactatg

SEQ ID NO: 16943 - DNA, 507 bp, Homo sapiens
aattcacacacacccaagcagacacacactacaaaatatacatgcacatatgtaatagaaaaccctgtcttacatattattaattcccccaatttgtgaaaagacagttttttaattgtgaataattcagagttgttcttatggacaagtccatgaaaattgcttctactttttgttaactttcatcagcttttcatttctgctcttaattttctatggtcttaaaaaatacataaataaaccacttcaaattgtttccaaacaggctgggagaggtggctcacaccagtaatcccagtactttggaaggccaagacaggtggatcatctgaggtcaggagatcaagaccagcctggccaacatagtgaaaccctgtctctaccaaaaatacacaaattagccgggtgtggtggtgtgtgcctgtaatcccagctactcaggaggctgaggcagaaataaattgtatcagaacagtgtaaacatgtagacagatactgacaggaata

SEQ ID NO: 16944 - DNA, 549 bp, Homo sapiens
gctcgttttggatattgccttgactccacattgacctcaatcactcttacccttcacattgtgtttgctctttttgcctcccacgctttagtcacttctttctcactttcatttcttctttctagtcttcctttatccactcctaacactaatctcgtagctgtagacttatctttttcattgtcctcattttttaagcataggtgaaataccggaattgatatagatttaatttaattttatctcctatgttatgcattattgagaccagaaagtagataaatcaaattggtcatacccaatcctttcctacaagatagtaaatgttttgaagtcacagactattgccatctggaatagtccttcttttgtaacccagtataatctccacaaaaatgttatttttaaaaaatccctccactctataacattctgatgacctgtaagctttcaagaagtcttcagtgaaaacctgtctctactaaaaatacaaaaaattagccgggtgcgggtgtcgggcgcctgtaatcccagctactcaggaggctg

SEQ ID NO: 16945 - DNA, 210 bp, Homo sapiens
acctaaatagacacaaattacataactgtcaagagactgtagacactgtccatcaacaagttcaaaattgaaaagaaaaattgaacactggtagtttatagaagcataccaagagaatgatattctaaatcagtaagtcaacattaggcaatcctgaacatttgatttactgtagaacttcttcagattaataactatgagcaagtgacc

SEQ ID NO: 16946 - DNA, 529 bp, Homo sapiens
tccttaggctcaaggaagcgattcatgtacgacagaggttgggcagatccctgggagccgccatattttggaggccaggttggctcttgaccacatgagaaaaggggacttggactggaagagccccttgctgtagctgggtctgaggtccgtctgcctgtggctgctcccctcagctctcctacatcatggccagtgccacagatggccaggacttccatcaccagcagtgtgcatggagtgcagtggggcaataggtcccagcaaggtggggcaatgctggaaaaacatgcctccccgagtgccacggagaatcatgccctgcaccttcgtcagactctgcaccagtggacggagactcatgccctgcaccttcgtcagactctgcaccagtggacggagaatcatgccctgcaccttcgtcagactctgcaccagtggagaggctctttgggtaaatgtaaataaatgaagtgtgagatcattcaccaccaaactccgggctttttgtaagaaaatagcgcaattg

SEQ ID NO: 16947 - DNA, 359 bp, Homo sapiens
gccagtgtatttgggttggtttagggagccctgtgatatctttcctctgttgatttcagacattatgtttttccataataacttcttaatacagttcttcagcactaggattgttttaatatactttaataaataagaatttcctaaaataacaggcatacttctctatgcaactaacttccctggaggaatgtcaaattaaagttaattaactccaaaataaatgtaaaatttggtagttgtattaaaaaaatgccagtaataaatctaggtcttcttctaggaatattctacatgtttctctatgttttatcagcataaaatatttttatgaaaaatatcaaaaaaatttaaaaatc

SEQ ID NO: 16948 - DNA, 589 bp, Homo sapiens
atctaagatgctatggctcaatattattttaaaactggactcgctactagagggtgtcctgccctggaggccattagcaactgactttctccacccatgaggcttcactgtcattccaccacattcacatgggtgggtgccagcagcatcatgaccccagccacccagaacctaagcgagatggaaccactaaccttggtttttaaacccatgtggcacatcagaaaacctataaaatatagcttaaaatttccaaagtactgggagagatatgggcatccagatttaggaaactcaaaagtcttcaattagatttaacccaagaagatcctctctgaggcccaatataatcagactgtcaaaagtcaaagacgaagataaaattccaaaagatgtaagagaaaagtaacaagtcccatataaaataattcccattatattattagtagatttttcagcaaaaaccttgcaagtcaagagagaatgggataatatattgaaaatgctgaaagaaaaaaaaactggcatccaagaatactatctccaacaaatttatctttcagaaatgaaggataaacaaatacttttg

SEQ ID NO: 16949 - DNA, 572 bp, Homo sapiens
ctggccaagagttaaattctagaagagaggtgaagtctggagtatctggtttgacatgtgtttttaaattccgtggctgacgctacaaccaaaggttctgctcatgtgaagcacaaaggggagatgaaatgtagacccagaaggatgacagcagcttcattgtgccccattgcaggatgccaggcaaacccagctgccctggaataacggcaccctgagggaggctctctgcacccctccacccacccttgtttcatcctgggttggagggagcatggctgcagcccctatccctgtatcaaccctggaaaataacagagccaacctctgatccttcttggacagcagaaaagctcaagaaccttcccctctcacatctgaaactccaaagttcatcacagatttcaatgtgaattgggaatctttcaaggcaggtattatcattctagccttaaaactagtcgttagcttactcaagaaatggttattaagcacctaccatgcgttgggtatggcttcatgcactaagaatacagcagtgagccaaaaagacaaaaatcacaggtctcatg

SEQ ID NO: 16950 - DNA, 478 bp, Homo sapiens
gaccagtcctgggtagatgggacataggaacatagaggaggtgacacctgaacaatataaatagattagttggaattagccaagaaagatgtgggacggcggttacaagcagaaggaacaacaagaacagaggggatggaggcaaacgactatctggttgtggggtggaggtcctgtatgtaggttggtattgttggaacacagattgggactatcttgaggtgatgtgttaggagttgggacttttattctgaagacgttaataagtctgaagagttttaaccagtttagtaaaaaggtcagattggtgtttggaagctgggctagagtctgggaaagaattctggaaaaatggccaggtgtggtgtctcatgcctgtaatcccagcactttgggaggccgaggagggtggatcacgaggtcaggagttagagaccagcctgaccaacatggtgaaaccctatctctactaaaaata

SEQ ID NO: 16951 - DNA, 242 bp, Homo sapiens
ataggcctgagccaccacacacaggaaccaagtgctagggagggattagaatccagatttgtctgcttctaggcctaagaactcaagtgctatatgtactacctccttaatcctaatgccaaatgaccccgtcagggtatttaatatgaatgcattacaattttaagaaattctcacgttctaaatcattcatttgcggtgaaaaaatcttgtttgggcttgtgtgtggtggctcaggccta

SEQ ID NO: 16952 - DNA, 572 bp, Homo sapiens
tttattaaaatacataaaagaagaggaaaaaatctagagaaaggaagggctgggtgatagctcctgttcattagtgaaaagaatcaatattataaaatgaaaatccccctaaaccagtctataaagttaatataatttttatcaagaatagaattataataaaataatttttcatggaagttatatatgcaaaagcaaagacacaaaataatttttaaaaagaacaatatggggaggggattttctgcctggatatcaagatatcataaaattgtagtcatgaagacactgtgatatggactcagaaataaatcaactgactgaaataggatgctcagatttaatcctatatataatacataaatatataaaatgtataaatatataaaatataaaaacacatatataaatatatataataagttatttgtatttatatattacataggattaaatctgagcattctactttgggtcattgatccatttgtttatatataatatattacatatatatgaacttaatctatgatagtagattagatacctactagatagagattagatatcta

SEQ ID NO: 16953 - DNA, 445 bp, Homo sapiens
  misc_feature 234: n = A,T,C or G
gcatgctatctcttacctcaggcctttgcaagcactgcctaccttctctactgacttttcttccctcccttacccatgtagcagactcctactcattttcatgattcaattcaaacactgtttcccagaaatcttccctgctccacccacgggtgctccaaatgtgggatgagcagacctcctctctgttgcaaagacgcactgcataatctgtcttgctgatcctcagctcangaggctggagtgggctggagagacatgcatcatgtgtttcccaaccccattctggagcacagggagcatatttcttcctttctctcttttatctccccaccaatctttatcatccaccagaatcacagccatcatgagcaactgtcactgataggagtgcattttcagatgagttagagctggaataaggagacctatagttgactgaaat

SEQ ID NO: 16954 - DNA, 440 bp, Homo sapiens
tacggctgagtatctgcctggcactctttgcagaaggcagccacactctccactaccccaccaagaccactcgcctgcccaccattggattggaagtgtagggcttggttcagccaggaaggttctctcagtcccaggtgtctgaaaggagaggtaaccaggagtaacttaactaaccaaattgctagagattagtcatgcttgatctaaggcttcatgaaaaaacatcccacagggagactctggtggggtttaagcagcacaagaatgcttctatttccacataaaatttcgacaatatgtctgtttcaaatcaaaccctggttgggggtgaggaaatctgcagacagaaatagccaatctctttgcctcagcaccaagaaatggcaatgaccatccttttctttattctctgtgcagaacttttctggaatattctg

SEQ ID NO: 16955 - DNA, 508 bp, Homo sapiens
gagtacaagggtcacagatggacccactgggataacttccggggaaaccctgatggttcctctcccactggcctctggctggtcccttggtccctccttcccagggtaatcaggcaagcacagcaataaggtcctcccttgtttcacagggttgtgggaccagttctccctcccggggcctcgggccagcctgcttgtcaccccgagaacccacagtgttgagcaattcacacacatcctcttctctcctgggcttcatggcagccctgagtagctgccttatcctggcctcaatgctgcctgtcctgacggccatgactgaccaccagtaatgacaccgacattgaggagtgagagtgcctgctgggaaagctgcaggcccaagctgatcaagcggggagaagccccacccagggtgccagaggtggagctggcttggggtcactggggccagggcaataggcttctcctttccccaccaccctcaccctggtggatactcaacatc

SEQ ID NO: 16956 - DNA, 369 bp, Homo sapiens
ggacccaaagacaaataagttatggaccaaacctcgaagactctaagtgggtaagaagatacacttaaataattattctgtatgactgatcactcctcattatcttcatagcatttattcaaatagtaattataaattagtttgcttacatgtttactttctgccttctttactaggccatttgttcattgtggggaaggaccatggctattttgtgactgtgagctcagcgctagtacagaagcccatcatatgttagagacccaataaatgttttctaagtgagaatgtatgcatatataaaatttatagaaagcaatagttttcacgttatacaaacaacaacgtgtagaagatgtaatggaaaag

SEQ ID NO: 16957 - DNA, 392 bp, Homo sapiens
aaaccctactcataacatcacacaaagtaaattgagttgaacagagttaacactgaatttctctcaaaatggcatagtgatgaagaaagtaaacaattagcacaagtgacgaaacattttattaccatctataattttgggaatttctttagtaattatccattctccaggctgtagcagagactgtccataatacatatcagactctgcacttgtgcttgaaaatgcagagctactggaaggtgtcaactcttcaagtttgaagaaatctaggccagttactgtgccaccaaagaatctgcagccaccgagacaaccacatttgtttctacacctcttattcttcaggatatcatctggccataaaaaccacaacctaaaccgaccccaaa

SEQ ID NO: 16958 - DNA, 485 bp, Homo sapiens
aataataacaaatattggtgaggatgtggagaaatggaaacgtttgtacactcttagtgggaaggtacaatggggcagctattaaggaaacagtatggaggtttgtcaaaaaataaatacagaactatattttttaaaaaaattaatatcccatgttctaaaggatttatctaaaagtgaaaagtttattattatttggaatcttgggtattttgaaaataagactactcatttcacttcagcaaaagtataaataaataggtagactttcatgttttagtcatgcaaaatcctgtgtcgtgaaggaagagtacaaatgttttccaggtcagtttataaaacagccatcttacctggtagctattgccaaatattatacaagaaagtaaatctccaaatcttaaatctttccttttaacacgcccaattgagtttttactacactcagtgtaatttagtaaaaaacattttttatttattacgtg

SEQ ID NO: 16959 - DNA, 358 bp, Homo sapiens
ggacattggttttattctgccttggaactttaactgaaacattagcccttccctggtgtccagcctgttggcctttggactggaaagataccagtggttctcttggttctccagcctacaggtcttgggacttatcagcctctgtaatcacatgagcaaattctttctaataaatttctttatatgtatacacacacacatacacacacacacacacacacacacacacacacacacacactctattggttctgcttctctggagagccacactaatacagtaacatgcgagtctaagcactaaaagacttacaacatttttgtttatgtatttggaaggctccttttttttaatccc

SEQ ID NO: 16960 - DNA, 434 bp, Homo sapiens
tctcccattcatgtcctacgtacctgtgttgtcttaaacattgttgagggtaaacagttgttttcaacatcttcagtatggcgaatttttaaaaatattttttaattagttttctctgatgggtttttttatttttattttcaagacagtatgtgttgggaaaatttctggcctcaaaatataattccttgcacctctcatgaataaatattatgacagaaggatctctctctttcagcaatgaccatgtgtagccttaaaaatgctcagtagtaagactctaggctggtgtttctctatctgaaactgtaggttcatgggcatattttcagatctgtgtggtgtattaatagactgtgtgacctgggagctattgtacacatcaactttaacatattttagaaagagtcgatggatatttgtgtgccattttc

SEQ ID NO: 16961 - DNA, 452 bp, Homo sapiens
aatttattataaacctgcttataagtatttacaataaagtaggaatatgtcatactatatttcctctttaaatttatgaaaatataaggctctatttcttaatgcctcacaaatattttctattttttttctcattcttcaggttcagcttaagttggggcttaaaaagaccaatatgcatattttctagcaaattgactaaactgaaatggttcttccaagaggatttggggacatttattaattcttatttcaaaatgttaaatgtttggcccactatcttaagctattaattccaaacagcacaataaactgaagacactaaacgttaaaaagggaaacatatcagttatatattttcctaagtattggttatattatagatgattgaaagttttagttaaattagcctgtaaacaccttcaacttgatagtcacccttatcatttaaa

SEQ ID NO: 16962 - DNA, 396 bp, Homo sapiens
agaagatagattttttttaaagatttatgaactgcgagtttggaaaagcacatttaattctagcatgtgaaattgttcgatttattttcccaggatctttgtcagttggttaatgctgatgctccttattggctagtgggcatgacagaaatgactcggacgtttggcctcgaattacttgagtcagtcctcaatgattttccgcaggtctttttacaagtaagccatttatagtatcttgtgacaaagttaatctgaattgttttacagatatttttaaagaaagcaacgtgtattttttttccaccttaaaagtggcaaagaggccagagttggtggttcatgcctgtaattgcaacactttgggaggctgaggtgggaggattgcttgagccc

SEQ ID NO: 16963 - DNA, 266 bp, Homo sapiens
atctgttataaatgaaggcatgcatttgcccagatcccttctgtgtttacacaacacctctgcatgccagggtctgtggcacagcctgctccggttgcatgatggtcttgctggtatattttgggcagggaagtcctttccagcacaacaactgagcaactttagttgtgtgaaaacagatgaacaggccgggcacggtggctcacgcctgtaatcccagcactttgggaggccgaggcaggcggatctcaaggtcaggagatcga

SEQ ID NO: 16964 - DNA, 340 bp, Homo sapiens
aggctgagggaggagaattgcttgaacccaggaggcggaggctgtggtgagtcaaactcctgccattgcactctggcctgggcaacaagagcaaaactctgtctaaaaaaataagataaaataaaataaggatggcgggtagatataaaggagcacgtggatattcagtggacacaaaaggcttgtcataccatggtagaagagtgtgatccaaacctttccctcatactctgaattctgtagccatgtcccacttctgtcacctcctgtatgatctatgcttacacacatgattttgatgagagcacattgaagtgcccccaaccactcacacttaaca

SEQ ID NO: 16965 - DNA, 453 bp, Homo sapiens
gttgacccagtctcataacattctggttaaagtgttttacaggaggtcaaaatacagaatttaaatagtaaatcagtcaagaatgggaaaatacctagccttgataacaattcatgccatgaaaactaaggattcattacatgctttttaaactagaaaaaaattaaaatgataagacagtattggaggggtactatttgtatttagctgatagtattacatgccattcactatttcaaaagagcaattcaggaaaatgttataaacaccaagtatcacttatattcttatgacctaataagattattgtcaatatatttaatgcctagtaattctacaaatacgataatgcctaaattaacatgatagaacactatctaactagtgaacatggtaaaataacatacaactatgaaaatagcaagaatgtagaacatggcaatacataaaaat

SEQ ID NO: 16966 - DNA, 556 bp, Homo sapiens
ttattaagtggatgtggatcatcataaatgtagtcattcttattatcttcattttgagtaggctgaaaaggaggagaaagagaaggggtttgtctaggggtggcagaggtgggaggaaatccccttataagtggacccatgcagttcaaacctgtgttgctcaagattcaactgtatgtgaatactgctgtatgtgcaatttggtgtggatatgcagaataattttgtctatgccttagaattcctaattcccagggaagtcattggtaaatgcagctggacataaaataatgcctctaaatctacttaactgttttatttaccaattcagatactgtgaatggccttattcccttatggttgaacctctacaacatcagagaagtttctattggtggatacataccttgagtttctttttgtatctagcacatcttgtcatctcatttgataatatggtccagtcatgaaaagtttggttgagttcataataaatcccatagttctttatacttgatatttagcccgtaaaattccattaaataatttttagtca

SEQ ID NO: 16967 - DNA, 509 bp, Homo sapiens
gttacttatttgctttacataaaacaatgtacataatgtatatctgaatttacttttattttaatgataaaatattgttaaaactttgtcactgttattttatatttctatggcatatggtctcatacatgtgcttatttgtccaaatacttgcataataatgaaagatgaacaattatttttgttctggaccaggagtcaacaacacacaagttacatcccacaggttatatccagccagcagcttgctttaaatctggcctaagaactaagaatggttttacatctttaaaccactgtaaaaacaatgaaagaaaacaaaattgaagaagaatatatgatagaattgtatgagttgaaaaacctgaaatatttgctacctgacccttcacaggaaaaaaaatgccagtttctacaataagtaattacaaatccatcacatctgaagctaaattatgttccaaaagtttacaaaaatctatttttatacgtactttgttattatcatt

SEQ ID NO: 16968 - DNA, 378 bp, Homo sapiens
ggcttcccccagagcaagcaatccaagaacaaagtgaaagcttcaatgctttttataacttaccacaaaagtcacacaccagcacatctgcaggagtctgttggtcacaatagattcagtatagcttcttgattcagagtcaaaagggattgcacaaggacaggagacaagactcactggggtcatcttggagactgactaccacacccccatcatcgctataagtatacaatgatgcataataataacaaaggtagtaggtcagacagattatggactctcctacccatggcttttgagaaagatgccaaccaagaaccaacatctaaaacaattcagtgattcagctaaggagaacatgcactttggagacaaatg

SEQ ID NO: 16969 - DNA, 436 bp, Homo sapiens
tatacatatacatcctattcattctgcttctttggagaaattgactaatatgttaatatattataagtacttggccaaacacttcataattatttaattattaaaattggcagtaaggtgtgtaatattttccaaatttatagatgagaaatctgaaatgtagggtttaagtaatttgtcccaagccacataattgatttttaactcatactcaatatgatatttatctttagcttgtacttgttaagtgacaaactctcttctgaatatggctcccctcaatatgcagtgattaagtctgtttcccaattagtgaacattttcaaatcctaaagcaattgatggcgtactgtttatagacaagaagtaagttaaacacacacacacacacacacacacacacacacccgaacccactagggctggtgaatgtgtc

SEQ ID NO: 16970 - DNA, 421 bp, Homo sapiens
tgtacatctgtggacaaaaagaaacaatgaatgagccaaatacatacttggaaattcacaaaaatgttagttttatatagacataatctgataagtcgaataagctcagtgtttacaatagtcttgtttcttttacttgtcaaaggctctgctatctgaaaatattcaaaccatgagtttcatgggccctgcctgtgagaaaatgtgcattttccacataaatccatttccttgtcagataatttacaactcaccctgtttaaacagactctgtatttaaagctagaagatttatcacacagcaagttcaacctcaagaattccatataagtccacaagcacatgtgtctaaaaactgttgagtaagtaaattcaatgatgaaaactgtaatttatatcaaggatgagaaatactctcttt

SEQ ID NO: 16971 - DNA, 507 bp, Homo sapiens
acctgtgaggcttgcgaaatttagttaacttacctaagatcaccaagcctgaaagtggtggagatgccaatacaggcaggttgatgcagagtccatgggattagcacaacatcctgtctccacccttctgctgtttacggtgctgtgaggaagcctctaatctatccaaagagaagtcactgaaacacttggcagaatggtgggtcccctgtgggataaataaagtatcttgaggacaaccaaagtacttcacagattcctgttaaatgattactttcccttaataaaagggatgggaaacaggttccataccttatgcttctctgttaggacagaacgagtcaggactttcagatctgcagatctggatgcccatccccattgcttcacttagaatctccatgattgaatcagtcaaactctcctcaactgtaacataaaagtgtctagctcttatgtatgagtggtatcttgctgcataacaaaacttagtttttaaagcaatta

SEQ ID NO: 16972 - DNA, 499 bp, Homo sapiens
ctattgaatgataaatggaacacttcactaagaagatataatcattctagtttcctttaccttgtaatagcttctaatacataaagaaaagtaacagatacaaagaaacattgaaacctctataatcacagtagtataatttatcattcttttgttgataactgataggtgtaatagacccaaaaaatggtgtatctagaggagacttcaacaaaacatttatcagacttgatttaatggacatgcctcaagcattgtactcaacaattgaaaaaatgcacaatcttttcaggcatacatagaatatttataaaattgattatatacttggccaaagaattgataaaatacaaagcacattctaccaaacaatctaataaatcaaaaattaaaaatgtcatttatttggaatttaaaaattcacttgtaagtaacttagaagcaccacagcaataagaaagatcatggtagaaattagaaaacacttagaatagaatga

SEQ ID NO: 16973 - DNA, 588 bp, Homo sapiens
ggatcaataatgactttgtttatagtttctgtatatttgactcttgttcctaaacttgcttacttaatcctcataatttcatcccacaagttcattgaacaactctgtttaaagcatttgcccactgctgggaacactgcctggaagatctggaaacatgggaagtcagatctcagaacagggtatagttacacggagtgggttgaaagggagcaacaaccagagtatgggtcaccagaaacaagatgagggtgccagatacatgctgtacctactccatacattctcattctagctatctgtagccctttcctaaatgagaatacccaaaagaacttgtttgggctattatatgcaaggtggctgaggggacttggcaaatatgaaattataaatgttaataaacagtgtggtaactgatgaattttatagctcactcgactggcatagaatacacacctttcagataaagagaatcatctgaacatttgcaagcctaggggaattagaaatggcacaaaaagagacagcagggtttggggctgtgccaccccctgccgtatctcatattctgtgtattgatttgga

SEQ ID NO: 16974 - DNA, 331 bp, Homo sapiens
aataatggcctgttaaagacccagatgtgtgcactgtctcaggttggctctttaagttcctggactaagaatctccataaagccatacaaactttaaatgagtcacccactagcacacatggcatcactccttataaatggttggcaaggcctgtaagacatgtcccacaaactctcggggttacctcaaagacactgagccatgctcctgaggcagatggtgagacatgctcctgagaacaccagtggatctgccaagcagtgatggctacagggacctgaagctgagctggaatatgcctccatactggattagttttatagtactgga

SEQ ID NO: 16975 - DNA, 470 bp, Homo sapiens
tgaggattgcaagtaagtgttaatagggcagacctccaaaatgagccagatacaaaggtatttggcagaggaaaaataattcactaacttgaaatagcagataagcaaccaatggagttagaatcaaatgccattatttgagaaaggcgttcagtaaaattccttcatacaaattaacaaatatttatgcagaaactcctatgtgaaaaacattgtgccaggctcagttatgggagtggggtggggaggggaacatgaagataaataagacaatttcttttctcaaggaaatgaccacataattggagatattggccaataaactataatgcaacacaaagaagttagttaagatagattaagaagagggagaaacatcatctgcatgaaaagtagggtggctatcagtgagaatggagagagaagatattcagatattcaagatattcaaatatatgaggcaaaataca

SEQ ID NO: 16976 - DNA, 456 bp, Homo sapiens
atcaattaacattttaattggaattttgaattattaggcttttcatttaagtcatctacaaattgattgacaattgaactttatcatttgcttagttcactgctaaatcaaactgtttaatacttttttctaatagtaaaaacatactgaagattgagaagcactggtttagaaaaaatatgtaaatatataaaatgtaatagcctggaaatcaatcagaaaattggaactgattccatttgtaagaacagaaacataaaataagttttaaacttataaaacttttattttaaaattactacaaacctcaatgtaggttataaaagaagacttcaataaatggaaaaacacaccatacttcctgggatgaaaagactcaatgcggtgccttgcaggcatttgtatacatagaggaaactgttttcaaagctgagctgcacttttggtcccctcaag

SEQ ID NO: 16977 - DNA, 514 bp, Homo sapiens
tgcttcgtgaggcccatatgtgggagctgggagcgctagactagaacccctctcagcctggacccccgggacctgcccttcacctctcagagcctcagtttcctcacctgtcaagcaggggtggcagtcatacccacagcagctgacaccagaccacgggtgggtcactcaccttgtgctggggacagggcttttaggctgctcggctctgctgcaggaataggatcctcaaagcagaggcggtttccccattttacagatgggcagagtgaggcttcaggaagcgtagttatctgcttggagtcttaggcagctgctcaggatgctacggcaaaatcccacagcccgggaagcttgtaaacccaggggcttctttcttgtagctccagagcctggaagcccagtgccagcgtggtcaggttccagtggcttctccttgtaccattacacagcagagatgtacccttacatccacagagagtagagagaagcagtcccttttggtactcttaaa

SEQ ID NO: 16978 - DNA, 485 bp, Homo sapiens
aagaaaccacaaagacatatcaagccaagatcaaagtcagatgcaatcatttttctcattacatacctggggacctttacttcccacacctcctttttctcctttcacaccagcctctcctcttgggccctaagtacatagaattaaagcattattttttgcctaaaagagaacattgaatattaaattgaatattacaagtagaaatactaagtcagtaacatggacagaaatgggaaagagagctccaatcatgcctttccttccatcctggcctgtggagctcattctcatttgtgcaggaatatgaatgtccaatctgaaatttaggcagttgaggatctgcagtcaaactgactggggcttggaaaaaaatactgaatggttgagcttttccatattgctttctacatttccctacatttctcttgttagaaagaaaaatattccttacaaatatacatctgaaaccagaacatttaaat

SEQ ID NO: 16979 - DNA, 282 bp, Homo sapiens
gtagcctttgtttttgtttttatacagtagctttttttaatgaatgatttatctctataggagaaacaaaaatttcaaatccaagcctgcccttccaaaggtgagtactatgaaaactttttttgtattggtattctgctacacaattattttttattactcatacaatcttcatacatcaaaaaacaagaaataaccttatttgtatccaagatagtgatcgtgcacttagttgaatccattttagaaataacactgttatgaaatggctgagcaatagct

SEQ ID NO: 16980 - DNA, 480 bp, Homo sapiens
caggcaggaagataatgttacagaggtccacaacaaggggtaatgtgcagtagcatcccaggatacaatattcagaaaagtagtaacataactaatggaatccatgaaggctaatcaggtagtaagcccaatgagtgctcagtaacaactgtaatttaattctcacaatcacattatgagatggagactgttataatccccatctctgataaggatgctgaaacgcagaatgaatggttaagtgacttactcaaattcacacagctaataatggtggacatggaattaaaacgcatgcagattgtccccacagtccacacactcttaaccactctgttagaaatgatttctttggcttagttgtgccaccacaagcaagtgaatggcatcagactgtctttcagcatagaaagtgttccggggattgggctgaggatcatggtaaagaatggacagagcaactggagagactaccttgga

SEQ ID NO: 16981 - DNA, 615 bp, Homo sapiens
agagggcttcttggaggccaggcatgaactgagcttttaaagataaatgggagttgcccaggtatggtagactgtcacatcaatggcctccagtgagtcatgcccccccccgcccggtgtccatgcttttgtgtaatcccttccgtgctgattctgggcttggccacgtgccttgctttggccaatgggccatcagcaaatgtgatgaaagcagaagcttgtgaaatgtttgtacgttggagcttgcttttttggagttcagttgccacttgagggagtctgaactatctcagtttacatcaatcaccatttgggatctgccagcccccagttgacctaccatgggaccacacaggcctgtgacctgccatgggaccacacaggcatgtgacctgtcatgggaccacaaaagcatgtgtaattccaagtgatgccatacagaagagaaatgagccacccagataaggctaccgtggtgattctaaaatgtggacacaaattctttgacattccttcatcaagaggtgacatctaggccgggcgcggtggctcatgcctgtaatctgagtactttaggaggctgaggtgggcggatcatgaggtcaggagatcgag

SEQ ID NO: 16982 - DNA, 601 bp, Homo sapiens
ctttggaaggccaatatgtgtggatcatatgagcccaggaattgagaccagtctgtgcaacatggcaaaaccttgtctctgcaaaaaaataaataaaatacaaaaatacaaaaattagccaggcatggtggcgtgcacctgtagttccagctactcaggaagctgaggtgggaggatggcttcagcctgggaggttcaaggctgcagtgagccatgattgtgccactgcactccagcctggatcataaagtgagaccctgtctaaaaaaaaagaaataaaaagaaaatggacaagtagacttagtagacatgggaaagctaaaaataggaggatgggggggaaaacagagaagcaatctgatttgttctacagagctcccccaaaggctcaaaaatggataggagtaaaggttatagccatggtgagagtccaaaggtagtaagttagtaagagggagccgatgacaaatgtggcgaagatagaaataacagtacttgattaagcttcaagagggcaatgatcatataactgcttaattcgtggtccctagatgcgcctatttcaactaaacatattgttgggtggatagatagaaagaag

SEQ ID NO: 16983 - DNA, 570 bp, Homo sapiens
aacagccataatgcataatgcactgctaaaaatatatgacatttaaagaaattctttgtttgacacaaacaattatgacacaaacataattgagtggaaaatttcactagcatgcccagtggtaaaatagttgacatttttaaaactcattctttgtgtcaacaacttctaacagatttctctgtaatcaccagagctgtactcaattaacccctaaaatgcttatcaaaaaaatactgttgctgatataagattctaatttccttaacacaaattaatctccaagtaaataagtatgtgccttcaatatgcagcaacaatttctcagatgctcatgtacctgaccagtaaaacaatacgtaaaagggttgtgagaaacaaataaggtaataatgcaacagtactttataaactacaaagtactatataatgagcttctcacaaaccatatccttggaacactaatatcatgaagaatctcaacatctgttctttgaataccaggctaggtagtttagtaggtgtatactctactttctttttgaggattcacaattcacttagtgtatc

SEQ ID NO: 16984 - DNA, 623 bp, Homo sapiens
cactcaccacatatgctgcactgctttttcacttgtccagctctgcctctagaccagctctgtccactataatagttactagcacatgtgtcctctgagcacttggaatgtgtttagtggctcatgataaaatactatatcggatatcttaggttgcagaaattatcaataaaattaattttactgcttctttttagttttttttttatgctctactctaaggtcagcaactgatgttttttcattgtatccccaatgcctactagagatcttgccatagaacaggactcaagaagtagttaagtaaaggaatatgagcccaaaagacagacagggactcaaattccaggcaatggtgccacccagatgggagagggcagagctgtgcttgaaggttactcaggccactgggagagtaacagatcagggcagtaggaaaagcattcagggagaggctacccacagataaggaaaatggctggaacccatgcttcgaaagccattcgaggctaatgctggacagcagacactctggaaaagccaaccagggagatatgttctgcctttgccaaatttctgctatcctgcctctggtactcccataggtgacagagtgatcttgt

SEQ ID NO: 16985 - DNA, 615 bp, Homo sapiens
tgcatgcatttgctaagcacttgtatataaattaccttattttatcttcatagtaagcccatacagtaattaatattaaaactcactgcacagataaggaaactgataaggaatcccagataagatccaaaaagattaagtaatttgcccaatatcccacagccagtaagtgttgtcatcagttctggactgacacagctacctctttgtcacaaaatcctcaaagatgcaggctttttccagctcgtggcattcccatcttaggaggtggctcttgtcctcattattcaacatggatggcagcatcatgttccaggcaggaggaaggaataagtaacaaatatgagagactaacacctaaagaaagatcatggaagatggcatgtgacacttagccaacatctttttggccataatgtggttacatgatgattggtcagtttgctgtcaagatactgatggagcacttcaacaagagaatttagtaaagaaacatgttcaaaggagtgggtacggttaaggaaaataaacaaggaacagtgtgcatgccagggctagcaatagtaaggaaccattataactgtgaccttgacgggcatggtagagatgattacc

SEQ ID NO: 16986 - DNA, 615 bp, Homo sapiens
gtatttatcttagctaagtgcctgtttaattgagtagagtgatatgtgtgaaatgtgtgtagaagtgtgttatgcgtatacatgtggtttagtgacgtaagttgaaactgtgtttaacagagttctgtatgtgtgttaatgagtttattgtgtgtaaccaacattgtgatatatgtgtgggacattgggtttaacatgtggggtgcatgttctgcttggtttaataatatacgttggaacttgtttaatacaggtggttcatgtgatacagaaaataatatttgtgaaagagtatgttaaccatatggatgcacatccttcacactttagtgatatatactgaacctctgtgtttagtgatatatacgaaccactgctaagctagggaggtgtgtgtatgtgtgtgtgtgtgtgtgtgtgtgtgtgtgtgtttgtgtgtttatgggataaaaaatgtgggccgggtgcagtggctcatgcctgtaatcctagcactttgggaggctgaggcgggcggatcacctgaggtcaggagtttgagaccagcctgaccaacatcaggaaaccccatctctactaaaaatacaaaaattagccgggcatggtggtgtatgc

SEQ ID NO: 16987 - DNA, 623 bp, Homo sapiens
gcctggctcagttacttagcttattaggtgactcaccttcttttcagcctttgttgctcatctattgaatggaaataatagttttcagggccagcgtccggtacaacgtcactactccagcccagcatatgtgagccatcatctggggagtaaaaggtttgagatggaggagctttatttggaatgtcagaattgacatcataggtcagtattgcccttctaaacatttttatttagaagctttataaatattcagtctttaccaaaacatttttgggaattgccttcaaagctattttacatctttcaagaaggattactctcatcagtttatggtgagacaaattcttcttgaaacctgattttttgatgcaagacaatattatacttcatggccagattagcttcagaatggcctgtggctgatccttattcattctcaaagggtaaagatttagtgtcagtacagatattcagagaaatgtgtgtgttccattgccctgtaggttagttctaaagagcttcaaaaccattttctatggcagtagtgatattggcattcatgagtagtattcccatgtacccaagtatctgaagagaggcagtggatccttcattctctc

SEQ ID NO: 16988 - DNA, 647 bp, Homo sapiens
ggagaaggaatcactcagtgttatttgcttcatgctagttcattcatatctttcttcacgctagtgtgctgagataactgaaatgtttgggaggatggaaacataggctgctaattctgaaaccagtgatgaagacaataaattgctcaggtttcttagcttggttctgcccttagctcctccaaagaagaatccaatgaaagaaatgtgagacataggaatactaccactggagagaaaggtgtgaactgaactcaagatggagatggagttgtgagctcttttatgattccactctccaagagaggtgtggactatcctctatcagaatccccctgggttgggcctcacatctgaacactcttcttgattagtgtggaactgccgaagtcaggatttttaaggcataataatactatttaacagtactcaggccgtgtgcagtggctcacacctataatcctggcactttaggaagccgaggcaggcagatcacgaggtcagaagatcgagaccatcctggccaacatggtgaaaccctgtctctactaaaaatacaaaaaattagctgggtgtggtggctcgtgcctgtaatcccagctactctggaggctgaggcaggagaatcgcttgaacccaggagttag

SEQ ID NO: 16989 - DNA, 640 bp, Homo sapiens
agagccagaggtgacggcaacacggtatcagcaggctacatgagtggccacgtgtgcagctgttcagagaaagcctgtgcgctggggtggtgctgtgaagctgatcgaccaaagggatcaaaacccagcgttggacgcagcatctaaggagagaggttccttggccacatcctccacccaggcgccaaacagtgaagagaagccacgcatctgagagtcaccaaaggagcagttaactcacgctcagcccttgatcatccacactgaggggaactggctggccatcatcaaaagcgcatctctgccgctttgcaacacgagaagtcatctgccttagcagcaggctctcctcctgaagtaaggccccaaagatttcctgtgatccaggaaaggaaaacagtaaataagccagcttccgtgtcctcactgacggggggcagcctcagaaagcatctcttttctccaaatctccagacacttctccactctgagccaagtgctaacccaaacagttcatgactcaacagctacgtagtctatccacccattcatgtgacattgtgaaggcgacactgccacaagccacaaccaagccttctacagggatgaaggccaaggggactctatgcagggagcgcat

SEQ ID NO: 16990 - DNA, 590 bp, Homo sapiens
ctgggtccctcccatgacacctggggattatgggagctacagctcaagatgagatttgggtggggacacagccaaaccatatcaagtagggacatgtggaaggattcatggatagcactaagatgtcatcgaaggttggagactacctttctgcaaaggccagtttctgagatgttgagttagatggtgtcatgggcaggaagcagtatcatacttgctcattacttgttatctagtccaactgcagagagatggcaggacaatttatcctagaaaacaggcagggccaaagcagcaatcagctgggatgggggaaggagtagcatagcttaagagctctactttgaccactatggaaaccaagagttttaagcttggccacacttgaattctaatcatatcatagagtgaacaagaactgtttcaatcatgatgtaatctgagaataaattcaccaacatgacctcattgcaaatggggtcagtttttatttttaacatgtttacgaaattgaggttcaggcttccaatagaaagagataaagggacagaggtcaataaagagggtgagaaaaatagctcaaaatgagc

SEQ ID NO: 16991 - DNA, 652 bp, Homo sapiens
tcccaacaggccccacttccaacactggggatcacatttcaacatgagatttggaggggaaaatacatccaaatcatgtcagaaatgaatcttaaacacttctaaaacaacagttactaaggaatcagttagatagaaggagtacgttctagtattcaatagtacagtagggaagtgatagtaaacaatgctgataatctgaagtggaacagtttcatgccaaaactatcccccaccagtctgtggaaaaattgacttccatgaaactgctccctggtgctaaaaaggttggggactgctggtttagaccacattattcagagttgttctagtaattattctggtaatttgtctcatgcaatagaaaatacatatgaacactaagaaatctagaaataattcttctcataataaaaaatataaaaacttggtaaaatataagcctacaatattttttctctatattcaggtataaagacagtgtcaaccatgtgacatttataatattcataatctatatttgcaaaaaaaatgtatcatggaatttgagaaggtttagattcttagaaatttcttataaatatttaaacatggtcaattaagggcattgtaattactctcttaatttgcattaattagtttagactctact

SEQ ID NO: 16992 - DNA, 619 bp, Homo sapiens
ggtcccttgccaacatgggagaattcaagatgagatttgggtggggacacagccaaaccataataccacccagctttcatgttgaattttaatccttgatgttggaggaagagcctaatgggtggtgattggatcatggggacagatttcccactttctcttctcatgatagtgagtgagtcttcataagatctggttgtttaaaagtgtgtagcacccacagttcctaacacagagaaatgacaaatgcttgagacaatggataccctaattatgctaatttgatcattacatattatattgctgtatgaaaacatcacatacaccctgtaaatatatacacctattatggactcataataattaaaaattaaatgaagaattaacttcaaaataagacactatacccaggtcattgaaatgtgaattattttagactttcaaaccaaatgaaaggtaagctctcactctatctaaacaactacagaacgtcaaaggaataaatgctgctcaatctcaatttttggtagtgaacaaagccaagtaaacacaataaagaaaatcagccaatgatagctaagagtggagatgaaaatataacacatgacactattatctc

SEQ ID NO: 16993 - DNA, 613 bp, Homo sapiens
tctgtagtgcataatgtttgtgtgtgaggtttaaatttatacatgttagatcacaaggaaaacatgaaaacatttactgtacaatttgttctccaatataactttgcttttggacaatggagactgaagaaaggcttttaaaatgataagacatctctttcacaaaattttcttccctggaattccagatcaataatgtttttagaaagctaaattaattaataggatatggtcttcactgagaatattataggtgaactatccataacaaaaaagataatgaattaatggttattgaaaaataaccactaaaatttaaccaattaatactttgcaagtattcctcatgtatgacatttaaatcaaaagctaagttacgctgtgatcatctagaatagctgggaatcatacaaatatcgaagccatttgaaaaatgattgttgaaccaaaaattaaagtgaacatggtagaatcagctggtattacaatagatgcccattagcattggttttagactctctttcttatcctcaagcaagtatattttccccaaaaaaagaaaatggaaaacacacacacacacacacacacacacacacgcacacacacacaa

SEQ ID NO: 16994 - DNA, 634 bp, Homo sapiens
gattttctttcatttactgcttaagtcttttctcttcggaaagctagtgttgtgccttttacatattagagcatcataaaatgttttgttcttgtgttttttatttaactctctgctcatagccattcatacctgactatagtctatttacttggatctcttttctatgtgcctgtattatctatttgtttgctttcttgcttttgagttgacttattgtactttaggattcaggaaagagaaatgagaaatgctgagagaattggagttttattatcagtggttctaggaagaagcctttttccaactcatcttccaccacggattaactggaatgctatgacactgctatttgttatttatgccattgtttaataattggtatgctgaaagtagtatctactgtgagtcatacactttagatattttcctagaagctactttttggtgggggaggtaaagagaatgtgaagggcctagatacgaaaaaatggaactagaaagaaaagtactaaagaagagtaaaaccaactctgttttggaattatttttatatctcagtcaagatacctacaggaagaaatggtacactgaacatgagtaattgaagaaagcataagaaagagaatattta

SEQ ID NO: 16995 - DNA, 608 bp, Homo sapiens
ggcttcttgggtaccagattcccacttagcaatctgccaaatagtcttctttctcggatgcaggtgatgccaagatccagtcccaagcagagagacctaaagctggcttttaattataaggcccatgatggtttgttgtgacttagactataagcattctgagacaggttccaagacctggggaaatcatcattaaacaaacaaagaggcaagacttgtgcaggactcatatcagaggacataaggagggagaagaagggatgagaatctttcctaaataatgcactgcttcttcaagacccatgcctgagacaaacaggattattaagttgggaaactagcctgtttcacctctctctaattagaactccctacacctcccaaacaagagaagggaaagcaactctgttttctgtccatgtctgcccagccagggaaagaatattaagtctcagagcaagggtcgggcacggtggctcacgcctgtaatcccagcactttgggaggccaaggcaggcagacgatctgaggtcaggagtttgagaccagcctgatcctaaaaatacaaaaattagccaggcatggtagcaggcgcctgtaatctcagc

SEQ ID NO: 16996 - DNA, 594 bp, Homo sapiens
tgttggccagtctggtctcaaactactgacctcaagtgatccgcccacctcagcctcccaaagtgccatgattatacacgtgagccaccacaccaggcctttgtctgattttagacagccactttctcactttgtaagaaacttgtaacagtggcagaaatgtcactgtagctgtgatctgtctgttcactgaacagatttcacctaggataacattctgaggcttttctctgggcacacatttagttgttacaccacattatttagctgttttatgagcttaagaacagtagttacaagcaaggtgaatccgcattgctgcactcaaagctttcagataggtgtgtgccacactaatataaacggttgctgtacacgtacagagaaacttctctagtaacgaactgtagaaatgatccctggaagtacagtcttcctgcctgtgggctttgtctaggtgctgctcttaaatacgtgtcttacaggtaaacaatctgactgtacattaagggcacgtaagtgacctgtaaagagagttttcactctaggccagtgcggtggctcgcacctgtagtcccagcactttgggagggc

SEQ ID NO: 16997 - DNA, 536 bp, Homo sapiens
aatatatcgtatcagttagggtggggcgggaacaaatcacaatggtagaatgtcatcaggtaagactattttcgcttcttttttggatcttcagttgcttcaggccatcttcatgtatatgtgcaggcccacaggggatatgatggcttagcttgggctcgtctagatggctatgctaaacccagcataatcagaggttccattttgttgagaaagaaagggacaacgaatattgggcaacaatttgtcatctctgccactgaaaccactgcttctctgtccactacattttatcaaaggcagagtgtcttgcaatcagcttgacttgcaagaggctcaaaggcctcttggaatgccttgcatcagcttgcttttgtggcataaaaagttaccccaggtgggcgcagtggctcacccctgcctgtaatcccagcactttgggaggctgaggcgggtggatcacttgaggccaggagttcaagaccagcctggtcagcatagtgaaaccccatctctactgaaaacacacaaaaagt

SEQ ID NO: 16998 - DNA, 575 bp, Homo sapiens
acaacctaaatgcccatgaagagtacactggttaaataaatgtggcacatcatgtatgtagcaacattgaaaggagtctcatatttaacacacagaatggttcatagcaggtaatgggcttacaatagatataaatgaatgaataagccgttaaaagtaacttacgatatggttggttctgttcatccattcgttcattcattcagccagtattctgtggggaaataatggtgagacaacagatccaggcacttcccttaccaaacatatagcctattagaaaagatagtcattaatgccgggcatgctggctgaagcctgtaattccagcactttgggaggtcaaggtgggcagatcacttgagatcaggagttcgagaccagcctggccaacatgatgaaaccctgtctctaaaaatacaaaaattagccgggcatgatgatgggtgcctgtaatcccagctacttgggaggctgaggcaagagaattgcttgaagctaggaggcagaggtcatagtaagccgagatcataccactgcactccagcctgggcgacggagcaagactcggtctc

SEQ ID NO: 16999 - DNA, 637 bp, Homo sapiens
caagcagaagtctgctgatggggcatctgagaaggctattgatttcctcataaaaaggaataaacatactggtacacactttttgcccttctgtcttcctgcctggaatgtgttcatgatgcctggagatgcaggagcgtgaggatgcacagcaggcaggtagagaagctgggtctttgaccactatcttgagcagctgtgccagccccaggctgcatccacttcttgttattgggaaggacaaagccctatttacagacaagtctctattccatgcagcttaatgcaatcctgactcataaagtacctccaaaccaccgctccccagttgttccatgtcaggtgccatagtatgaacttatttcacttgacaccctctggaaggtcctacctcttaaaagaacatgtagccatatgcattcagtgttttcagagaagacaccaccaccatcaccaccatcatcatcatcacccccaacaacaacaagaacaacaagcaagtagtaagtatttacaatgtgtcttaaggaactcttgattaattgacttcaagcagcactacttaattcaggaacacttaccaagagaaaagaagccaggggcagtggctcacacctgtaatcccaacactttggga

SEQ ID NO: 17000 - DNA, 574 bp, Homo sapiens
gggggacagagcgagactctcttgaaaaaaaaatacgtatatagaaaagtttaatcgtgggaagtgctgtaaaggaaggcacatgttactctaagagtaaagagcaggggaaacaggagggcttttcagaggaagtgccctttaacatgaggcctgaggagtaagtgggagccagccagcgaagggaagggcattccaggcggagggaacagcctaggcaaaggcctggaggcagagagagccatcagccttccctcctggactgcgagttctctgaggttccacacttttatgtctcccctgtgccctgcaaacaggtgccactgcattgatgcctggtggaatgaattgattccagaagggagggaaccgggagaaaccagctccctggattcctccccgctggggcggagcaggtttgcatgcccaaacttgcccccagatttaagcagctttccttggtcacgtaatcaggaggatgggatttgacaaatgtttgccagggtttccatgagatcaggcaaagccgcgggtaaccccgaggatgggcccctttttccaccctccgcaagtt

SEQ ID NO: 17001 - DNA, 342 bp, Homo sapiens
tgcctggccccctctctgtactgtgtccacatccatcatttcccccaggctttattgagcacctgctgtgtgcgtccatctctgtttcccagagcttagacttcaaggtataggaattgctttgttttcatttttttttataatcctccaagatcttccagtctacttgaagaaacaaaagccacatcctgttttttatcctgtctttttgtggcttgctcatggcatgaattttctagctgtcaacaaagggaggggcgcttttgggctggaggagtcaagaggccttcaggaaaaaggagggcttttgatacattttctttctttccttccttttttttt

SEQ ID NO: 17002 - DNA, 589 bp, Homo sapiens
ataaagccctttccttccacaacttggtgtctgaggggttcttgtctgcggctcatcctgctacagtttctgctaatttttttgacttttatttttcttgtccatctctgatgcttgctttgctactccactttgaggattttgggcagcttcaccctcagccattccaacagtccatccatttgcctcaagctctaggcagtttctcctggttcttctgttcctggcatctaagatttgtcagcagggcctggtttccaggaaccatgcatggctatggcctcctcccacctggagggctgctcctgcacctctgactggcaatggttccagctgcggcccagctgagcacagcaggaatggcagcagcaactggagcatccatgcccagggtcacctagcccagggacaccttagctacaacccagggttgatgtccagctccatgcaccaaaagccaaggccaaccagagcatttcctggacaagatctctcggtctgcagggccagttcctcctactggcttcctgctgccacctccctttccatcaaagggatgctcaggatggcacaggagcctggagacact

SEQ ID NO: 17003 - DNA, 546 bp, Homo sapiens
tcagtagagggtgctgcagggacacggtaggaggaaagggcttttctttccggtttggtgtacttttcttctttctcccaggcatgagtggcctgtagtgtgtgtgcaagacatccagtggtgctcgcttcccactgacttagtggcaactttctgggcagctttctagccagtttgcaccagctgacattccaatgactctttcgggtgcctcagtaggtgcctttccagtgagttccagcgacaccttagtgagtagtttcctagtgaattttgtcaggaccctactgtgctgccagttctagtttgtacctccatgaacttctcggccatccaatgtgccaaactcacatttccaaccaggtctgagtctcatgcttccggccctgttcaaaatgtgtttcttccttaggtactgttccttagccccagaggtagtagctgctctctgtacctgccatccatcattcatggtagagcttgctctgccccttagtaattaatctcctgttactaccgaacaattccttagattaaatttgccct

SEQ ID NO: 17004 - DNA, 519 bp, Homo sapiens
tccctacttgaacataggttccctcaactgttaaatgaaggtagagtaaaggggcaggctagctgagatattctggaaaaactctctagctttatgattcactgagttttagaataaagagaagaatcagcttttatttctaacgtcttggatagccacccaattattccatgcaatagcagacatctccctttgctaaccacaggaacttcactgcagtatgagcgcagcacttgaggtcaagtacagtttgagaagactggattcaacagcactttggctccctcttgcaggatgatggtctctctcctccaacaagccagccaggtatcacagtatcaaaaatgagctgtaaataggccaggcacagtggctctcacccgtaatcccggcactttgggatcacttgaggtcaggagtttgagaccagcctggccaacatggcaaaaccccgtctctgctaaaaatacaaaaattggcttgggtgtggtgggcgggagccagtaatcccagcgactc

SEQ ID NO: 17005 - DNA, 604 bp, Homo sapiens
acctcctacctgaagggggctgctggctgtggggtcccgcttgtgcccgccacctccttctctgtcttctatgtcatgtgaggctggcattcccacgcgtgattccaggcttgttgttcatctacacaaaacttttaatacgattttgacaaaaaacatagaaaaggatgacttgccctactgaatattgaaatgaaccgtggactaactatgaactttcaaacaatccattagcggctgagaaataaacagaaaaatcaatggcccaacacagacagtggagaaacaggctgaggagcatgtccaagtttgtatggtcaggagtgtgcctttcaagtctgtggggaaatacgtgtggaaaagcaagacaggagtgtatttcataccacagggcagaaggattccagacttatgtggaaggaataaagtcatcacaatgtgagcttacatgggcctgtggggcaaaaggctttctaagtatgacttctaagggagaaatcataaaggaaatgcatgaataataaaaaaggatacattttctatggtaaaataatatcacagaaggaaaattgcaaactgtgaaaatatatttgcatcatatgtc

SEQ ID NO: 17006 - DNA, 653 bp, Homo sapiens
cactaaagctcccagctctacctcatcccaatttcctcaaaatgctccaagtaaagctatgcctttggaaaacaccccatgaattcactgattcagttttatgcagctatccaaacactgagcttaattttgtttactttaagaagagggaaaatagcctccaaaggtagtaaatcaagtagaattatttcagttatcaagtccttctctgtgaaactcaaagtcagcagttgaaatgatcaacctcttaaaaataattaaaagcagacatctggaaaatactagtaactgcagcactcacagcgccagaaacatattccaggaataaccaaggcttcattttttcaaaaaaattatatttttattttattttaaacagaagcttatcacccatgaacataaaacacgaatgtctaataaaatttacttttaaaaaatttcagcaagttaatgtcaacacatgttattaatttttgctaggaagccattcttaatggggagtctagaagcatggccaaccagagtttaatgagctggtggctgttcaatagcacatgcatcacaatgagaccagatggaccattaaatttcatcctccacattcttttttggaatgtgaaaatattgtcccctatatctctggcacacctcta

SEQ ID NO: 17007 - DNA, 578 bp, Homo sapiens
cagaggatatagatcccacagctcctgtattcaagctgtctttttaaatattgtctctgcagaattaattctaataaccttctctccatggaagcactcctgaagaattaagtttgagccaaggcattagatgttgaggagtatgtaagtcttccaaatgtgccatatggttcagaatgctccttatctgatggggaagaaggcttcaagttttggcaaccaccatcccttagatttttctcttgtatgccaaaattatccttatttgccttccttaattgtattccattatctaatatgtttatgactacttctcatgattcttttccttttttgagaaaatgactactatcaaaggagctttctctgatcctgatgattgtatctgaaatggcacctccctcttttcaatctctacctgcttatcctgccttatcttttgttgttattaatagtgcaacacagtattttaaatagtatagttttatcaatatattagatgcacttatctctcttagcacatattatgatgccagggccattagattaggaaatttgttttattcactattatgtct

SEQ ID NO: 17008 - DNA, 531 bp, Homo sapiens
atatatgttttttgctgaacagtttgagattaatcagggtaaggagatgtcatgatgcttaccctctctctctatatatattttaaggcagggtctcactatgtcacccaggctggagggcagtggtgcaatcatagctcactgcagcctcgaacttctgggctcaactaatcctcccacctcagcctcccaagtagctggaactataggcacatgccaccacacctggctaattttaattttatttctatagagagaaatcttaccatgttgcccaggctggtctcagactcaagtgatcctcctgcctcagcctcccaagtattcagattataggcatgagccactgtgcctggcctaagttcttgagcatctgtttcctaatagtaagggcattctcgtacataaagacactaacatttcaaaatatgaaaaatgaacgataattttctcattatatctggtatccagtccatatttaaatttatctagttgtctccaaattgtcttttatggcgattttttcttcct

SEQ ID NO: 17009 - DNA, 544 bp, Homo sapiens
tttttttacctcttcataatgtctaacacaatgatggtcatatttggccagccacctgattattatttgttgatttatggacttttggaacttctagatgatccagatcttttgtagttaattactcactttggggaaactctaaaaaaaacaagtgtttattgagcatctattatgtataagccataatgctaggtgctagagaagctacaaagatgcaaaagacatgggagtgcctgcccttagggagttcacattctagttgggaagataggcttgaaaaatgagtagcaaggaaaggcttaagtgacaactacgtagaacaataaaagagacatcaaaaaggtaatgtcagtttaacggccaaatgatttttctacatgcattcagacaagagaaagatcccttctgttgggagcaatcaagaaaggttttgcagagaaggtgggatttgagccgaaagaaaattaggatatgaggagggtaagaaagagtgtattccaagtgagaaacaggctcacttggtgggaaagagtggtgggaa

SEQ ID NO: 17010 - DNA, 570 bp, Homo sapiens
caagagccaacattgaatcttttaatgatcaaatatcaactagcattttcttagacctctagaatgaggattgtagaaattttataaggcaaaccagcctggtatcttgaaaacatcatggccctgggaatcagaagaggcaaagcactaactcagtcacttaacctccttagagtccattccatttagtcaatatttattgagcatttcctgtgtcctgggcattttcttgagcaccagagacataaagacaaatgaaccctagccttgcctgcagagagcttataatttactgttagagacagtcgtgtaaaaaaacaactgcaaaactgagtgagccatacctcaacagaagtacacacaatgtgctagatgcactaatggaaccgaatgattcattccatcctggatgagctttagggcatgtttctcaaagaagttgacaccccagtacagcctctgtttttctcatctaaggaatgaagaggccaaagtgaaaaattcctatgtctctcccagccttacagctctgaaattcagtaagtgtgcagataaatccaagaaatcctg

SEQ ID NO: 17011 - DNA, 508 bp, Homo sapiens
gtcctatggttaaaagcaaataagtaaatagcttattgcttactctctaacataaatgctagttttgggttttattttcataaaagcccaagtaaatttagagcttcaaggttaactactcattatgttctcaaattcatttaatggtccagagtgacactacacagggaaatgtatttctgattaaaacttagtaaacataggccaggcgcggtagctcacgcctgtaatcccagcactttgggagacagacgggcagatggatcacttgaggtcagtagttcgtgagtactctggctaacgtggtgaaaccccatctgtactaaaaatacaaaaattagctgggggtgatggtgcatgcctgtattcccagctactcaggaggctgaggtgggaaaatcgcttcaaccaggaggtagagggtgcaatgagccgagatcgcgccattgcacttcggcctgggacagaccaagactccatctcaaaaaaaaaaaaaaaaaaaaaaaaa

SEQ ID NO: 17012 - DNA, 562 bp, Homo sapiens
ttttcactgcagatgtctttacaatttacagatggctttacaaatacagcttaactttggaacctgctgaatgtgtttactgccctagattctaaacacctgtatcttgaaagaagctgctgtgcaaggcacaacctactgagtcattttcaaaacactgagtacagggagcaggtgttcagttgtcagtaatggaataaaacaaagttacaaactgggttagttagtaatatgaggtgcacaaactatatttccagacctgtagataaatttctctatttaattttcaaaattattaaaatactctactctttaaagatgaacttcacctgaatataatagatgtctcactgcatatctgttaatctcaacgtatttctgatgcattaaaccatgacaggttacccattctctctttatctttgagataactaagattccataaacatttattccaagagaagattcaatgtggtcacttcataaatcatcaccttcaaagactagcacaactggtcaaaagaatttgtaaaggtgctatgtttgacatcactttaagcac

SEQ ID NO: 17013 - DNA, 606 bp, Homo sapiens
tggttcaaagccttaggcttacaaaagcactcatcaaataaaacacttcaggagctcagtttccaggagttaagtcaaaagccagccctgaaaacaggccttttttgggatatgcactttgagcaacctgggtctgcagagttgacatttcctgtgtattcacgtttttaaactgcccaaaattcttactgaacataattgtgtgtgcaatccaaaagaaagaagagaaaaactgaagacagaaaagatccagttcacccctaacctctgttttagaagcaaagtataggaaatcaggattaagacaccaatactaccccaaaacagcaaataatcccaagtaattacctccagctttgcaaataaaaggaaaataatttagcaaaattcagttcaaattttatttaaatgaaaatgcaaggcatctaatgtatacttggtactgactatcatttatgtgttcagcctatgcctcaatcatgacaaaacaggagttataaagtattatttcagcttcaatggatgctgtatttataacaccctaggccaatagcagaaggtgaattaagaaaagaagatggtaaatacactattatttttaagcat

SEQ ID NO: 17014 - DNA, 538 bp, Homo sapiens
atagtgagaccccatctctacaaaaaattagctgggtgtggtggtgtgcgcctgtagtcctagctactcggggagactgaggcgggaggatcactgaagctcaggaattggaggctgcagtgagctatgactgcaccattgcactccagtgcagcctggtgacagggcaagcaagacgctgtctctaaaaaagaagacaacattcctaccatcatgcttgtctaatttttaaatttttataaagataggatctcactatgttgcctgggttggtcttgaacggctaggctcaagtgatcctctcgcctcagcctcccaaagtggtaggattacagatgagagccattttacctggcccttatctctttcaaatttagttattctcatatctctgccaatgtcttccagatagataaattctatttactgccttacgtttgcttgttatattcttctgtcctcattttccttaccttgtatggtaaattaaaaagaaaaatgagggcttgggcgtggtggctcacgcctgtaatcctag

SEQ ID NO: 17015 - DNA, 203 bp, Homo sapiens
gaagggtgctgctctgggtccctgagaaagcagatgcaggagtccttctgatgccctgatgtgctgggttctggagaggagagaggactactctggggacatcattttggtgcccggaatagtggccagtccaggaactatatcccttactgcacttggtggtaacttgtctaggcaggctgtgtctctccgctattgaatcc

SEQ ID NO: 17016 - DNA, 574 bp, Homo sapiens
ggtggctagtgcctgtaatcccagcactttgggaggctgaggcgggcagataacctgaggttgggagtttgagaccagcctgaccaacatggagaaacccatctctactaaaaacacaaaattagctgttcatggtggcacatgcctgtaattccagctacttgggaggctgaggcagtagaatcgcttgaacccaggaggcagaggttgccatgagctgagatcacaccactgcacttcagactgggcaggaagagtgagactccatctcaaacaacaacaaccaccacaaccaccacaaccaccacaaaacccaaatgcatttccttggcacagtaaaactgaaacagaaaaagtgtaaagtaaatacaagtaactgaaagagtttatgtatattattttacttctcatttgataaaatttgtaaagtaatgagcagagtgtatttctccagggacccagatatatacatttattcattcaatagaaattcattcttataatggccactgatacctatatcctaaatatttctgaaaacatctcttcaggcctgcatcatctttgcaacatt

SEQ ID NO: 17017 - DNA, 569 bp, Homo sapiens
agacttttaactctattttttcttttgtgggcctgtctttctataatgctcttcagtccaatccctacaactttatggcaaaattctgttcaccatccaatatatttcagttaagattcttagcttgtatgttagtgctcccatggcaccttattagtagtttcattatagtatataatcacactatatttcagttgcatacataattatttgtcctttaaaattgtgaactctttttggtcaaggaatatgtctcattcatctttgtagtctaccagtactttagctacaacagagttagcgctattcaactcaatcaagcttaaccattagaaatggaagacaactggccaggcgtggtggctcatgcctgtaatcccagtactttgggaggccgaggtgggcagatcacctgagatcaggagtttgagaccagcctggccaacatggcgaaaccctgtccctactaaaaatacaaaaattagcttgtgtgtggtggcacgtgcctgtaatcccagctactcgggaggctgaggcaggagaatagcttgaatgaacccaggaggcag

SEQ ID NO: 17018 - DNA, 654 bp, Homo sapiens
ttagtagagacgggatttcacttgttagccaggatggttttgatctcctgacctcgtgacccacccgtctcagcctcccaaagtgctgggattacaggtgtgagccgccatagccagcccatacatctctctttaaagaaactccttagactcctgtgggcaatctggaaggcttagagaagattgtttctgtgaagctgaaggtagattccatgcaggaactctgtgaatttatagaaatcatgtaaaacctgattttccccaccccctatcatccccaaatgtgccaatggacagacccagcctcaagattccaggttttcagtctctttgatcacttgctcctaaatgaaatccagcaagagagaggaagaattttacttgctgttctgacatttcaccatcttcctcagatttagtttgctctgctatgcgggagtcaacagaaaatggcacacaaatatccatcgactctttctaaaatatgttaaagttgatgtgtacaatagctcccaggtcacacagtctattaatacaccacacagatctgaaaatatgcccatgaacctacagtttcagatagagaaacaccagcctagagtcttactactgagcatttttaaggctacacatggtcattgctgaaagagagag

SEQ ID NO: 17019 - DNA, 622 bp, Homo sapiens
tgactttattcagtatcttgatctaaaggttgactgaaggtggagaagaaaaaaatacgaatttatacaaatgacttaactgcatgtaatacaacacgaggcacaagcaagctcagcatacaccaggtgcatcgcagatgggggagtattccttattgctaataaattcaagtgcatgtcttcagtggaaaaagtaaaaatgcaggccccattagtattaatgtagttacttacctcacatctatacagactttttttttgcattatcccaaagctggtagtcatagcatgcacattttgcatcattttcatagaccctcttgtcttcccacacacatctatgaaatgtccactcactcagaatttaattattataatgcatttgtctcttaacaagtaatccagtacctataaatcaatgctgggcaccccaaactgatacaggatgtgctgttggagtcttgctctgcacatatggctgggataattcaagaacagaaagaagcaggctgtgattctggctgattagaaatatccccaccctacaaaaccaacatatatactatgttccagatacttttctaggtgcttatgttatttcatttagtccttgcaatgaccg

SEQ ID NO: 17020 - DNA, 601 bp, Homo sapiens
tgctctcaaactcctggcctctagcaattcacctgcctcgttcacggacttttctgatcttgcttgtctctgtttagggtttctggagtcagaactgctgtcaggatgagtgggaagggcatcccctcacctgtctgtgcctcagattcctcatcttcaaaatggagggaataaaactacttaccttgaagggctggtgaaaggttaaaatgagatgtaattagtttagacattacattcatacataattagtttagaatagaaactggcatgtgttaagtgttaaaataaatattggcagcttttgttgctttatctctatgaatcctttgcagaagttagagatcacggattatctagaggtaggccatggtggagaattgagaatgagatgtggagtggtgattggatgaggaagtcatataagctgcaggaagggcgagtgactgaggaagcttttgtggagtcctaattagagaaacagagttaggctggcaggaccaagggaaagcaaagagagaaagcagataaacggcccgggtgtggtggctcacgcctgtaattccagcacttcaggaagccgaggcagatggatcacctg

SEQ ID NO: 17021 - DNA, 622 bp, Homo sapiens
gtttttccctcaagaaaaagaaaaaaataaaacaaagcaaaaacctctgcctgagaaccatttaaaccatttgacaaatatttggttaaaacccccacctctgtcaaaaaggcaacagtactgtttattatccaggctggagtacttctgagaatgaaatggggtggtcttgatagttaagctgttttgggcaaatcagggcatttggtaatcctagtcataaagtatttctacatataatcatgctttccataacttttaaactgagccagtggtcacaaactcatttgtatcaaggggctaggaggcaacacaagagtttttaaatttttttttaattttttggagatggaatctcgctctgttgcccaggctggagtgcagtggggtgatcttggctcattgcaacctctgcctccccggttcaagtgattctcctgcctcagcctcctgagtagctgggattacaggcacctgccaccacctggctaattttttgtatttttagtagagacggggttttgccatgttggccaggctggtcttgaactcctgacctctagtgatccacccaccctggcctcccagagagctgggattacaggtgtgagccaccatgcct

SEQ ID NO: 17022 - DNA, 538 bp, Homo sapiens
tgtagtcctgagaatagcttgaacacggaaggcacatgttgcagtgagccgagattgtgccactgcactccagcctgaatgacagagcaacactccgtctcagaaaaataaagagaacaaaaaaagaaatatgttccacatctgctactccctgtccctcctgtgccaccacctggccatgccgccttggcccctccctggagtgttgctggcactgactggtctgcccaccgacttccgcgagcccttcaccttgtcgtaacacagcagccagactgatccttttaccaacatgtcttccttctccttggaagccctcggatgggttcacatcttggaacagaagccaggtgctcttcagtggcacacatatgctgcgtgtgtgtctgccctgcggggacgtcacccatgcaggcacatgagtgtacctcccgttttctgcccagcacactccctggtgcactccaggctcttacacacctgagtgacgggaaggccagcacatttcttctgtagttaacatctagctacttgagtt

SEQ ID NO: 17023 - DNA, 644 bp, Homo sapiens
acacacacacacacacacgcacacacacacacacccttacacatacaatacttcttggcattaaagaagtgcctaagacctaagacttggtaatgcttccattcatacacatctgtgtagcagataatttcctgccataaatacagtagagaacaaacaaaatggtcagcagagtagacagcaacctacttcttgtgatgggaaaactgagctgtccaatacacagacttgagagctcactgagagtttttacacactagccagtcattgggtacagttcaaatttgtgcctgagcaaaaagtacaaatgttttcatactgcagaccttcaggatctcatgtataactggggcggcaaatcttgaatctgtaactgccaagggcctactttccaactctctctctctatctatccatatattatctataatttttcagcttaggtgcagtcaccttttgttttttaaaattcgccatagtttagattaccttaaatggccaattaaagatgatgttttatagattttatgaattttgccaagcacatccctttgagaaaaaccattcttgacatgtgtgtagtcaagccattcacaatacattattttaattggtgggagaacttactgaacttcaaactataa

SEQ ID NO: 17024 - DNA, 633 bp, Homo sapiens
tactggaaattaggcaagcatttgagaacaactacagtaactaattttgaagtagcatttttcttacaagaatcatattctatcttacatatagtgtattatagcttttatagtttcttaacatacttattctttaataatcatttgctcaatggctaatagtttcaaggtgatgtttaaatcaatagttttaaatttaatgcatatttaaattcaacaagaagatttttaaagaatactttattacccagccaaaccaactaagttgaaatcttggagatgaaacgttgaggcattaagctgaaaaaaaaatcagatttaaaaaaggatttttaaactgtccagtggattctaatgcacaccagattaaacatggcacctcacacccaacactggaatgtataaaaatatatttggcaccagattttttcccaagttgctaataattaagtgggtaaaatatccatggtgtattataatgtttaaaagctggctatctgaacagaaagccttcatttgtagcatttgctgattttcatggtgtaaatgcgttcatcatgcccaatttaaagcttacaacatgactcactgtaaatgcagagttgggaagaaatgcaaaacagcacaccatta

SEQ ID NO: 17025 - DNA, 504 bp, Homo sapiens
gacatgtatggttctacatatccatgaacacagaccatctgtgaggttatacgggtcttcctgtaaatgttttataattttctctacaaaggtcttatacatctttgtgttttgtggtttgtagcttgtagtttttgttaccattgtgaatgagacatttaaaataacattttaaattaattataactgtggtgtactttaccttaaatgaatggcaattatattggcaaaggacttctcatgagccataatagaggccaggagacaatgaattcatacttgtagagtgctgacgttaaaaaaatgaccaacttagaatttaatatcctgctagactgtaattcaagggagaaagagaaagaaaaatagagagaaaaggagtaagaatttttaatatacaaaggctaagagagtttaccacctatagattactaagttaattcttcgaggaaaaaaataaagccagtgcaagatgtaggaagcaaaaaccaataggagatttgt

SEQ ID NO: 17026 - DNA, 570 bp, Homo sapiens
atacaagtaatcaatctgcttgtaacaattgttacaaaatcaatttataacaaaatatcaataaggatataaattgaaccacataattaacagaatgaacttaacaactgtaaaacacaaattattttaaacattcacaaagaatgtatcctcaaccaacaggaaggagaaagccatctgggacatatatgctcaactggtggatggggagctagagagagagagagagggacctgtgggccatggtctttattggggtcattacccaagcaggttttcccacaaggcgttctaactgatgggtttaaagcaagttggcaagagttccatggggtcacactgtgactgagaggggctactgtggcatatctgcgcagtccttgggggttaaggggatcagaggggtgagtgaagtaggttgtatctaaccattcatagggaggtggttgtataaggcagataactggatacactgcattaaggaactgtaaggaagtggacaactggaaagtgtgtcaaaggtgactatgtcctgcttctgatatctggtatgagaaagctaaatttata

SEQ ID NO: 17027 - DNA, 559 bp, Homo sapiens
gcaccccacccaggctgggatttcagcccaggcaggctcactgcagaggcctcgcccttcaccactacccaacaggcgaccctctcctgctacttctctcgtaggatctgaaacaaatacagcagaatgttcaggcactatcgcgaggctgggtgatgggggtgtgcgtctctgttatcattttatgaatgcctgggatgcttcggattggaaaaggagataaagggactggcatggaaggaggaggaaggaacaggagtggcgagtggctttctctcttcctctcaggtcccgatcccagaaagagctagaaagcagatgtcgcaagaccccggaacacaggattcttttcctctggaatgcgggtgccctgttcctgcctggcctgaaggtgtgcacgagctcccaagatgaagggttcacgtctgttcatgcctcctccctggctctggtaggtgtggcccaagctctgtgcacgacctacctaccagcagaattagagacaggaggggatgcaactcccgtgaggcttctgcaaaccagtcccgagggtgaattt

SEQ ID NO: 17028 - DNA, 575 bp, Homo sapiens
acgtgccaccacacccagctaatttttgtattttcagcagagacgggatttcaccatgttggccaggatggtctccatctcttgagctcgtgatctgcccacctcccaaagtgttgggattacaggcgtgagccactgcgcccggccaaaagaatcctgtgcctcagcctcctgagtagctgggattatagacacgagccaccacgcctggcccccaaaggtatttaaaggaaaaggtatttctgtcaggatttaaggattctgatcctgagtagtagcaattccatctgctacattccagcctaagtgagtgggcaaaaagagactacgcttaacatcagaatgaaagccaaagtccttacaatggcctacaaaagacctatataatcttactccactacctccttctgctccttaaatgtgatgagtatgctcccaactcgggcctttgtatttatcttccagcccagtggttcccaaactttacagtacattgaaattttcctggctgggcctggtggctcatgcttgtaatcccagcactttggggggctgggcggatcacgagatcaaga

SEQ ID NO: 17029 - DNA, 541 bp, Homo sapiens
aagtggtttctgaaggctgtcagtaggccttttctggattctgatatggtatgcgtctaaaatatgtttctgtaagtaaggattttttaaagtatatactttgcaaaaaaaatactccaatcaacaataagaacaactatagggtacttagagtttagaacataaaagtcattcatatgttttctaaccatttaaaaaatcagtttcctgtattttgattccattcatttatctagcacttatcaggaaattcaggtttccatgttacacagtttatatgggcccttataaatcagtataccactttgatggaaaaaatttccaaactaaatcatcaaattttaaagtcttggtaaaaagatttttgaatcttattttagtttttcttggcaactttggtgtaacagttggctataagaagggctataagatgttaggattgctattcctgctttaaatagttccagattggcaattttggggcaattctagcggtcacctattcccttatttcctaagctgggaagaatggaattttctt

SEQ ID NO: 17030 - DNA, 662 bp, Homo sapiens
ggacatggacaccctacaggggccattgaaaaggcagacaaaccagcaaaaagtcaatccttgaaagataaagttgtgctaagattaatagctgctttatatttacgtatgtatgtatgtatgtatgtatgtatgcatgcatgtattttgagtacattccctaacctcagaagtaggtatcagagtaaagagttttggattggccaggcacggtggctcactcctgtaatcccagcactttgggaggccgaggcaggtggatcacttgaggtcaggagttcgagaccagcgtggccaacatggtgaaaccctgtctctaataaaaatacaaaaattagccaggtgtggtggcacgcgcctgtagccccagctactctggcggctgaggcaggagaatcgcttgaacctgggaggtggaggctgcagtgagctgagatcgcaccactgcattccagcctgggcaacaaaagtgaaactccatctcaaataaagcaaaacagttttggattgatagagcagctggagaaataggggaaccttcagggtgggtatatccaaaaatctcagtataagctctccagttccttggctgactgctaagctccatgggcacaaaaggagaccaggctagaaaagcagcaactggaagttataaaaactga

SEQ ID NO: 17031 - DNA, 652 bp, Homo sapiens
catgttagtaattctaaatctcagcgatccctgttgttccataacagtaccactgctggaaactttagcttatagtattgggtcaaaaggagaatgctgggtgcttcaaaataaaagagaagtttgcagtgattgtcattttatagccaagatgagacttaaagacttcctcaaagtagatactcaataagcatactttatttttattactgcactcacattaggttttataatactgtgatatttacaatgtatatttccaaaaataattttatgtgttttatttcatatacttctgagaatttctctgaaatatagaggcagatattattaggttggtgcaaaggtaattgtggtttctgcttttaaaggtaatggcaaatattacatttacttttgcaccaacctaatacatattcttcttagattttcttagtcccttattcatcctcctttagtatagagccaaatcatagccatagacatatccttatcacttaatcacatgatcagttagattgtaatgaaaaactcaagtaaataaatgtaattgagtacactaactcatagaaagaaatgttttgattaaggtcacactattttttaagaactaaaaaagccagacgttgattccagaagtacagacaccagc

SEQ ID NO: 17032 - DNA, 538 bp, Homo sapiens
gatttcatgtttttgaaagatgaaggcaagatttcaatttctatcatggctcattctgctttctagggacatccatcttttaagccatcagatcatgctgtttctgtttgaagtccatctcaggtactgcttgacatgtacagatgctgaagcactgcccctttctaagggagggggaaagttcttatcaggtactctgccttagcagctccccttgccttcccaacctggaccatccttgccttattctcatcttcatgcttgtctcctggctaatctcaattccattttgtgttcatgttcgactggtgttatgatcctgatatttgcaagaaaagaagattaatctacactataaactctatgtgagtaggagcaaggtctgtttgtatttattattgtataccattaccattaccattaccattacctagcagtacctgttacatagttggtaagcaaaaaggtaaaaaaaaccagacaacaatgggccgggcacggtggctcacgcctgtgatcatgaggtcaggagatcgag

SEQ ID NO: 17033 - DNA, 655 bp, Homo sapiens
cactggtttcactagtagtctattcatcatttaatgagatttaccacttttaatgtctagaacagagactaatcacatagtatttaatggtcttcagaaaatatctattaaattattgaattttcatctaccaagccaactgttcttgaggtcattttctcaggaaataaaaacaaattacgcacaagaaaatacttaaagcatcagatggaatgtgggttcctcaaaaaagtccactctcctttttcatggcatgatacattcctttcactaagctctctggtactacctaagaacatgagcacacagagaaaattaaattcttatttaaactcaagaagcaaacatttctcaaaatgacactatttccctcctttacacttgagtcgtaaacatttctctacatgccagtgcccttttatttagttagaattttagcaagcagtattttgtttatttgttcaggatcgtgtatgttttttcactacatctacagtacacttcatcacctgaacacatgctgaaccaaacttgtcttgccagcaaaaaattttgaaattatgcaatctgcaattcagtccatgacaagcacctgggtagaatttcttctataccatttcaacatcaattaaagaactgcctgcatagaaatatt

SEQ ID NO: 17034 - DNA, 621 bp, Homo sapiens
agtttttctattagtagaaagtagaaataaaaaaaaattgaactaaacaataaaattccaaagccccaaaaagcccaaatacactcacaattgttttctctctttgtaggatatgttttataaccgaaattcttgcaatccttgtagaattttgtaaacagtacaatgagaattcctttgtgccaagactcttattgtgtataatactgccactgagcaagtgcagtgatattttaggctaaagcacatttgtgacatttgtgtgtgtgtgtgtgtgtatgtgggtgggtgggtaatatactcatgtttacctgcatcactccattttaaagtaaggtttgtaattagttgtttccagagctttgaaaaggagaaatattgcaatatagaccaacaaaccttattgaagaaatacatctgtgctctatacagtcagaaataaaaaaatctgaaagttctaaagtagatacattttatacttttgaaaaaaattatagctgaatgaatttttgtcacatgaagttttacttaagtgacacgtgggtgatttcaggtgactgaaaacgagtgcttatttgactttgtctaaaagaagtaggcattgtttaaaagcttgtcttt

SEQ ID NO: 17035 - DNA, 601 bp, Homo sapiens
ttaattaaatctctgtattaagtatgcagtaaaatgtgctgctttatcaaattaagtcatccgccagaaaaaaaggccatgttgacaatgttttatagattcaactaccatttaactattcattcatttaatgtgtttatttaaaaaaaaaaaatctgccagacatttggctcatgcctgtggccttagctacttatgacgtcgagatgagaggatctcttgagcctaacagttcaaggcgcagtgagccatgattgtacccctacgctccagcctaggtgtcagagtgacatttcatctctgaaaaaaaaaaactttttttcctaccttggcacaaggccagtgctacaagcagcagtcacacagtcccatgcctgacatgtgccctatgcacgccgaccccacccacttaggcaggctgcaggccctgtgctaattgaaaaagcaggtggagagctggtaacatcaagcacagggacagatttcattgtgacatcaccaacagacagcaccccgctgaggtggtactcacagccgatagccatccagctgtacattactcacaacaggtaacccacccacccaccaaaccaggccctac

SEQ ID NO: 17036 - DNA, 668 bp, Homo sapiens
gtggctcacgcctgtaatcccagcaccttgggaggctgaggcaggtggatcacttgaggtcaggagtttgagaccagcctggccaacatggtgaaaccccatctctactaaaaatacaaaaattagctgggtgtggtggcaggcgcctgtaatcccagctactcgggaggctgaggaaggagaattacttgaacccgggaggcagaggatgcagtgagccgagatcgtgccactgcactccagcctgggtgacagagtgagactccgcctaaaacaacaacaaaaaagaatgtgatgcctcagtatagagcatttgggaacccggttaggatggaaggcgagggctgggtaaagtctcttttgctgactgtgacaagtggccgttacaaatactggtgtattgcaaaacttcatgaggattgatttacagcatgtgccgtctttgtaaatggctttacatccgggttgtgctttcatgttccaagaaaacaacttaatctcttagttaatgaaaagtggaaggccgggcatggtggcaggcgcctgtaatcccagctactcaggaggctgaggcaggagaattgcttgaacctgggaggcggaggttgcagtgagccgagatcgcaccattgcactccagcctgggcaacagagtgagactccatctc

SEQ ID NO: 17037 - DNA, 665 bp, Homo sapiens
gaaaggcttgagcccaaggtacaataatggcagagggaaatctaacgttccaggttgtttgtattgctgctctctaaacaactctgctgcagacacatacaaacacacacacacacccctcacatacctcttctgtaaatattatttgtttttaatctaattattttttattttgtgggctttaaagaaaagggaggacttccatgtttccattactgcagggtggtgaagggtggagagtggacacagaactggcagaaaatgcctaagccaaatggcttcaaatgaagcaatgaccacaagagcattaaggaatttggaaattttttacaacccatggaattcatgtaacagctagacatgtgtgaatgttttatagtttcaaacttactctatcctaaaatgttcttgatttaatatattatcattttagtgccagtgcaacctcaatttaatatattatcattttattttatatattatcattgtattttaatgccagtgcaaactccctgtcaatttataaagatactcctcagcattcaataatttcctgataaattataatcgacatgctccaatttaatacatatactcttcctcagcatttcttaaaaaataaaccagcctggtgtggtggctcacagctgtaatcccaacatttc

SEQ ID NO: 17038 - DNA, 538 bp, Homo sapiens
cctgtaatcccaacactttgggaggccaaagcaggtggatcacttgaggtcaggagttcgagaccagcctggccgatatggtgaaaccccgtctctactaaaaatacaaaaattcgccgggtatagtggcgtgcaccggtagtcccagctactatggaggctgaggcaggagaatcgcttgaacccaggaggcggaggctgcagtaagctgagatcatgccattgcacaccaacctgggcaacgcagtgagactccatctcaaataaataaataaaatagcacatgtatcccacaaataattattaagtatcaatttttaaaagcagagatgtaaagataaatgattcttctaaaaaaagtataaataaatctttagtttaaatgatatatttgccatctgtgctagatgacaggacaatcaaacagatttacatctggctggacaccattgcctaaagaatattgatcaacccaagctaaacttttgtctctggcgaggtatctccactgaaatcctagcctactcaatagtgacct

SEQ ID NO: 17039 - DNA, 596 bp, Homo sapiens
ggctaaatcttcatcaacactattgacaaacatggagcttactttagtggcatcactcttttttgtgagacaagaattttctttgaatatacctctagtctattataataatcatgagctcatttgccctctctgagtgccaccctgaattatattctaaaccactggctttagtaaagctgtgggaatagctttaattatttcgtcagcaaatttttaagttttttttgtatcttggggaagatttaaatttaaatcatcagaaggattttttcatcttgctatttttgcccaatagcttgctcattgtagccctacaagcaaagctattagccagtataaatcagaaaatccagggacataagttatgcgcaccattgtgaattcctcagcaaatcttagggtttcctcagtcaccctgggaaattatttggctatcatgcccaactcgaaataaaactagaaggtgtaagataccacctaccaccggtaaattccctttgttgtttgagcagtatttaaaaagatatgcgagaattagagcaggagtaggaaaggccactgtgggggattgtcaatttaggggtttgtagaac

SEQ ID NO: 17040 - DNA, 578 bp, Homo sapiens
gatatcatttttttctgactctgatttaaaaatctctgtttaccaagatgtttcctggtatgtggtagtgaatataagtgtatttaaaatttcgaacagcgaacttacaaaagaataatcagaataaacttatttttgacttgcaaactttctgtttagtttttatagtaaatcagtaactctagctatttttagaagtcattccagtttgatccctatgttttatttccatttcttgtcattttttatgagttgttatgtttgtttttatagaagaagaataatatgtattatgtgaaagtaatagccaaactttaatttcattggtgtttcttaaaaatttctattaaatcgagtacagcatggattagaaaaataaagccagaaatcaatatcagaagtttaaagaagattgtaattagtaatttgcctgagttacagtcaaggataaagctaaaagtctcagagtaaatgcaatcacagtaagaaagataagggaaggccgggcgcggtggctcacgcctgtaatcccagcactttgggaggcggaggcaggcggatgacaaggtcaggagatc

SEQ ID NO: 17041 - DNA, 535 bp, Homo sapiens
taatcacaagacattaccattgacaggaccaggtgttgcatcaagaaatctgggggttaaagtaaattttgattttaatgtgtgtgtgtgtgtgtgtgtgtgtgtgtaagaaaaattactttcatctccttaaaaaaataataaagtggtaagtagagatgatctgtgcatgtgtgttatgtatatcaagtattaatcatagcatatataccagaatgcatgtgcttagtaaatgcttatacaaaagctgagtcatatatgatagcacctcaatcctagctttgttctttcaacaacgaaataacactatttctttgcttcattagctttctgagatgagtagtcttatacattaaatccctctaatagtccgaatggttttcaacagtttaatcactcattctattaaatgttaagcatacatccccaaatatgttcatagattttaaattattaactatgtacatatatcctgtagtgatcgaaggcaccaactctggagttagattgccttgatttaactcaagcttcagcc

SEQ ID NO: 17042 - DNA, 393 bp, Homo sapiens
gagatctgattaataaaattttaaagcaaattctaacacacaaacaaaaaactaacatagaagctaaataaatagtgatttatcacaccaagcactgtacctcattgtagtttataacataatataaccgtggagggcactgtcattggtcataccagacagactcactaccactcacaatcttctgggaatgtttaaaaaatgtcatatttacattaatattatcaaatctttaataaaaggtaatagaatgtaaaacttgcttggccaagggttctcccactagcactatgataccatggtccactcctacacgctgcatcagtgattaccctatgacttggcagctaaaaggcctatatgtttatagactttaccccagagatcatcctt

SEQ ID NO: 17043 - DNA, 602 bp, Homo sapiens
gaggcactaggttcagtgtacagaactgatattaataaacttccttatccagaacttgtgcaatagccgagcatagtggctcacgcctgtaattccaacactttgggaggccacggcaggcagattgcttgagcccaggagttcgagaccagcctgggcaacatggtgaaggcccatctctacagaactacaaaaattagccaggagtggtggtgcacgcctgtggtcccagctactaaggaggctgaggtgggaggatctcttcagtctaggaagtcgaggctgcagtgagccatgattgcaacactgcactccagcctgggcaaaagagtgagaccctgtctccaataaaaaaaaacaaaacaaaaaagagaacctgtgcattttaacattatctccaactatggaattcattcaatcaccaacttttattaaccatcaagcagggagggaagatatgaacagaaatacagtcagggctttacgacagggatacatctgggaaatgcatcattaggcagttttgttgtgtgaacatgatagagtgcactcacagaatcctagatggtacagcctacagcctacaacacaaacaggctacg

SEQ ID NO: 17044 - DNA, 480 bp, Homo sapiens
acagttggagaatatttgtcagaaatggggaggttgttgtaattgagttgccagaattacagagtttccattttcagatatcacagttgaatcacctctgtagattgttataaagagaggcattttaagatagtattttatttgctaggttgtgtctcagtctaagaattgggaaaagaagagctataggtttctctttcctagtctggatttcagtaaacacaagcctacctctgcttctttggttcacagcagtgtggatcatgaaatgaactgtttacccacattcatcaatattggtattttacaaatctacttggagcatttaatttcatctcaaagattgtgatccactttagataagcacaaatacagtattaggaaaagtaaatatgcaatcttactaaaatttcaacttgttaagctgtatatcttaaaagaaattatttggggctgggcatggtggctcacacctgtaat

SEQ ID NO: 17045 - DNA, 456 bp, Homo sapiens
gtgttaaagtcatatcatatgttcatttaaattacacaaatttatccagacattcagtcaaataaaagagagaaagaatatttagcaatagcaagtgcagtagtgctggcaattctgcttacactccgtttattgaatgtatgccccacagtgagcagtagtgagctgagaattgagaatccactatttctttagtcagtcttagtttctgcatgccttctgtgtgtctctttgaactgagggagactctagtgtgtgtgcgtgcgtgtgtgtgtgtgtgtgtaaaacactaccctaaattcaagccaacagcttcatctgtggtttaaccgaaaaactagtggtccactccaatgctggaggaatacctggctgtgtgggtgtgttgacagactgtgtgcctgtctctggctacctttttaaagacatttcaagagtaatcttgaaaaaaaaatt

SEQ ID NO: 17046 - DNA, 643 bp, Homo sapiens
tcagtggggctgcctctggggctctcagtctatgggggctgcatctgagagtcaatcaacaggggctacatctgaaacttaatcaatgggagctgcctctgagactctcaatcaatggggactgcatgtgaagctctcaatcagtggaggctgcacctggggatctcaaccaataggggctgcatctgagactcaatcaatggggctgcatctgagactcaatcagtggaggccgcatctgagactctaatcaatggaggccgcatctgagactcaaaacggtgtgggagtgcacggcaaatctggcctttggtgccctctggtgggcattgcatgccctgctgaccagtctgaggacagagatgagggaaagaaatcagggtagcgtggggctgtccagggttttccccaccgacatggatgacagggtgaccctgaagaagtcactcttttctcttagcctcggcttcctaatctgcaaagatggtgacagatacattccatttcaaaaggctgccagggtctaggcgtagctgctcatgcctgtaatatcaggtgcactttgggaggctgagggaggaggatcacttgagcccaggagtttaagaccagcctgggcaagatagtgagacccccatcgcta

SEQ ID NO: 17047 - DNA, 501 bp, Homo sapiens
attttaacatggaggaccgatccatatattgaaatccaattcttctactctttaaactcagctcaagcttcattccttctattaagtctgtaacccaaatgaatcagaccttttgctgcatcctcattgtacctgtgtgcacagaccacaactgcaccacctatatactacatacttgaggcatacatttatcatcactcctctgggtttcttccttatgagactgtaataatgtaggggaaaggcagacctggcccctgtctttatacccccagaacctagcacagaggctggtaggagtaaatgataagaaaattatactcaaggacgggtgcggtggctcatgcctataaacctaggactttgggaggccgaggtgggcagatcacctgaggtcgggagttccagaccagactgaccaacatggagaaagcccatctctactaaaaatacaaaattagccaggcatgggtggtgcacgcctgtaatcccagctactcg

SEQ ID NO: 17048 - DNA, 475 bp, Homo sapiens
atgataaagccccatctctgttaaaaatacaaaaattagccaggtatgatggcgcatgcctgtaatacaagctgcttgggaggctgaggcacaataatcgcttgaacccgggaagcagaggttgcagtgagccaatatcataccattgtaccacacctgggcacagattgagactctgtctcaaaaagaaatatgtgtgtgtgtgtgtgtgtgagtgtgtgtgtgtatatatatatatatagatagatagatatttcatatccttacctcactcttaagtgaaatctaaagtcttcaacatgatccgttaggcctatgtggtctggctctgcctcagtctacagccacccgcctttgctagataggtcgaggatccttaaccttaaaatccaaaatccaaaattcttcaaaattcaaaacattttgaatgctgacatgacatcataaatagaaaattccacacttgaccttatat

SEQ ID NO: 17049 - DNA, 431 bp, Homo sapiens
agtatgaaaaatgaaccctaaaggtgatcacatttcttacttgtaaatgtaacaggtattttcagccttagaaaagaaagtcaaaacagtttgtcagctccagttctgctctatgcctctccccttgagacttccttttctcctgggagcctttcatttaagtttaatattagagaaaagaaaaaaaaaactgtaggatgattcaaggaaattcaaataacaaacaaaattaaaggttcaactttgtttaacaactaaaagtcctcacacctgtaatcccagcactttgggaggctgaggtgggtggatcatgaggtcaggagtttgagaccaacctggccaatacggtgaaaccccgtctctactaaaaatacaaaaatcagccgggcgtggtggcacacacctgtagtcccagctacttgggaggctga

SEQ ID NO: 17050 - DNA, 481 bp, Homo sapiens
acatgtttgtgaggttcatctctggccaattcattttatatttgcaacaatattaagaacttcaaatactgaaatgctacatacatgaagttccacatgacagaaatcagaagctctcactataaactgtcaaaattcatttctagtttaatcccttcattatgtttaccaacacaactcttctggaggttaagtgacatttggaggcacagaaaatgaaggacaaagtttttcttctacagaaacaagtggtagcctctgttctaatatctgcaccctggggcaaaagcagtggggaagcctgtcggacttcaatctgcccacctcttcatatgacctcatgtttgagctgatctgacatgctagcagttctagagaagtcactcctgcaaagtaagccaggctagtactccaacctttcaacccttagatagttgttgctgccttcatccaactgaagttgaccacgtgtgagtgaaag

SEQ ID NO: 17051 - DNA, 442 bp, Homo sapiens
ggaggaggaggaaggtcaggggttatgggaggcaaccctctgactttggttggagctatttctccagcgcccagggaacccccagccttctcatggaggcattattcaggccactctcctttagccacacttctggccactgtgggttgccacaagtacctcaaagacagggactgggccctcaggaagatggccccagtgttcccagtctcactcagtcagggtctatttcacgaattaccatcatatcaggaaaccttttgtactgtactaatgcaatatacgtttttgttagctcactttgaactttaaatttacttaaaaggaaactttatttcactaccatcccaaggaactatatccatgaaatcactggtttgaccttctaattggggctttttctaatccttatgaaaataaaggtattttaaaaaaaaaaaaa

SEQ ID NO: 17052 - DNA, 299 bp, Homo sapiens
atagctgactgctagactattacgacatttagtagtgaatataaattaaatgtgtttaaaaattctatgaaacaccataaaacaatgcactttttaaagtcacaactgaaataaaacaatttgctacaaattttcatggagttgatacgtgatgtcttagcttcagaaattatcttagtgttcttataggccaaggaataagtaagttatgtttacacttgtctatacaatttaaatgtaaacctctttaaagtgacatttccatgtaatcgtctcaaaaaaaaaaaaaaaaaaaaaaa

SEQ ID NO: 17053 - DNA, 367 bp, Homo sapiens
ctttagcaactaacacacatagcagctgaggactggcttcaccagcctcctaaagagaatctgagcaagaaaccacagcatccaccaaacaggctgagtgtggaattaaaaggaaagaaatgaagaagaagaaaaagaaaggcatgatgtctaaacatggaagaaatgtgaggggaaaaaaagaaaatacaaggcagttttttatttccaagggctaacagaagatatccttaaagacaacatgcataatacatttagatgtgaaagaaacaaaatttaaatgaatgagaaaggaatagttaggttaagcttcttggtgaaagggatggtttagtcaccatggtttacaacgaccctgctgggcact

SEQ ID NO: 17054 - DNA, 446 bp, Homo sapiens
aaacattagagacaatcctattaaagttaggaataagataattatgcatgctattaatgttgttatttagcattgaactgaaaagctctagccagtgtaataagacaagaaatattaatattgaggagaaaaaaatatcattatttgcaaaattattgtctacctgaaaataaccctaataaataaaatgtacttacaaatcagtgaagaaatgaatacaccaatagaaaaatgagcaaaagacataattgagcaattcacaaaggaagaaaaacaaatggtcaaacaaaacaaaagtaaatagtccatattgggctgggcacagtggctcacgcctgtaatcccagcactttgggaggctgaggtgggcggatcatgaggtcaggagttcaagactagcctggccaacatggtgaaactctgtctctaataaaaatacaaaaatc

SEQ ID NO: 17055 - DNA, 220 bp, Homo sapiens
agatgtggctatcaagacttgaaaagtaacaattgcaccagaggaactgaaatttcaacctaattttaattaatttaaatgttaacttttagtagccacatctgactaatgccgatcacagctctgtactattcagtcattatgccttggagcttccttatctatacttagtcccttacaaattacattaattttcataccttttaagggacgaagtata

SEQ ID NO: 17056 - DNA, 298 bp, Homo sapiens
gagacggagtttctccatgttggtcaggctggtctcaaactcccgacctcaggtgatccacccacctcagcctcccaaagtgctgggattctgattatcattcttgaaattcagtaacttcaccaaaatatgtcttaaaggtgaagacatcactataagactataggacagaatgtactttcagtctaaagatacaaggttctctttattttagaatatatgtgtggtggtggaggtgattaaaaaactaaggagttggccgggcatggtggctcacatctgtaatcccagcactttg

SEQ ID NO: 17057 - DNA, 409 bp, Homo sapiens
tacgggaacatctggtcaggattcagacttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatg

SEQ ID NO: 17058 - DNA, 467 bp, Homo sapiens
atttctcattctagctgaagatgcatttcagcatagcacgtgtgaaaaggaactgtgtaggtaggtagtcatcttttcagtagtcatcttattaacatttattgaatatctgctgtgtaggtaggctctgaggatattgagacaattaagaaacagttcctactcttgttgatttctcattctagcagaagatgcatttcagcatagcacgtgtgaaaaggaactatagcaggagcacgtacaaaggtctatgagtgctctggggaaggaataattaattctctctaagtgcatccagaagggcttttcaaacacattacacttcagcagcaccttggaaagtgcataggagtgtttcaggtattctgtcttcaagagacccatctcacatgcaatgacatccataggctcaaagtaaagggatggagaaagatctctcaagcaaacaggaaaaaaaaaaaaaaaaa

SEQ ID NO: 17059 - DNA, 559 bp, Homo sapiens
ctattcggttcagcttagggggtaacagggcaaattttttttcttctttgggacttgaagtatggtgttttataattcactgagtgattacagagtgcccagaactttatgtaaattatttttgtttctcataactcatctgtgtagtagatattagtgttcccattacatagatgaggaaatagaagctcagcaacaaaaagtaattcatagctggtaacagaatttgaactcatgtttttctgtctctaaaatctacaatcttttcgctactcaaaggtgctaaagctcccctgtttcctccatatttaactttctttaaatcattattttattctggtttaaagaattgggtcgggcctagtggctcacacttgtaatcccagcactttgggaggccgaggtgggtggatcacctgaggtcgggaattcgagaccagcctgaccaatatggtgaaaccccatctctactaaaagcacaaaaattagctgggcatgatgacatacacctgtaatcccagctacctgggaggctgagacaggagaattgcttgaatct

SEQ ID NO: 17060 - DNA, 312 bp, Homo sapiens
attccctcacacccggccccactctccttttttctcttcccacctacttggtgaataaaacgataaaagcatatttggaaaataatggtgacatgtcaaaaataatttgtttcttatttatctcctctcagacactgccaataagaaaccattgccactccatccccagcccactctgctgtaagttggaagcagatgatttgctctcctgaaagagcagcaaatccgttgcctgggtgatatctcattactaaggcaaccaatttggcgcatcagtgtgaatcccaaaaaaaaaaaaaaaaaaaaaaaaaa

SEQ ID NO: 17061 - DNA, 467 bp, Homo sapiens
atgtaggagacaggtattatctacattttggggatgagaaaaccgatgtatggaaagtaacacatctaaactacagtgtcctagcccgaattcaaatccagctgtgcctccagccacagctcatgcttttgaccactgcgctctgagtagcagcacatacacagcagagaaggcacttgatcggatgcttttgatgccagctctaagagcatccagttctacacagatcagaaatagacacacaggtcctctggttatttaactgaattcagtccatttggggcgtaatttttgtttggcttcattttactaagttcagccaaactgatttatatgaagcctccaattatcttttcagtacaccaatgccaaaaattttgttagggaaacattcttctcctttctccctctcagggagagatgattaagaaaaatcaagttctagtggcagctgggtcttagagaga

SEQ ID NO: 17062 - DNA, 540 bp, Homo sapiens
tacctggtggggatgtatatcctggaggcagtctctccccctgtcacactctgaggacttacaatttttcacctggctcacagtgggtgtaggctgcagcctgctgcttctttcaaagggtctatggtttctgtttttctgttcagttcctgcattgcttcttagaaaaaagttcacagtatgaatttctactcaccattttgtctttccaagtgggagagtcatgctgacactgtttccaatccaccatcttgggaagaaaaacaaaacaaaatgtgatttttcttagcctatccacatggtagtttagattgattgattttcaaatatttaaacagccatgcatgcctgtaataaaccctacttgtaatcatttattactttatttaaatgtgatctcttttctttgaaatatatttaaaatagtctttgctaaatctattgtttgggattactcaaagatgatttctgttgacttgtttcctaagtaaagaacacactgctggccaggtgcagtggctcatgcctataatcccagca

SEQ ID NO: 17063 - DNA, 579 bp, Homo sapiens
gagtgagggaagggaacttagagaatgggttaataggtgcagcaaaccaccatggcaccatatacctatgtaacaaacctgcatgttctgaacatgcatccaggtttgtttcctttttttttagaataaaaaaaaatcttttccccttccttcctcattttctcttccaccattctactcccctgccacaattattaacttccacatgacacatgtctagcacaatcctttaatatatcatcgagccatcaaaatcaaaatgattcctatttaaattacataaacaaaaatccatctgtataaacaagtgtgtttctgcttcttgcaggtggggatagcatctttttcgtctttatatttccaatcccatcacctagttgctcaataaacctttgttgagttcagctgactggcattattcattatacagaagggtttcttacgagtaatgttatctcttctagtgaacttataatttgtaaaaatgtatatagtcatattaactaatatcttatgaaaaaaagcttttacccataattttcttcacaccaataataaaagctcataatatctcgctag

SEQ ID NO: 17064 - DNA, 433 bp, Homo sapiens
gagactggagggaaggaggagtacatttaaaaaatcattttccgggctcccttcctgtggagtccccgtgggctggccacagcccttgacccagcctcagctccgtcagtaaatctctccaggtcccctgtctgcaccgcttcaaatttagggtggcaacagtccccagtgttcctagccccagggtactaaatcattccttccctgttgcttttcttaatccctgtttatacctttgtaaataatctcattgctaaactctcctcaattactcaacttgagtgtgtcatctgtttcctgctggtactggaatgatacctatggagtctggaaatacttctccacccagagaaaaaacaacagctcacatgcacctgcaaataggacttcagtgcgtctcagattcctgaggcggtagggaagggtagagagt

SEQ ID NO: 17065 - DNA, 163 bp, Homo sapiens
aaccaagagttttcagttttggacaaaatggtgaactaacacagactgctggttccccaaactaagcttggagaaaatgacagaggaagacatgaaatccatgaaatatgaaataataacttaaaaagaaactctcccctaaaactcctattgacggtggggg

SEQ ID NO: 17066 - DNA, 295 bp, Homo sapiens
agaacagttaatggagacgtactctactactttgttgttgaccactggctatttggggaacagtgtcaggtggatttggcatggctattaaaataatcaacttaaataaaaaaatacatcccaatataattcccttgtagttcttttagttggatttgaaactgttccacaactgaaatttggaaaatcaagttatattgaaggtggagggaggaatggttggctgaatttaaatgacagatttaattgttttgttttgttggagaatactgtctataaatgtctaagaatttgg

SEQ ID NO: 17067 - DNA, 114 bp, Homo sapiens
gtgggtgattaagatctgtaatataatatctatgtagactaaaaaccatacatacataaaacttgacatcttttcaaacctacatttatatatataaatatatcatgtatattt

SEQ ID NO: 17068 - DNA, 493 bp, Homo sapiens
tgccacctccgcctcccgggtttaagtgattctcccgcctccgcctccggagtagctgggatgcgccaccacgcccagctaatttttgtatttttagtacagactaattttagggcttcaccatgttggtcaggatggtctccatctctttaaaagtgaatgaggaacttccttgagaggagacgctgcactgattttatggagactcaactcctgaccactgggatgggccattcccttctagctggggctgttttaactgctcccttcgagggcaggcatcagctgagtttggtccggatttcctttctggtttttggttcttgcgaaagtgcttttcttgtgtaaatagttgttaaattggtgtccttgctggagagacgatctgtggagcattctgcgccgccatcttgctttgcctcccacctcagcattgcttttaatggcctcggtggcagctgggattttatccctgccacgtgagatggatatt

SEQ ID NO: 17069 - DNA, 655 bp, Homo sapiens
cacaacacctgaagaagggatgaagctggtcagaggcaaataagtgaagtggagtaaggatggggtagatacaaaaatggagtgggcaaaggaaacaatatttgcaaagacctgcaagtaagatagcaaggcaacagcagggcaagattgaggaattcaataaagctccaaattaagagtctggcactgacagagtagtttgtatcagaccaaccctcagcaagtaaaaattataaataaacaaaacacaaatacaaaagcaactatctaaatgtactggaaatgaccaaaagaagcagaaatcaggagactgagcccttaaaaagacagaacaacattaggtgagatccatatttaaatatggcttttcccttcaaacgcatgcccatgttgtgcacttctgggatagctagaactcaagtcaaatgctgcagtcttactgtcttgaagtaacatggagttctggcctatgagagcagctggaaattgaggagacatccccaaaaggagaaagccagatcccgaaaatctgggcataaatgttctcaaatcctcagctgatccctaaaatgtacatacacagggaagaatacaaacagaccagcagaaaacaaagctggaaggcagaaagagttaaatagatacctcagcaact

SEQ ID NO: 17070 - DNA, 653 bp, Homo sapiens
attgtaacacaatgctaagtgtccatcctgttatctggtgttcttattagcgtttgcatgatcatattaaattaaaaataaaaataaggaattctgggaagatggtggcagagctttctaccttttacaaatttgtaaacaaaatagagcactagtggccaaccaaaaacacatggatgacatttacaacaaaactaattacaaggtattcccagaaacctcaaaacaaaaatggcaaagacaaaccaacaacagccacaagacctttagagtatcagtgtctatgtggaagaatgcagagggaactaatggggtatttgacagactagagaataggagcatcctcaaagagcaaacaggtgttaactggaaagtgcagcagaccaatctgggaacagtcactgaaatcgggaggggttttgtcctctcttatcatggacgagcacaggctgcctggggtaaggtctcaagggcctggaggagactcccatggatgctctgaaattgtacctttcaggataggctcccacactgagaagcaactgctgggaatagaaattgaattgagcagagcagggccaataaagatgaaggaaggagaaggtccagatgaaaaagctggaggggcacagagccagcacatctcaaaaagc

SEQ ID NO: 17071 - DNA, 562 bp, Homo sapiens
agtgagccatgatggcgtcatcgcactccagcagcctgggagacagcaagaccctgtctcttgaaaaaaaaaggcataaaatatgtattgtttattgatacacaaaaaaatccaagactaagagcacttattactcacataacatgattctaagtactttccatgtttaaacaaatataaactttaaaaacagatcaaatgatacaagatatagtcagccctctgtatccatggtttctgcatctgtggattcaatcaaccttagattgaaaaatactggggccaggtatggtagctcaggcctgtaatcttagcactttgggagtcggagacaggtggatcacctgagatcaggagtttgagaccagcccggccaatatggtgaaaccccatgtctactaaaaatccaaaaattagccaggtgtggtggcagacgcctataatcccagctactcgggaggctgaggcaggagcatctcttgaacctgggaggtggaggttgcagtgagcctagacagcgctgtcgtactccagcctgggtgacagagtgagactccatctc

SEQ ID NO: 17072 - DNA, 522 bp, Homo sapiens
tttgagtagatgctgaaggagacggaaaagccaccgactaaaaatagtaaagcgaaggtgttctaatgttcctgagaagacttaatagtatccttcagagaatccttttgtaaagtgaatggccgctccctccttttatcagttttgagatctagattgggtgtgcttaaaatgaatccatattaattgctagattacaatgtgaattcctatgtctctatatgtctgatacaaatatcattgtcattcaaaatgatttataaccttcacttgtagctgcaattatctccataccatatattctatatataacagtgacctaaatatactgtctaaaaagataatatgatacgttctcctttaagcttagcatttaaatatactaacaaaattatattgcatattaaattaacacttaaaatttcagattcacattcaattctgtttttgaacataaagcaaagcccttatattttgaaagtttctaaatctcaatcttagaaactttcaaaacataagggc

SEQ ID NO: 17073 - DNA, 648 bp, Homo sapiens
acttgacaaatgaagatagggacctctttcattataagcctattttaggctaaaatagaagggaaggggacacagtgaatccaggccttctggcatggctcctcagccctttctgagctggcctgggacagccttcctacctcactgatgccacttcctactgagcgactttcctgcctacctcactgatgccacttcctactgagcgactttcctgggctccagacccagtaagcgactttgcctgcacccaccttattttgctctactccctgtgcttttatgcctttacccatctgccctggaaagctcttctaacctttgaatgggtaaaggcataaatgtatgctggagaaatcctcagctcagggccaggcacgctggctcacgcctgtaatcccagcactttgggaggccgaggtgggtagatcacctgaggtcgggagttggagaccagcctgaccaacatggagaaacccctgtctctactaaaaatacaaaattagctgggcgtgatggcacatgcctgtaatcccacagctactcgggaggctgaggcaggagaattgcttgaacctgggaggcggaggttgcagtgagccaagattgcgcctctgcactccagcctgggcgacagagctagactct

SEQ ID NO: 17074 - DNA, 199 bp, Homo sapiens
ctggttcttttctgcctggctactgggtctctaatgcagtacttttccctgctcctcagtttgcttgtatgcctatatccctgataaaagtgtatgaattattcaactagtcttttcctgccttcccacccactttatccccttctagagctgctagtaatcccagaacgaatggggtcctagtaggggaagacatatc

SEQ ID NO: 17075 - DNA, 517 bp, Homo sapiens
gagcttccaatggcatccctttagaatggggcctcctgagcccatgctgtgctcgtcagatagcaacatgggaaatacaacagcccagaatgcaggctgcagagttagatccccagaacaggatctcagctggctccatccttcctcagctgggcaaccgtggccaatgactagctttctgtgcctgagttgctccatctgggaattgaagattgtcatagtccctgcttcaaagagtcactgggaggattaactgagaaagtgcagggaaggtgcttggaactaaatgctcaaaaaaagtccatctggccaggtgcggtgtctcacaccagtaatcccagcactttgggagaccaaggcaggcggatcacttgaggtcaggaatttaagaccagcctgatcaacatggcaaaaccccgactctactaaaaatacaaaaattagccaggcacggtggcaggcacttgtaattccagctacttggaggctgaggcatgagaatcacttgaacctggga

SEQ ID NO: 17076 - DNA, 556 bp, Homo sapiens
tgagacagagcaccaaatagaacttatagtagtgtccggagaacaacagcacactctttactccaactcactcagagtgcgcaaaagaagcacaggaataaactgggaggaaggtgtctttggggaactttgtgtcatagccccatgcaagaggtgagaggtagggttactagagaggatcttaagtggaccagtatgagccaaatgtgagacacttgcattttgaagaaattttaattaatgatgtctgacttccatctgggaaatttggaagacctgaaatgaattagccactgctttcttggtagatggaccaaaagcagaaatgttttagatggacatgagattttatactccagagaaaagaatgcatgagtgattgcactggaccagatatgggcatgttttacacacacacacacacacacacacgtatatgtatgcacatatgatacaccatactaggaaaaaaaacaaatcttgataacagcaattgagattgatggggaagaatcttatgtcagattgagtggtcagagaaggccagtcctagtcg

SEQ ID NO: 17077 - DNA, 646 bp, Homo sapiens
gaagaggcatttaaactttgtgttaccattcgattttatcatcaaggaataggtttctcagatagcctggatcatcttgaagtctgttgttgcataagctatatttttgctagaaatccttctaaagggaatgagtagttacatatgaaaaaaactataaagactctgcaattgctttgtcccagaagaatgtatattcacatgattcacacaacttatcgttttaacatttgtctgcctccctggaagtaataggacataaagagaatgaaatcaatattcttttctacttgcctagcacaaattcatacttacttggggtcgatagtcctttttgagggttttatgtaatgttcaaaaatacctctgcacgaggtagggagaggccagaagatggaacgatgagggaaacatacagttagctgtggtcattaccaaggtcctgtcttttgtttggggctgtggatttgcagttgcctattacagtattcaaactaaccaaataaatagaacgaaaaattaaagtaggtcataaatagaccagtgatggagttaatcatggaccaactccttactcctgctaaatgctaaaagaaaaaaaaatccagagaaactactcctactttgatttgaatattggaaactg

SEQ ID NO: 17078 - DNA, 577 bp, Homo sapiens
gtaacatgggaccctgaagagaagttggccgttaggattaagacatagagtggtggtgtggttgaagatttgaattctacagctgggtaaacctgtgtttaaatcatggtccgatacttccaaaccatgtgaccttgggcaacttatttaactcctaagccttggtttcctcatttcgagaaggaaattaataaacctcattttatggagttttggtgaggaagatgtgatatgttaattgtaacaaaatcctaggttcacagtaggtacttaatgaatggtagtattattggctattatcatttaagtcatacagagagtagggatgtcaagcaaaagatgatgtgtgaaaaccctgattgcacatttactcagcatgaaactggggcacatgtttgtagtaattcaaatctctgcaagtaaggtatgtgtggcaacaaatcaatgaggcaattgaatttattttgcagaaaacagaaaatactgctgacagacggcaataattccatgttaagtaggtgtcagatgtttcctctctcctttctcttcttcttttccacctcagcagtggcacagt

SEQ ID NO: 17079 - DNA, 636 bp, Homo sapiens
gttgttgtgcctgtgtgtgtgtgtggtggggtcggtggggggataggaaagttagtttattcacatgattctcaacatagacataccttgcaaataattgtgcaattccctactttgctttgcagacagaatgtctttgaatcaatgtcttttataaatacactatacaaaaaacataattataaacctttaaagtatttatgcatactttaatattcagaactagaagagaaatttctgtaaggagaaatgctttggagattaaaacgtaaaggagataaccaaattttactaaacctctatccatcatgaccacatttcctttcattctaaaataacaatattttggaaatgttgaccccctgcccaccatttttgcctgagaagttttaaatgcgaagaacttgctcctcacttttgaagcacggtgctttctttaggaaccaatctgtatcacatgcattctattggtttgtattttattacatatcattctattacattttaaaatgcatttctgagcccatgtcattgatttcatgattcattaatgggttgcaagcagcagctggaataacactggcttaggtaatggcagtataaatcacatgttggtaaaatgaaagatgcctttct

SEQ ID NO: 17080 - DNA, 478 bp, Homo sapiens
cagcagtttctgttgtgctccaagaactgtgttatcaggacccaccactcagaatactccagttttatcacatactccgcctctgggccgtagtagaggaggcagtaattatctatcacatgcttgcacccagcatttgctcttcctatctgatcaacttagagcttaagaaaaaaattatatatatatgtatatataaaatttttgggccgggggcggtggctcacgcctgcaatcccagcactttgggaggctgatgcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgtactccagcctgggcgacagagcaag

SEQ ID NO: 17081 - DNA, 441 bp, Homo sapiens
gcttacactgggcaccacacatgccgcgctgagcagtgagaatcaaagcacttctagttttagaaagtgtcctggcactagtagtaacccaggtttccaaagggatgcagaataggcatgatagtaggccagaatacacacacagtgccagactcctgcttcctatttctcaaaaactgtgcttccggctgggcatggtagctcacgcctgtaatcctagcactttgggaggccaagacaggcggatcccctgaggtcaggagctcgagaccagcctggccaacatggtgaaaccccatctctactaaaagtacaagaaattagccggggcatggtggcgcatgcctgtaatcccagctacttgggaggctgaggcaagagaattgcttgaacccaggaggcggaggttgcagtgagccaagattgcgccattgcctgggc

SEQ ID NO: 17082 - DNA, 616 bp, Homo sapiens
aaatacaaagtaaaccggcaaactactttcatttgatgaatatcagtgtgtacattctacatgaaagaataatgcagagaatcgggcaaaagaccaaaagaataattatccatgaataaatgatgtatattccaaaaatgcaaagatagtttgactctattaattggccatatcagatgaaaagagaacctccataaatatctatcagatattaaaacatattacaaagctatggcaattaatacattacggtaccaaatcaaaaataagtttatcaggctggacacagtggttcacgcctgtaatcccatcaatttgggaggctgaggtgggtggatcaactgaggtcaggagtttgagtccagcctggccaacatgatgaaaccgggtctctactaaaaatacaaaaattagctgggcatggtggcacatgccctataatcccagctacttgggaggctgaggtacgagaatcgcttgagcccagaaggcagagcttgcagtgagccgagattgtgtcactgcactccagcctgggcaaaagtgagactctgactcaaacaaacaaaaaagaataagtgtatcaataaaacagagtatagaatccacaaatata

SEQ ID NO: 17083 - DNA, 479 bp, Homo sapiens
ttacattaaacatatgatttatgaagagagtggtatagactaggagccaatatagttttaataaaaataagtcatgctaaaacaatctaatttctctttttgattctattggaggaatatgggcaagtgaatgatctagtctcagaggagcctgacaaagcctctcaaggcatctttacgttaagggtaaaatgatggctctctgaatacacagactgcatattacttttcttaatttacccccctcgtgccaggtacacagcagatgcttaaagaatgtgttggccacgcgcagtggctcacacctgtaatcccagcactttgggaggtcgaggcgggtggatcacgaggtcaggagttcaagaccaacctgaccaacatggtaaaaccccatctctactaaaaatacaaaaattagccagggggtgttggcacacgtctgtaatccccgctactcaggaggctgaggcaggagaact

SEQ ID NO: 17084 - DNA, 566 bp, Homo sapiens
agaagcgttaattttccgtaagacatttagtaaatgttgaaacactgaagacttacccctacatatattactaagcagcgctattagaatagcattactatgtacaagtcactgaacttactatggggaaaaaaatttggtcgatttataatataagcctataactggtccatttagtatttaacatattggcaaatgtaaagcccttttagaacaataaaaatgcttcagcaacaacttaacattgaagcaacagtacattccctcacacccggccccactctccttttttctcttcccacctacttggtgaataaaacgataaaagcatatttggaaaataatggtgacatgtcaaaaataatttgtttcttatttatctcctctcagacactgccaataagaaaccattgccactccatccccagcccactcttgctgtaagttggaagcagatgatttgctctcctgaaagagcagcaaatccgttgcctgggtgatatctcattactaaggcaaccaatttggcgccatcagtgtgaatctcaattttaaaatataattat

SEQ ID NO: 17085 - DNA, 657 bp, Homo sapiens
ctcatacctcagggcctttgcacttgctgttccctctgcctgaaatgtccttcctccatatggacaaggctcacttcttccaggccgctgctcacatgttgctttatcagatgggccttcccagcccacccacgtaaatagcatcttcatcgctctctgtcattcacagcacttatcaccacttgacgtagttatatttgttccatgtttattgtttctctcttccccagttgaatgtcaagttcatgagatcaggggctgtgtttcttttccgtggtgtattcccagagccttcagcataagttttgttgactgaattgggcatctgctgtatgtatacccctagactgagtgctgtgggtggtatgatcttcacatgccctgctacattggatttttataatatccccatgaacatggcaggtaaatagcaccatcactactttacagatgtagaaactgaggtccagagggggtggtttccaaagggctgacagctccacaaattgatagagccaacttaagtcctcaagcaacttaagcccaattagggagacatttacatctgaaaagttatcacaagaaggataaacattcccattcacagctcaccacatctaaagagatcaggcaatactaagccatcaggcaagaagt

SEQ ID NO: 17086 - DNA, 605 bp, Homo sapiens
ggacatcaggggtcaacgccagacctcaggggtcaacaggtggctcgtggagtcactgcaaatccttctccatgggctcagtgcccattccatattaatgtgttccaaatgtgtttcaagactatgaataattatcatggagaataagaaaaggcaggcaaatttacgtttatgtaataatggaaaagtctactgtaaataaagccaatttacatggaaacattttatttcctgattcatacatgttgtaatccaaacttaaaagtgtttaagtttaaactttaagtttaaacactttaaaaaggaaaatgtgagtttaagtttaaactttaagtttaaacactttaaaaaggaaaatctgaacctcacatgtgctgaagctctaagacatgaactgtttcactggatggaaacacactaaggcagcatttgtccatctgtgcgacctgtctgtgacgcacacgacacggagtcctctgtggtgacaccagacataaaaacgcaaaggaccccagtgctccgttctgactatactgtccaagaagacgcacatcacctccctgttcacaccccagatatgcaacaagaacaacggtcacgcacca

SEQ ID NO: 17087 - DNA, 536 bp, Homo sapiens
atcttaactaattacatctgcgagggtcctatttccaaataaggtcacctgaggttctgggttgatatggtttggctgtgtccccaccccaatctcatcttgaattgtactctcagaattcccacgtgttgtgggagggacccggtgggaggtaatcacaagatctgatggttttataaggggtttccccttttgcttggctctcattctctcttccctgccaccgtgtaagacgtgcctttcaccttacaccatgattgtgaggcctccccagccacgtggaactgtgaatccattaaacctctttttctttgtaaattacccagtctcaggtatgtctttatcagcagcatgaaaacagattaatacatggttagacatgacttttcgtgggatactattcagcccagtacaaggcatctttgtggactctgctacattctgcggggtttaaggttgcaattacggaataaaatagtggggagaactagttacaaagtgtggagaagacaggagatgggtcttcagaagtattt

SEQ ID NO: 17088 - DNA, 648 bp, Homo sapiens
tattgcactatcatactacaagatgttaacattttgttaaaataaatatctttgttatttctaaaaacggcatgtaaatctacaattatctcaaaataggttaatacaacgtttttgctttactggagaaaaattagcatgtaataacaaagttttcagtatgttcatattttaacataactcatgtttgaagtcaatatttagttaagatcagcaccaaacattatgatttttatactgcatttattttatttgtagttataaattaaacagatgttaagctttcaactttaaagctatgtttctgaaatactaatacaaatgctttttacctgaaagctatttacatttttacatttctactaaaatttcgggtttcttaaataaaatgtaggaaatgttttattcaatttcacatttaatacttgagtaatgatgaaagcaaatagacatatgtgtacttattgattaaattttaatggtaagcattttttctgaattcaaaaataataaaattggggacattatgtcatagttgtctctctcttttgaataaataccttctttactaataaaaacatattggtattaaaacgttagcttcctattctcctaatacagtaaaataatttctccattaattatatg

SEQ ID NO: 17089 - DNA, 573 bp, Homo sapiens
agaacagttaatggagacgtactctactactttgttgttgaccactggctatttggggaacagtgtcaggtggatttggcatggctattaaaataatcaacttaaataaaaaaatacatcccaatataattcccttgtagttcttttagttggatttgaaactgttccacaactgaaatttggaaaatcaagttatattgaaggtggagggaggaatggttggctgaatttaaatgacagatttaattgttttgttttgttggagaatactgtctataaatgtctaagaatttggtgttagaagtttgtacactattctaaaaagaaggaaatagaggatcaaacttacagttaacaaactatttgcaaagaaaatatctcttaacaccctagaaaggcaaagaaaattaatgtgaacacacctaagggcaattaacacttataaaatgaaagtacattatattgacagctttatcttttttgtttgctttttttaaaaaatgaacagaagcttgaagtgttaattttaaaaatcagggctgggcacagtggttcatgcctgtaatcccagca

SEQ ID NO: 17090 - DNA, 651 bp, Homo sapiens
atttaaaaagtagctttatttatctagaaagtttaaaatatgttgttataccacagaacaagcagattatttttaaaagctttttcttattcgattataaatctttcaagatagatctgtttgttttagtctctttaactccactgtgtctaatataatatcttgcacatagctcttcaccaagtacttatctaattgaatttctaatcatctagtttcacagccccttctcttattagaaatgacttgtgaaggatgtatatatggctggttcatgatacagctagatatattttatgatttctggggatttggctgggcacagtggctcacatcccagcactttcggaggctgaggtagaaggatcatttgaacccaggagttcgagaccagcctgggcaatatagtgtgttgtgggaagtcagggaccccaaacggagggaccggctgaagccatggcagaagaacatggattgtgaagattttacggacatttattagttccccaaattaatacttttataatttcttatgcctgtctttactgcaatctctaaacataagtttcgaagatttcatggacacttatcacttccccagtcaatacccttgtgatttcccatgcctgtctttactttaatctcttaatc

SEQ ID NO: 17091 - DNA, 570 bp, Homo sapiens
tgatactgctgttgctatccttgtatgttcatctctgagtcattccttaacataaatacttggaaggcttttgacatattgccacattgcacttcagaaaggttgtaccaagtgacacaacagatatgaaagtgactttttaactgagcattttgataattaggctaatcataatttgtgtacttgattgaaaatgtgtttcttcttttatgaactgttactagtaattttcccctatctttctcctgtttatcttattggtttatagaaactcttttcagattacagatattagctttttaatcttttgtttaaaaaaaaaaaactttagacaaattaaatttgacggtttaattagcaaagaatgatttgagaaccgagcaccccccagccctggcccccaaccagacaaaatggaagtgaggtacagaaacaggctggatgtggtggctcatgcctgtaatcccagcactttgggaggccgaggtgggtggatcacttgaggtcaggagtttgagaccagcctggccaatgtggcaaaaccctgtctctactaaaaatacaaaaatt

SEQ ID NO: 17092 - DNA, 612 bp, Homo sapiens
cagggtttatgggaggaaggcagttgactcaatctcagtaattgtaagttactaaagacacagatgtatttctctctctctctctctctctctctctctctctgtctctctctgtctgtcttctaattgagaatcttcatcaatgctctcacctctctctcggtcataatttttttaaattgaccttaaataaataacttgtgatgagtctttactaattctacatccaaaaagatcaaaagtcatagcaatgataaacttagcagaaaaaataaacaacctagtagaacacaatagcatgtacttgaagaaatactacatttatcccaaatactccaagtttgttatagctatcaataatgtagtgcgtcaagaagaaaactctgagtggtgtgtgaaagaattctctaattctcagatctgtcatctttctcaagagtagctagtttgctaaatgcttggcattgttctaagtgatgtgcttgtattaacttatttaaacttgacagggacttagagggaaggtaccattttcatctacattttgccactgaggaatcaggagaggcaagtaacctgcccaatgtcacacaacagtaaatggaatcactg

SEQ ID NO: 17093 - DNA, 584 bp, Homo sapiens
gttctattgtgcagccaagtttgagaaccatgcaataggtccaactcattcaggaggggtgaaagtctaaatgccaaatgtagctgctccatgtctctggctctctgaggtcatttgtttattcatccaacaggccactcactaatgggtttccactgaggtcacagaaacacaatcttttgagtattagtgtaaaaactcccaactaaaccagaaaggacatcattaattcatttattcatttgataaacactgacttagaccttcatctgccccagtcactgtgatatgcctgggaatactgagttgattaatgattaattctagtgatcgagaagctccagaccaataagaggaatggatttcaacataataatatttactccctttacttttactgagtattctatgctagaaactgcacttagcaatttgtccacattatttatttttatcttcataaagccttctgatgtaagcagcattgtgcctgttttacagatgatgagcctaaggcttcaagagtaactgatcaggccaggcacggtggctcacgcctgtaatcccagcactttgggaggccg

SEQ ID NO: 17094 - DNA, 635 bp, Homo sapiens
ctaaaacttggctgttagcatcaaaagttttgcatctgaatgttcttagcctcctcactcattcattcgttcattcatctattcaacaaatatttattaaggtcaagtacttaccatgttctgggtatccgtgagaaagaaagaagttatagctccctatgtcttagctaccgcccctacatcaaggctgtaggcaagccctccttagcatcccccttagcaactagcacagtgcaaggcatgcagtaacagctgtgtccactggggagcgcagaataccaacacagcttgtcacttcctttgacttgagaccactgaacagagtcatccttcagcatacgataatttaaacactggcccttataaggagttgatgcaaattatagatgacataggtaaagagcttagcatatgatctggcatgtagtaagtgttcaataaatgtgagctagtgttagggactcagtaattacttgtttatcagggctggattcaattctatctcattagaagcagccccatatctataactgaatagtgaactgtacaatatgcataattggaggcagaagccagcatggagtagagcaacgaaagattatagaactgtttgcttgataattgctgcttaagta

SEQ ID NO: 17095 - DNA, 530 bp, Homo sapiens
ttttctgagtgtgtagcagctaatgattgtcagtatttgtcttagggtagctgccctggaaaacagacctcaacacatagtttcacttgcaaataattcagtggggagtactcccagggagaacatcagtgaggtcctgaggaaagcagagtgaggccaaggaggtgttgaagtgtaatgcaggcacaacagagcctcaacctgttacacaggcagctctggagctctgatggccttcaagattgtcccaaattgaagtatggggattggacctttatatctcacatcaactaaaaatcattgatgaaactgctcccagagaggagatataaacttgcatgacgttgacagctttttctgaggtcaatttttaatctttgagcccttggctggcaatacccctggcagcaggggaaggagcatctcaggggatcttggtggcacctgatagcagtctgtaaagtccatttattacgctcctaagatccattgcttcatataaaacttctctcccattagagaaaaagctt

SEQ ID NO: 17096 - DNA, 519 bp, Homo sapiens
atttactatgggccacgttcttgctgtgctccttctccctgtggttttcaaaaaccagtcacctaacctgaagcctcaaactcttcatctgcaaaaatgagttgtggcaggtgcctctgaagcaaaaatcctgggctagaaggagtgtcgtcatctaaggcaaaaaagaaaaacaaaatcaagactaagagaggaggaattagaatgagactcatgtaccctccttccccactccaggggaaggagagactgtttgggaatgccctcccactacttccagggcagaggctgtgcagaggagccttggagaatctgcagcccactgatgactctgcttcagtcagtgtttctgactttctgatggagaggcctcccattgataagatttttgtcactgcagctaaatgggggcttcaaatacaaataagtttcagttacagaaaaaaaaattcttgcacgtttaagcttatcccttctacggtattatctgtgagaattatagaccaaccataaggcact

SEQ ID NO: 17097 - DNA, 601 bp, Homo sapiens
gatataaaggatctaagaaggcagccagcaggagccctggagaccatctgatctgtcctgcccatctttcagatggggagcctggggctcggaaatagggtaggacttgcccagggccgcacaatccaccattgggcaggccgggatgtgaacctcaggcctcaagcggtgcaggaccctggacagctcccaggctctgagagactccaggcctgggttcatggtgaagcttgggcctggagtccccaccccagaggggagggactgtacacgtttcccacctggccttctggtgaccagtcataggatgtgcagtagcggaacagcagaggtgacactctgagagccaagtcccttcccctgggagaagtggtaccaatggtcagactgtgaggaaagggatgtgacaccaaaccagagaggtcaggcgcggtggctcatgcctataatcacagtactttgggaggccgaggcgggtgagtcaactgaagtcaggggttcgagaccagcctgtccaacatggtgaaaccccttctctactaaaaatacaaaaattagccaggcatgggtgatgtgcacctgtaatcccagctgcttggga

SEQ ID NO: 17098 - DNA, 502 bp, Homo sapiens
acatgtttgcattgactgaattttaaaaaattcataataaaagagtcaattccaatgcctgtcaatgcataatagttctcactttagagtccttgatatttctcttcctgattagtgtcaccacatcattcctttaaacattttgataaaagagatatcaattaatggtgccctggtaaactgtaatcagaatagattcccaagatgaagttggttcttttacttggtcacaagaagcatttttctttctatttggttgtacctgtccctttaacaaccagctatttaggcgatcaatgtcagaaaactagaacaaatagaaacacattttccagtagagagacattcagttgactccattttggttttctttctcggtttaacttttgatttacccaagaaagaccaggaaatcagtgattgcctagagtgaaaactgctagaagaagagattatatacaaagaaggataaggaatattttggatatgatgaaaatagtct

SEQ ID NO: 17099 - DNA, 508 bp, Homo sapiens
ggtatcctcctgcctcagtctcctgagtatctgggacaacaggtggatgccattgtgcccagcaaattattttgacttataattcattctggatgacattttatataataggactacagttaatgttggttttattttgcttatcttggttgttattgtgattgactttttaaaactttttgttcatgtttctttagcatttctaatgtttttcagcatggtaactaaatacttttatataatataaatgctaaggttacatggtaggcattgttcatgggcaccatgctatacacctataaattaaaatcagtacaatcatatccaaatgaatacaattatatcaggtgacagagttgttaatagctcagaagataagcggtttcaccattgctcagtagataaatttcttctttccaaaatgtgatttaaatatcaatacttccccagcactttgggaggccgaggcaggcggatcacgaggtcaggagatcgagaccatcccggc

SEQ ID NO: 17100 - DNA, 590 bp, Homo sapiens
tcgtgaacaccctagacctgagaggaggaccagcccagatgaaagcttggaagaattcccaggggctggtggcagtctcagcctggctgctctgcccagggacatggcccacagggctctgctttccctgctgccagctcctcagctggagacagcatggccagtggaggcctcctgtggctgcttctctcagaccaaactcctttgagaaattttgacatgaatgagaatagggtagcctaattgaaatacaatggggtcttcctcctaaattcccacctctaagctagttttctcttgggagggactagtgctctctttttaagaggggtgtgtgtgagtgagtgagtgagtgtgtgtatgcgcacacataggttaacagtttggttctaatttagttgcctgtcccaactgcattgtttactggtagtggtaactttacttcatcatataacctgctcttcacagtggcttcaaaatgcattgtaactcatcactggtactaccatgccctcagacatcatgaagacagactgagggcagggctgggactatgtgtgtacacgtgcgtgcctgtgtgtgccctcaca

SEQ ID NO: 17101 - DNA, 645 bp, Homo sapiens
aaagatacaataaagaatttctcccaagcagaccctcaggaaaagaaatactaaagattattcttcaggtagaagagccatgatccctgatgaaagtttgcagttagaagaactattttttaatgaaagaaataaacatagagataaatttaattggatattgactgtataacagaatgctatctcataaagtttaaaatgtatcttccatacaacagcagaagcatataagttgtgagttggataaattaattttaaaatattgtcaagtattttttttctccaaatagacatatgtaccaattatattagactctgaattcaagaatgcacgttgtattaaaccaggtaaaacataaccagaccagattttttaaatgggctctcttaaagtttttataatttatattcatatttcacatatgttgaaagtaaataatggaaaagcatgcaatgcaaatattaaccaaaatatagctttagttgtacttatattcacattttaaaagttggacacagttaagtctcagtgattttcttacacaacggaggcaacctgtgcagttataactagtattatattatgctcttggcctgattacagaagggaaaggagagatcatacaagacaatggcagaatgaag

SEQ ID NO: 17102 - DNA, 281 bp, Homo sapiens
gtgctgggattgtaggcatgagccactgcgcctggcctcattattcatacttttctatctcccctctagattgtgtttctgtaacctattgtgcacacaataaccggcacgatgcatgcagaaaatgtttttgaatgacatgttggttgaataaaacttgttggatgaatggatagatgggtggatggatggggtaagtggacaatgatggaggatggatgggtggataaatggatggatggatggatttgatggctggatgcatggatgggtgagtgggg

SEQ ID NO: 17103 - DNA, 526 bp, Homo sapiens
aggcatgtaagcacaagcagccattggtgaacttgtgctgtgagaccaccaaagaaacagcttaggagctccagctaaacacttttctgattatgaccctgagatccttcacttctataaccaatgtggtctcaaagacacagaaatatataggaatatattgatcagcataatgtatggtctcagagtcaactctgggaatattttaagccagacatatcttggatttgaaaaagtataaaatggggccgggcgcggtggctcatgcctgtaatctcagcactttgagaggccaaggcaggtggatcacctgaggtcaggagttcgagatcagcctgaccaacgtggagaaactccgtttctactaaaaatgcaaaattagctggtgtgatggcacatgcctgtaatcccagctactcaggaagctgaggcaggagaatcatttgaactcgggaggcagaggttgtggtgagcctagatcgcaccattgcattccagtgtgggcaacaagagtgaaactccctct

SEQ ID NO: 17104 - DNA, 536 bp, Homo sapiens
tacgcctgcaagtgagaaagctgtggttgaaacagattcagtaacttacgcaagtttatattctctgtcaagtgacccagctgggatttaaacaggccttttgactctaattctagtattcctcccatgtgcagtattttattttatattgcacaatagataaaatataattttggtttctccttttttattctaaaagagtaaaagcagttatctcaatatgttatgttcattctagtgatgactttactatcatgtactaaatgtgttttgtttaaagtagaagttaacttcacgttatactgatttgtccccccataaaccaactgtatgtcatcatataacaaaagttgttaaaagtgctatataccatataatgttgcatctaaactgggacacttatctgagatgcttttgcgtgggacaaatgctatattagaaatgactaggactggccaggtgcagtggctcacacgggtaatcccagcactttgggagactgaggcacgtggatcatttgaggtcaggaattcaag

SEQ ID NO: 17105 - DNA, 635 bp, Homo sapiens
atctgaatatccctgacatcacttagcattctttagctttctgatgttttgcaagtccaacaagcatcaggtgatattgtattgccattttaattttcatctctttgattattaatgagtttgagcaatgtcaatgtgcctattaactttttaagaaattatctctataagcccaacagtgggcatttcctggcatataatggatccttagtggatgtatgattgaaagaaagacattatagcatgcaaaattcccaaattagtctcaggctttgatttttgatacttgttggttatctcgaaatctgaacactaagtaaatattggaattaagtttttgaggtaattaactatattaatcagttgtcctgattttacagtcgaagattgttggtaagtttgacatagggaaattaaacttaaaaaaatcataaaaataacattttttaaaagttaccatatgatgtaaggagtgactgtgagttatattttcccattttgtagatgagcaaatgagttcaggagagatttaaataccctatgaaaagcatgcagaattctggtagcactataaggataaataaaaagattgggccatttggctagggctggcatgagttaattataatcattat

SEQ ID NO: 17106 - DNA, 577 bp, Homo sapiens
gttaacaagtaacacacgtttgttcagttaaaggaatgcaaaagttaatgatgatactgcctagtgaggtggaaagtcaagggaacaggcgactacaaagctgtgtgttaatggttagaatgtgaaaagtatatggaagcacacatccatggtaactaacccatggagagagggggcgtccaaagaacccttccccaagaagcttgcttcagatctaagctgagacctgaaggacctgcaggatgaaggggatagaagtgaggacaagacggtgttctaggcagaggaacagcatgtgcaaaggcgtactgactagagagcgtagggccttcaaggaaagttaaataattggtaaggccaggcatggtggctcacgccacacctgtaatcccagcactttgggaggctgaggcaggtggatcacctgaggtcaggagtttgagaccagcctggccaacatggcgaaaacccgtctctactaaaaacacaaaaaattagccgggcgtggttgtgggcgcctgtagtcccagctactcgagaggctgaggcaggagaattgcttcaacccgggaagcgg

SEQ ID NO: 17107 - DNA, 641 bp, Homo sapiens
gagataggcaattaaaattttgcatttgctggtatcacaagtctttcgttaatgggtatacatagttacatgaaaacacatgtatattaatcaataatttaccttcaatcacagtcatctgtataatgcctttcctccaatacatcattggtagaggacaatttggcaatgagaaagcaacaattgttactgattttgcattgttttggcagagttgcaataattttcccataccgtgatccagcagagatatcagatagatttctagactgtacttgcatttgaaagttcttcctctgtttttattctgagtatttttttccatcagcttataacatcataatattgattagtgcaagtaatgtattattcatgccattctggtttcattccattagtgccatcggcattagtattcagtctgagagacacaattatgtcaagaaccctctggatcagctagtcttgttttgcatttgtttcacattcatagaagagacttctttgtagagtagatctttttttattttgttggtgccaactggaatgaaataagagattaatatgaggctgatgtaaatataaccttatatatttttattttacagataatcattatgtaaaatttgaaaatttggaat

SEQ ID NO: 17108 - DNA, 597 bp, Homo sapiens
aagaggaggttcttgaggctagttaattgtcccccagcttggccggggaatggtggctcacgcctgtaatcccagcactttgggaggccgaggtgggtggatcacgaggttaggagattgagaccatcctggctaacacggtgaaaccccatctctactaaaaatacaaaaaattagctgggcatggtggcgggcgcctgtagtcccagctgcttgggaggctgaggcaggagaatggtgtgaacccgggaggcggagcttgcagtgagccgagatcacgccactgcactccaagcccaggcgacagagcgagacaccgtctaaaaaaaaaacttgtcaccccacttacagtcagtgatataattttagaacaagtggagagtgagaaaggtataaaatgaaggctgccttcctgcagggtttggtcttggatggttatggattttaaaacttgaccacgtttcatgtttagtactttcttatttattttagagcttctgaaaattctatagaaaggaagacttttgagctaaaatgtttatttctatcttatagtcctttctccctcttaccagataaagcaaaaaaaatagaaat

SEQ ID NO: 17109 - DNA, 624 bp, Homo sapiens
taatttaattttcctgcaaactgggaaaatatttccagtattccattttactgtcatgtcactttggttctttaggtgcttaaaccacatattatgaactattagagaattatgaaattgatgtagtgagtcttggctggtattcttttcttaaagatagaatagagaatacatcacatatattttgcctcctgaaaagtttgtttcagttgtgtgtgtgtgtgtgtgtgtgtctcctaggacacaatgtaaaatgtgtttcttgccatgtaggagggtgttggttaaaagtttgaaaaacattgctgtagagaaaagttcctcaatcattaatatgtataaaattacaggggaaccttgttaaaatgcagtttcagacttctacttatctatcaatccatgggatagggtcttatattcttcatttcaataaaactcctaagtgattctgatgctgctattccaaaggatcacactttgagtagtgagggccaagaggaagagctatagccacaagcagaggatgactaaccctctggaggaatggcaaatgaaactctagaccctgaatatcctgctcaggataccacagccgcaagaggcatcttcagctacagcgtctga

SEQ ID NO: 17110 - DNA, 593 bp, Homo sapiens
caacttgtattaaaatgatcctcgttggctagtgccgtcagtcacctggaaaaagacatcacacccaaagcctctaattatttctataaacaatttttcaaataccatgtccagcacacaaacatatgaacaaagtaccatgagtaagaaccatgagaggcagttatagatccaaaggaactccaaatactggagatatcaggagactataaaagaattatatttagtatgttctaggaaataaaagcgaagtttgaaaaatttagcagggaacaggaatccataaaaaacaatgtagcagacttgaaaagaatcacaactgaaaaatacagtaagatattggtaagaactatccattgagttattaaattaaaagcagattaatcggctggcgcggtggctcatacttgtaattccagcactttgggaggctggggcaggtggctcacttgaggccaggagttgaagaccagcttggccatcatggtgaaactccatctctactaaaagtacaaaaattggccaggtgtaggggcacacacctgtggtcccagctactcgagaggttaaggcacaagaactgcttgaaccca

SEQ ID NO: 17111 - DNA, 488 bp, Homo sapiens
gaaaggaaagagagatatagaataggaattagggatggattcatgttcaaatgagatccatgggttctttcatatatgaaagaaaggtgaccctccccaaccccaaaaatataccactgagatccagaaaggaaagagaaaaagagaaaaaaatacactattgagatctagaaaggaaagagaaaaagagaaaaaatacacttttgagatcccgaaaggaaagagaaaaagagaaaaagaaaattgagcaatattccaagtatatagaataaatgaagatttgggtaataggatggactgctgcttcctctaggactgggaaaaggcaaaaatgatggaagatgtgagtaagtttgtagaaatttataacttataattaagtgcttctattttctgagataaatgacaagattatttactgagaagtaggaagtaagataaggtgatttgaggaatacaaggaataaagagaaagctttgaataacta

SEQ ID NO: 17112 - DNA, 119 bp, Homo sapiens
tggtgttcatgagcagcactgttattcattaatttatttgtttgcagtataagcatctaactccatggtcaaagaatacttaataatatacgtgagtacatggataaatatttctgact

SEQ ID NO: 17113 - DNA, 620 bp, Homo sapiens
gaaggaggccgtggggggcctggacttacccctggtcccacaggtgagttctgcggggcagcgagaactcgaggtactggcgctggcgggcctgggaggaagcacagtggggtaggagagggaatgtgtcagcctgtgttgggggcagtgggcccctgaacccccacgcagtcaggtctccacaggcctcaccaccttgtctgtaacaggggcagccgctggttaccgttcaggggcaacagcagcaagggtgccacccaaaagtgtcgctgtctatctagagccctggcatgcaccagcagccaggagagggggtacagctggcctcgtcctcactgttcttcctgggccagcaggtctcacagcttggggtgcttggagctccctaacacgcttctcctcactagtcatctttgcatcttccctgcccggaagagctggggtctgaggttgccccagtcttgcagctccctgactccggctgttttgttaaccgagaagctcctgagcagacactgccaacctggcttgcggcctcacgaacacccactaagcacaagctgtccgccaggtcctgctgaggattctccatgcaggcccggtaacactgggaggcgcac

SEQ ID NO: 17114 - DNA, 635 bp, Homo sapiens
aaatatactaaaaagagatacttaaaaagatgaattttcctttctatattaattacaatggatttttagataatatggaaatatataaaagtagtcagtgtttagacatttgaaaaattaatgggaatatatattttgctgtatggttctgaaagtactaattggtaattgaatcataaaatatcagagttgagattaaagagctaaaattaaataatatcttcagagacttaacagagatctttcatttgtgccaaatttagtaagatttgcctcaattcagttttacttatggtgtatattgattctttaaaatgtcacgtgtatggtggctcatgcctgtaatcccagcactttgggaggccaaggcgggcagatcatgaggtcaggagatatagaccatcctgcctaacatggtgaaaccctgtctctactaaaaatacaaaaaaaggcccggcacagtggctcatgcctgtaatcccagcactttgggaggccgaggtgggtggatcacctgaggtcaggagtttgagaccagcctggccaacatggcgaaaccccatctctactaaaaatacaaaaattagccagacatggtggcaagcacctataatcccagctacttgggaggctga

SEQ ID NO: 17115 - DNA, 586 bp, Homo sapiens
acagctggagagccctgtgcacacattctcaagccaggtcaacacagcctttgaggtcaggagtgttgtccctattttacagatggaaccaaggctctgtagctgggccaaggtcacactgagccagtaggttttttaattccaaagccaggcatctttccactggttttctcaccttcagatgaggaatgaagagaggccctccctggaggatggttagcctgatgctgtgagacctggagtgtggagctctgagatggacagggccagatacacaggctagtgggggtgggggtggaatagggcagggtgttggagccagaccacccctcccccagcggctccagtccagagctccgacccctcactctctgggaacataaacacaaccacatctggactcagggcctccctcagcctcacgcatctgccaaggccagagggccctggtctcagctgagggcaggagtcaggggagacctagaaggaggcgggctggaggaaagtgaagagcaaaaaggaagcctgtcccgaaagtcaggtctaacaccaggtgcaaggggagccacacagggctcaggtggag

SEQ ID NO: 17116 - DNA, 589 bp, Homo sapiens
tctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggc

SEQ ID NO: 17117 - DNA, 459 bp, Homo sapiens
agatctcaactctcagtatcctcagagtcaagttgagggaccttataagactccaacagaaggaaccacacagtttcatgctgcaagggcaaggctactctatttttaattgatggctagacttcattaagactgaaatgaataacagtgaggaaaggcggggcagctactagagacagaagagtcattgtgatttagttgtttggtgaattgctcatactttcaagggtcatcggtagcataactgcaccttggtgcttggagaaagcagagtgcagcagctgggccagcccaggactctctgtgcctggagctcctggtaatggacctgccagcgtgtgaactgacgtgcccagcgctcccacggtgggaagctgtttactctctcccgggaggacacagggttagacatagttgaatctataatcattatcgaccagatcaacacgttctaactga

SEQ ID NO: 17118 - DNA, 619 bp, Homo sapiens
actgtatgcactattcagatcgttcaactattcatggttaagaacattttagatttttaaaatatcagtataacatttgacaagaatttataactgattacacttttctttgggaagcaaagtacactgtgagtgaattataaaaattagcattattttaaacaatatatgcaaaatatatcttatttataattctgaatgtatatttgagggagaatatccatcatggaatgaataataataactcctactaaattaaaaatattgaataagtgcagttgaaccacaaaaataaaagaatttaaataattaaacatatcaaaatccataaaaatctctgttgaaaatatatagaatgtaatatcattggggattaatgctctggtaatatgtacatcatatggcaaaaattaaaagactgaaaataagatgctagaagtaaagtttattctgctagattaaatatttaaaggaagaaacaaacatgaaaaaactcaccattagtatcacgaaatttaatttgataaattatagtacaaggaacagattcttgttaattttattttaatctatggagaatgatatcctaatataggccacattcataatacactgactc

SEQ ID NO: 17119 - DNA, 630 bp, Homo sapiens
ctgggatctcagctggagagaaggacatcagggtgaccatatccaccacgggccgggagctgcagggcagaaggcaaccaactctctccctccaacccaactgcacgtcccccctcagatgtggggctcccgccagcaaagccagagaactctccttccctaaagcagacctcaacatgtcactgtctcctcttaaggaaaataataatgatactttttatttatttattttgagagagggtctcaccctgttgcccaggctggagtgcagtggcatgataacagctcactacagcctcggcctcccaggctctagtaatcctcccacctcagcctcccaaggatctgggaccacaggcatgtgccaccacacctggctaactttaaataaatttttgtagagaagggaccttcctatgttgtccagggtggtcttgaactcctgagctcaagcaatcctcccagcttgggctcccaaagtgctgggattataggcatgagccaccatgcctggccaataatggtgataactaattagggctcccagttcattctagcagcctctgacccattttccatgaagaagagaaagctcttaggaagagaaatcatactgagttactttcatgc

SEQ ID NO: 17120 - DNA, 630 bp, Homo sapiens
cttccccagtttaatataagaataagcagtctctgttctctaaaagccagaaggcttatgggggagaccaacgcactaatttagggcttcagcagaaatttctgtaaagtgaggtgtgcctacctttttccctaaatgagatgtcccctaccctacagattgatatttgatgatgcaaaacaattaaacaaaagactctctttgctgacctgtgaaatctgaagtttttacggtgaaaagtgctaatacattttcaaagttgacatagtatatttatcactttacacctaacggtctttctatgacgaattgacttaagcgctttgtactggagaatcagcacaaattaccttttttaaataaggggaaggctgaagtgacaagcttgtctcccctggagttaacaaatacagttctcttttagaatagggcgctttaaagttggagaagttctgagagcttgagggtcattcaaactgcaaggtaccctgttcaccgagtaattcaggttcagaaaagtcaagcagagatatatgcagtgatgtgtgcaaggcttcacagctgggaggttgtactacatccccacaatgataagcctttgctgccttcttgatcacttttgctacatct

SEQ ID NO: 17121 - DNA, 550 bp, Homo sapiens
acaggatgtcaggacaagtgtatgctcccaaattgttgaaggaaatgttaatttctagagccttttaggaaaccaatctattaaaaccaaaaacatcttgtaactcagtaacttcatcactggggatttgtcccataatattaaaattccagtacacaagtacattttcaatgatatttactgcaacatttttcatggtagcaaaaaatggaaacaaagagaatatctaacaatagggaaaaggttatgtaattattgtgattcacaaatagaggattatgcagccattgaaaagaataaattacagctatactagttgatatgcagggattcctgcaaaggtattgagaaaagcaagttgcttaagtgtttatattatgatcatattatgatcctatttatataaaacaatgatgaaaatctctgttatatatatacacctacatgtatgcacatctgcaaaaaatatgaaaaattacattttctataatactagttcccttggttgggggtgagtaatgtgggttgagaaaaggaacagaggggagcg

SEQ ID NO: 17122 - DNA, 414 bp, Homo sapiens
ggtgggtggaggtggggtataggttggcaattatggatactgagtgccttgtttgaagaaaatcccccaacccctccaagcctgaaaactttaagtcatgaagaaagtagtagagaattggccgggcgtggtgcacagtggctcatgcctgtaatcccagcattctgggaggccgaggtgggaggatcacttgaggtcaggagttcgagaacagcctggccaacatggcaaaaccctatctttactaaaaatacaaaaattagccgggcatggtggtggcgtctgtagtcccagctactcaggaggctgaggtgggaggattacttgaacctgggaggcggaggttgcagtgaaccaagattgtgccactgcactccagcctgggtgacagagttagaccccctctaaaaaaaa

SEQ ID NO: 17123 - DNA, 407 bp, Homo sapiens
tggaattacaggagtgcaccaccaagcctggctaatttttgtattattagtagagatggagtttcaccatgtcagccaggctggtctcaaactcctgacctcaggtgatctgcccgcctcagcctcccaaagtgctgggattacaggcatgagccactgcgcccggcctatatccgtttttaagataaatatttagtggtgatgttccttaacatcatttcttctggtgatgacttggttctaacaagtgatgttaatgtcaatgtcagggaaaagagttacagaggtgctgggagaaactaaaaattgaaaaaaacaactggcagggcatgatggctcacactgtaatcccagcactttgggaggccgaggtgggtggatcacctgaggtcaggagctctacagca

SEQ ID NO: 17124 - DNA, 597 bp, Homo sapiens
cttccttccttctatttgctctggcaaagaggacgcatttccaggaccagtctcagctagcccagtgtctttattgtctgtttctttgttgtttgcattaataaaaataccattagtattttttaaactcatggaaattcataattcaaacaattttttgcttagggagttgattctttttgttcttttaatactatactatttttaacctttttgctcccttttaaactatacatgcagttataattaactgatattagtattacttctgtgcgaaaatacctttaggcattcaataggattataaatcctagtttattttctttacaataagccaaacactatgttcatacttgttatcaagctgtctaatacactatatagatgaagacactgagggcttgcttacagttgtatggatatgatgtgaaagagctgagtttttaaacagaacagaaagccttattctttccattcttacccccactgtcttttaagtttctaaagatggcgaggaatgttgaagtttaatacttataattttcttaatgaacttcattattatatatagggccacataagatactatgtttgaat

SEQ ID NO: 17125 - DNA, 571 bp, Homo sapiens
tgctcactttagaagtgcttgccctttcatcccttgcaggatggagagaaggaacactagtgatgagaactgactcatttctgggcacatgctgcctgccaggctccacactgcgtgttgtacagaaatgatctcatttagttcttccaactgctctctgaggtagatacgacttttatctctccacttaaagatgaggaaaattctccaaggtcagacagctagtaagaggcagtgcctgggtttgaacccaggtccacctgacttcgaatctgggcatatgtgaaccttggttacacactagaaagggcgcccgtgtgtgctcatgcaagccatcctctccttgggtcctggggaatcccgaagtcttctccattcaaaacgactcagtgttccctgggagagccagaaatgtctttagagagaagctagaacattctttagagataagtcctatctctcctgtttatttctaaaacatgtcatttgaaaatgggagaagggtcaccttttcccctgcagctgacatgctgaataccatctctaaccctatttgtttctgaagaaactt

SEQ ID NO: 17126 - DNA, 545 bp, Homo sapiens
atgccatggcctgtttttatgttcactcttctttataaatgagatgaaatagctttacaatgtgcctaacatcgttttaaaatgccacataaattcactcctgtttttatggggttgaaaaattttaacacagaaataatttgcctagcttgaagaatttgcataaaaccatcgtaggggtgtgttaaaaattactcttcttccttttaatgtaagagcgcaagacaggatggaggatagatttcattcttatggtgccccaggtgaatctcacatttgcatattaaagattcaatttaaaataaactcccaagtcacaatgggcatttaccctagaatatatatttcagcatcggcctgggaccatgcaaggaaaattcctagagggacagcagagtccacagttgttgtagctatgcacctcttgtatttacctttacaaatgttagcaggagaatatggtctgggtagcccacccctgatgccagaaagaaaatggtaaattatagaaacaaaatggtatagcagtttgacttttacttctc

SEQ ID NO: 17127 - DNA, 341 bp, Homo sapiens
cacagaacaaagtagcaaaaccctaaaaggagtttgttggtatactcctccaacttctgctaacagcagagcttctaactagcctgaattagggagttaaccgggctgacaaactacaatattcctctgttattgatggtttttctttccaaagtttcagttaactatggccaactgcagtctgaaaatattaaatggaaaattccagaaatagacagtttgtaagttttaaataactgttatcaccatatgttgttataattgttctattttataattagttattatgtttccttcattatcgtgcctaatttataaatgaaacttcatcataggtatgt

SEQ ID NO: 17128 - DNA, 568 bp, Homo sapiens
gggagaacttgagaaataaagaaaacttcaaatgcttttaccaactagtagcatgcacttcttcatgaacactcagattaaaacttgattcacattctgagagtgactcaggagaggttgacaaagatctctctgttatttcgcagagttaaactctatgacactgcacaatccaatagactggccattagatatgagctaaaggagaaggacacatcacttagagagtttgttgttgtttttaaattgtgtcttgtgtgtataaattttctaagtttcaggaaacttattctgagtgtctttgagattgcaatctaaaaattatatactgcagtgaggccatggaaattgatatttcaccagccaggatcactaacaactgttgggccttcagctggctggaaggataaggtaataaagaggatagataaaagtggggctagccaggcgcagtggctcacgcctgtactcccagcactttgggagtccaaggtgggtggatcacttgaggtcaggagttcgagaccagcctgaccaacatggtgaaaccttgtctctgctaaaaata

SEQ ID NO: 17129 - DNA, 554 bp, Homo sapiens
ctgaaataagtgagaacatattctaatttcaaagacttctgaagaaataaacatttccattgctcagatgtcttcaaaattttcatggagaaatatagacactttacctgaatatatgaagcaatatcatcatgtgtatattttgaaaacaggcaggaagaaattcctgtgatcaagacagcccatatacacttttcttattctaataaaaatcagtcccatgactgacacttgatatcttcttcactctcacagaattattcaagttgtttcccagagtgttgcaaaatttgatgcttctggttgtgattatttccaggaagaggaattgttcctaaaagagaatgtgccagcagtgatataggtcatgtggaattgtgcaaccccacacactagccagaatggaatatttgtctgcatattcagcagttaggatttatggggtcctgtgtgtcatatgtctgctcaaggtttagtgatgcaatgggatggggcaaacagaaaaaatcctgcgagtgatgggtgcaggaaacagagcagccataggtaccaga

SEQ ID NO: 17130 - DNA, 616 bp, Homo sapiens
ggttgccatgagctgagatcacaccattgcacttcagactgggcaggaagagtgaaattccatctcaaaaaaacaaaaacaaccacaaccacaaccacaacaaccaccacaaaacccaaatgcatttccttggcacagtaaaactgaaacagaaaaagggtaaagtaaatacaagtaactgaaagagtttatgtatattattttacttctcatttgattgataaaatttgtgaagtaatgagcagagtgtatttctccagggacccagatatatacatttatttattcaatagaaattcattcttataatggccactgatacctatatcctaaatatttctgaaaacatctcctcaggcctgcatcatctttgcaacattgccttatattttatctttgttcattgatttatatgcctcagaattttatgctcctcacagtatttagagtgaattatccctaatgcaaatagatccgtgaaccggtcctgaatacctaatgtccaagcatcttaaaggtttatataaggatttcagaaactgacttctgggtagggcacggtggctcatgtctgtgatcccagcactttgggaggctgaggcaagtggatcatttg

SEQ ID NO: 17131 - DNA, 549 bp, Homo sapiens
gtgatagaaatatatattgagaagataaagagaagaaaatacgttgattcaaatggaggctagtgtaaaggagctataacctcatttaataataataattcataagtcaagaagcagcaataaaatcatgttatttagaaacatggagataaatactagaagaaattgctaaaagatttaaagtagttgccctggagaacagaaatggaggttggattgaacagaaccagaacttctatttttcagggttgtagtgtagttttcactttttaaactatgagtgtgtttctttgataaaatagaaaaaatatataggttctaaagagttaaatgaagctggatgtgatagtgtgtgcctgtaatcctatctacttgggaggctaagacaggaggatcgcttgagcccaggaatttgagaccagtctgggcaacacaaagagacctcgtctcaaaaaattaaaaataaggccaggcgcagtggctcacacctgtaatcccagcattttgggaggctgaggtgggtggatcacctgaggtcaggagtttgag

SEQ ID NO: 17132 - DNA, 657 bp, Homo sapiens
agacagcgtctggctctgttgcggaggctggagtacagtggctcaatctcagctcactgcaacctccgcctcccaggttcaaacgagtctcctgcctcaacctcccatgtagctgggattacaggcgtgtgccaccacgcccagctaatttttttgtatttttagaagagacaggggtttgccatgttggccaagctggtctcaaattcctggcctcaagtgatctgcctgcttcggcctcgcaaagtgcttgcaattacaggtgtgagccactgcgccaggcccaatgacaagtttttatatctgaaaatccctagggatcaagggaaaaatttatacaaataatgtgagcattctgtaaagcagcacgttataaaatgagtaactaccatgaaaaaccaccatgtaatctaggaatgaaaaaactaacaatcttcatatattcaagaaaaacaagataaaatggaagagaaggcaccatttatgatagcaaaaaaaaatcaaatacataaagttaacaagaaatctacctgcagaaacaccacaatattcctaaaagacacaaaatagacttgaactaatggagagataaaccatgttctttgatgggaagactcagtattatacagataatgatgctcattaaattaattttta

SEQ ID NO: 17133 - DNA, 624 bp, Homo sapiens
ttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttattgattcaggaggtaaaaattaggagagccacgtgtagttttaaaaacaaaagaggaattacttgtaacaaaagtaagtaagaaaggaattctcagttatctcttgggtagagataccttgcatagag

SEQ ID NO: 17134 - DNA, 567 bp, Homo sapiens
tatgaaacatgtcacaaatattaaggagctttctttgcccaggaaatgacatgcatctacaaactacaatacagatttctaactatgcatacacttgttaagaaattggttaattcaaataaaatgtagaatcatcattgatgtaatgaatcattaacaagctctggacaaaagaattccttgactacccgaggggcacagaccgctgataaaatctagaaagtgatttggtacgatcaggtgtatttttactctacagagattcattgatcggtccaaattttaaaacaggctacataataaatgcagttttaatgatctacatttcctcatattcacaggcacttttaatatatttaaatccaaactggaataaatccaaaaaggaatcataaatgcagctgaaatcagccccatgttctgccaagcagtaaagaccactttaaaacaattccaactatccatccatatttctagagccaaaaaaaagctccacatttgtataacttatataataatcacagcaaagattactcatctatatgtgtaataagaaatcactacatg

SEQ ID NO: 17135 - DNA, 636 bp, Homo sapiens
attctcatgcctcagcctcccaagcagctgagattacagacattcaccaccacaccgactaatttttgtatttttggtggagacagggtttcgccatgttggccagcctggtctcagactcctgacctcaagtgatctgcccgccttgatgtcccaaagtgctgtgattacaggcgtaagccaccacacccagcctaataaatgcttttttattgtgaaggtagtaagagacttatacccagatctcaatctggagtcttcagtgttcatttcagaaactgaaaagcaatgactatccatcaccactccccacttccatgactactgtacaatctcaacttcattgctcttggctctcctttccctcaattatatttattaataaaaataaccaggccgggtgcaatggctcacaacccgtaatgccagcactttgggaaactgaagcgagaggatcacttgagctcaggagtttgaaatcagccagggcaacatggcgaaacctcatctctacaaaaaaatacgaaaattagctgggcatggggcacacctgtagtcccagctacttggaaggctgaggtgggagggccgcttgagcctgggaggttgaggctgcagggagttgtgatctcacca

SEQ ID NO: 17136 - DNA, 530 bp, Homo sapiens
tggtgtgcagagtgcagcggcacgatcttggctcactgcaagctgcaagctccgtctcctgggttcacaccattctcctgcctcagcctcccgagtagctgggactacaggcacccaccaccacgcccggataatttttgtatttttagtagagacccaaagtgctgggattacaggcgtgagccaccgtgcccggctgccacaaaaaactcttaacagagaggctgcactaagggcttggccagctgaccccttcactgttctggtaaacagtcctgtgtcctggaagagtctcttccccatgaggcacgggtgcttccaaataccttgtgtctgacctgcttggccagctcatggtgaaaggtgcgggatgcagggaggaagtggggttttgattttgatatgtatttgggagtggggatttaccttgtgctcaacaccatggataacttaacctcctgaaaaatttaggcttaaaaaaaagtggaccaggcctggtggctcacacctgtaatctcagcactttggga

SEQ ID NO: 17137 - DNA, 472 bp, Homo sapiens
gtggaactctagttgtgccagtacagaaatgggcagacagtcattggaacagttttgagaagaaagatgcccatataggaaagagcccatagaatggttataaaatatgcctggatttgtggaaccagttctaaagctggcattactttcagattcttagtatcttagaggtgggtgtgatcttgtagatcctgtttcagtctcctcagaagcgggaaaaattggtatcatttggaggctattgtttaggttggggcaaaaaaatataatggggggagacattatatataaaggtgatatttacttcttagacttgagagaagctggctttcttaataatctctaactgattttgaacctctattagaataagccctggaaataatattggaaatgatataggcattctaagtagatatattctaagatgacagcctggtgtggtggctcatgcctgtaatccctgtacttt

SEQ ID NO: 17138 - DNA, 648 bp, Homo sapiens
tgccacaatctcagtatgactagaatttcttcacttgctatatttaattttgtaaactatgtggaattaattttgatgaataatgtgaactggaaatctaattttatttcttcattttttaaagcaattctactttttcttattaggaaacttgcatgtacatattgaagaaagcatacaatatagacaagcaaaaggaaacaaaataaaattttattataatcttcccacacagagagaatcattttaacagtttaatctatatgcttctaggagattcagtatcattatttatgaaacaggggaaataccacattttattgaatctaatatgcaatcaattgtaagaattaccttttgttaccatcaagagaaaaaaacacagctaattaaactaggcacactagcaaccaattttaggtatcttgatacatgcaaatctgttaatcttcaaatcaaatagaagttataataatgaccttacaggactgttatagagatcaaatgatataatgtatataaagtacaataaatgataactattatcattccatcatttgaatatactgaaatttatttatccaacctcctattgttgaacatctaggttatttccaactattagctactataaacattaataattta

SEQ ID NO: 17139 - DNA, 478 bp, Homo sapiens
tatcctgtggaggattttctcacctttatgtgtggtgaattaattctccctatggatgtacacttgcagtcctgaaccacccatgccccttctagaaaacattggatgctaacccatctggcagggaggaatggattttgccctttgtgtgtgtgtgtgtgtgtgtgtgtgtgtgtgtgtgttcatcctacagtagggttataaaggaaaacaatgactccctaattaaggcatattcttgacaaaacttggacccaacccttaaacccatgggtacttcaagattacactcccatagtggtaactccgctcaaggggcctaaggcactccatccgccagggtgtgcagctgccacaccactctctctgcatttgacaaggaaatggagtggggtcttcctcccagtgtcctctccccccagcacatgggtggctcaaggcatttattttgcatctctgacagtacttacttatgtac

SEQ ID NO: 17140 - DNA, 535 bp, Homo sapiens
tgtggccaatagggtgcctggaatgcactccagctccagtatagagaaggaagccagggaactgacctgacccagacagatgtatctgaagcaagggtgtttttatttttttctaatcctttttattgtggtaaaatacacgtaaaatttgcagtttagtggcgccaagtacatttgcatttttctgtagccatcaccaccatccatccccagaacgcttttcatatgcaaaaatgaaactgtacacatcaaacaactctccacttctcccttttcccctgagttcctggtacacaccaccctacttatgtctctctgatcttgacgactataggtacctcatataagaggaatcacatactatctatctttttgtgatgatgagcttattttactgagcataaagtccttaaggttcatccatgttgtatcatctgtcagaatttccttcctttttaaggctgagtaatattccattgtgtgtatagatagcagtttccttatccattcatccattgatagacatctggctggc

SEQ ID NO: 17141 - DNA, 641 bp, Homo sapiens
tggccaaggcaggtcgggggagtaggaggtagtggctaaggggtgcggatttctctatagagtaatgaaagtttctaaaagtgactgtggtgatcgatgtacagctctgggaatactctaaaacctactgaattgcagatttcaataaataaagtgaatggtatgtgaattatattttaataaagctattattttaaataataataatagggggctgggcacaggtagtcatgcctgcctgtaatcccagctctttgggaggctgaggcaggaggatcacttgaggtcagaagtttgagcccagtctgagcaacctagcaagatcccgtctctatgataaaaaaaataaaaaaattagctgggcatggtggcacatgtctgtagtcccagctacccgggaggctgacatgggaggattgcttgagcccaggagtttgaagctacagtgacccatgatcatgtcactgtactgcagcctgggtaacagagcaagactctgtctctaaaaaggaaagaaaagaaatgcaagtttttaccactttgtgagtgtagccaagttggtggagaaatagacaagaataaaagggcactgaataatgaaggtgagtggctggttaggctcagttgctagcttatcagct

SEQ ID NO: 17142 - DNA, 512 bp, Homo sapiens
  misc_feature 455: n = A,T,C or G
aagtgacatgatctcggctcactgcaacctctgcctcccaggttcaagcaattctcctgcctcagcctcccgagtagctgggattacagctgcttgccactgcgctcagctaacttatgtatttttagtagggatggggttttcccatgttggccaggctggtctcgaactcttgacctcaggtgatctgcctgccttggcctcccaaagtgctggtattacagtcgtgagccaccgcacccagccaacactgggaatttctgttcaagatatgctgtgaatatcatgctgtgaagcataatattgattctatacattgtcagttagatgactgttggatgctagagaggcaaatggtcttataataatatttaataaaatataattattgaaagtgtttaaaatcagctttattagtgacttgcatttaaatttggtattttatttaacaattntaaaagatatatttaatgatatctatttattatattttcttgaacagtttgtgtctc

SEQ ID NO: 17143 - DNA, 547 bp, Homo sapiens
agcaagaaaaataatcatctccacagtgaatggattaggtgacaagtgttccctttgccttgcctagccaatctagccaatatgccaacatgggcactaacaggataggtcagcttagccaaggccaggagcagaatccatctaggctggaggcttagacagcgagagattcagagggtgacttctggagtaaggctgctctggtcactgttttttccctgtcactctctagttttgtgaccttgggcaggtaactgagcatgtcctggtctgtctttgcagttgtagaaagcggggtagtgtctcctttgtagggctgctgtgagcctccaatgaactggtgctcttgcacagagcctggtacatggggagtgttggctgttagcgcaccaagagttcatggccagaaattcagtttgttgaaagcaagattaacaagaacactaatctaagcagcacagagggcctggggagtgtcacagaaatatattaatagtagcagagtttggccaggcatgatggctcacacctgcaatcccagcacttt

SEQ ID NO: 17144 - DNA, 610 bp, Homo sapiens
aaatctgtcacttaatggctaatattcgtaaactatcaacagagaaatgaagttcgtaattcagacagaaaacccatttgctcagtgtgttgctgataaaacatgcaacataagcaaattattaaaaacctaactgtagcaggtcgatagagagctctgcttctgtccccataatcccattattcaattaagcaatactacaggtagaacaggggacacaataattatcaccaacaacattgccattcatgcttctaccgtaggccaaactttcttcagatttttgtggaaggtatttgtatgtcataaatacataaaaagtcaagacacagataaattacctctattaccttttccaaggatgatccaaagaaaatgtcaaatctaagctgaaactcttagctgagtccggtaaagatatacttttatgtctttccttattataaatatctggctcatcattttcctcatggcactgacaaattaaatttatatcattgtcatcagttcacatccactttgcatgcactggaggcttggaattgtgattagccgaatcattatcaaaagagttacttaactcaatatcaaatggaactgactgaatagc

SEQ ID NO: 17145 - DNA, 627 bp, Homo sapiens
  misc_feature 520: n = A,T,C or G
ggatcaataatgactttgtccagagtttctgtatatttgactcttgttcctaaacttgcttacttaatcctcataatttcatcccacaagttcattgaacaactctgtttaaagcatttgcccactgctgggaacactgcctggaagatctggaaacatgggaagtcagatctcagaacagggtatagttacacggagtgggttgaaagggagcaacaaccagagtatgggtcaccagaaacaagatgagggtgccagatacatgctgtacctactccatacattctcattctagctatctgtagccctttcctaaatgagaatacccaaaagaacttgtttgggctattatatgcaaggtggctgaggggacttggcaaatatgaaattataaatgttaataaacagtgtggtaactgatgaattttatagctcactcgactggcatagaatacacacctttcagataaagagaatcatctgaacatttgcaagcctaggggaattagaaatggcacanaaagagacagcagggtttggggctgtgccaccccctgccgtatctcatattctgtgtattgatttggaagagacttctgaatctctccactcacttctctggatgga

SEQ ID NO: 17146 - DNA, 486 bp, Homo sapiens
tatatatgattaaccacgcgtggtggcatatgcctgtaatcccagctaccggggaggctgaggcaggagaatcgcttgaacctgggaggtggaggatgtggtgagccgagatcacaccattgcacttcagcctgggcaacaaaggcaaaactccgtctcagaaaaaaagaaaaagaaaaaaaaagaatgtacataaaacgtttatcacaataactagtattataggaagacttcagtatacaaccacccacaaattaaaaggaaactagcaaaataaaacagagaatatcacgtagaacccctggaagaagcagaataatttttaatgtttcaaaaattggaacagaggccaggtgcagtggttaatgcttgtaatccaacactttgggaggataaggtgggaggattgcttgagctcaggagtttgagaccagcctgggcaacaaagtgagaccttgtctctacaaaaaataaaaaaatcagccg

SEQ ID NO: 17147 - DNA, 425 bp, Homo sapiens
gtttcgccatgttggccaggctggtctgaaactcctggcctcaaatgatccggctgcctcggcctcccaaagtgctaaaattataggcttgagccactgcgcctggcctcatacaattttttactcaaactatttagtgttgtaaaactatattcctaaaatactgtcagatttcaataaacactggggcacactgttatcaccatttacacgaatctaacgcttaaccattgcaatgaatggttcattcaatcctggctcccaaatggacagaaataactccccccgaacctttccttgagaatgaaacttctataaggtgtgttcattgctagctacggtgaagttcattttagaatcacaagcccttggaacttcatgttaagagttctgcagtagatcacgaggtcatgagatcgagacca

SEQ ID NO: 17148 - DNA, 613 bp, Homo sapiens
tgcctacattgtggcaggtaagcaattattattatttcctattttcttgcttgcttgaaataaatgtccaagttcaagggaatggtgaaggtaaatggtgcatctgtgtgatgaaatatgtaactcttaaaagatgctgacgtactttttcatattttcacatctctgaagttggaatgcctcttaacagtcactgttagccaggcagcaccatcacttagttctcactatctgtgtatgtgaactatgtatcatggcagttcatgtcaaagtaggtgcactcttggtattactataagtgttgagtttaattgcttttaaaataaaaacaaagctaaacaagatgatgaagaaattactgggtcatggtcttaaacagaagaccaaattgtaaaaacacaaaatgtattagaccaggaataaaataagccatggaagatctggcagcacagagtaggaaattaacaagcttgatgttggacacaaacactatttctccagaaatgaacttctccccttaggattagcattggccttttccagaaccctgaatcctataccagattgaaaacctgtgtagacatgtgaaaagatgttcaacagcatttgcttt

SEQ ID NO: 17149 - DNA, 402 bp, Homo sapiens
aattttacagccagaatcagtttgattatttaacaccaaatagtgacctccgtataaattatatatttaaatcaattggtattaaaccaaaagatccaatttttaaaataaatttgatgtcctaaaattaagagactgacatcaattttatcatgaaaaattccattataatccctactacttgagaaattagctgctcaatattgacatggacactgagaagaaaaatacattttggcataaaattaggaagaataaaattattattatgggagaaaatataccatttacaataacaaaaagagagttaactgctcggatcccattgaagttcatgaagttgatatactgtagcaatcaaaattctcaagattaatatttcatgacagaatacctggattt

SEQ ID NO: 17150 - DNA, 438 bp, Homo sapiens
gatcacttgagcccaagaggtcaagactgcagtgagccatgttcacaacactgcactccagcctaaataacggagcaagacccagtctcaaaataaaaattatatttagtcatcttaacatagtcaaataagtttgagggatttttttaaaccttgggtgtgaatttctaacaaaatcatgttttgtgaataacaactgtagttttgcgctccatacacaaaacagttttttattaatcattaaataattaaaaagaattagaaaaagtccagacatagataatctcagaatctcttaataataaagtatatcccttatttttccaacttatctttatcttttaacaaggattgctgtatcagcacgtgcacacgtgcacacacacacacacacacacacacagaggcatgcttacattttcctttttttccttattc

SEQ ID NO: 17151 - DNA, 642 bp, Homo sapiens
ctagagagcaatgaatacaaacacacacaagaaaatctgtcacttaatggctaatattcgtaaactatcaacagagaaatgaagttcgtaattcagacagaaaacccatttgctcagtgtgttgctgataaaacatgcaacataagcaaattattaaaaacctaactgtagcaggtcgatagagagctctgcttctgtccccataatcccattattcaattaagcaatactacaggtagaacaggggacacaataattatcaccaacaacattgccattcatgcttctaccgtaggccaaactttcttcagatttttgtggaaggtatttgtatgtcataaatacataaaaagtcaagacacagataaattacctctattaccttttccaaggatgatccaaagaaaatgtcaaatctaagctgaaactcttagctgagtccggtaaagatatacttttatgtctttccttattataaatatctggctcatcattttcctcatggcactgacaaattaaatttatatcattgtcatcagttcacatccactttgcatgcactggaggcttggaattgtgattagccgaatcattatcaaaagagttacttaactcaatatcaaatggaactgactgaatagc

SEQ ID NO: 17152 - DNA, 492 bp, Homo sapiens
acagcatcaccagacaaaatacagaatgtccagttaaattagaatttcagaaaggcaacaactatttggtatggcccaggtaatatttgacgtcccacatttttatgcactagatcagccaaccctaggttcaaagttatcttgagctgtgctcccaaaccaccaccatggcctcagctgagggctggcgagatgagcccccagcgttctggagctgagaaaacagcgacacgggggcttcttcctgtccctccacacgtgctgtgtttgccgttccctcggcctggaaggcatctgcctaccccatgtatggggctcaccccttctttcctctgggtctctgctcacatgtcccctgctgagagaagtgtccctgaccacccacctaaaataggccctccctcactccatccctttccctgctttattttccccagatgtggatgccacctgccatggcacacacttactcctccattctttatcatctct

SEQ ID NO: 17153 - DNA, 589 bp, Homo sapiens
atcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaac

SEQ ID NO: 17154 - DNA, 576 bp, Homo sapiens
tgaaagaatgcaatttttaatttcagttgaatgatattttgtaccttattgatgtttggctcctccatcatagaatttttgatggtttcactgttgtcctctaatgacttcatcaagaaagaataaccacatgacaaagagtaaagatgagatgtaacatgcaaaatactggggattgtttcaatgctatattttaaaccaaatttactagaaaagaacattatatggaattactattctcaaaatttcatacaccttataagaagcatgtgtgagggtgcatggttaggaaatgagcaaaacttaatccctcagaactcattaactaccactataaattttattctaaccctaagaagtttttactcaatttcgaaatgttgacattaaagcacgattgaaaccaaaatactttatattaaaataatcagagctactggtgtcagagtactatgaacaaagtcgaattattctcttactcgctgctttgtcttatctccacatctgaaccttcaggaaaatctcttgattagaaaatttcaatttctacatgtatctaattctcttccactgatg

SEQ ID NO: 17155 - DNA, 553 bp, Homo sapiens
aagatttgcactgaacaatgatgcttcatttcaaaaactgtgattgaaccagttgattcatctggaaatctgatgagcatctcaaactccacatgaaaggggttaatagaatcaccctctatttggtcattgagcaagaaatcttagattccttttgaaacccgtcttttacatctcaaattgtttagtgggtcctattgattctacccctagacccctttaaaatctatccccttcctttcattttccaaatagagtcctttattgtctcagcacccagcccagtatctgacatgtacattgtaggcactcagtaaatgttcagcaaatgggtgaatggatgataaaattgatagtttaggtagttttttttaagttgtttttctttttccttcgtggaaaaccgcaatagttccctataagaagtctctattattaatcgttccactccccaatttgacctccaaacttacaagggttatttttctaagacatatccaaccatatcattccctgctcaaaacatttgatggctattattgcccacaatatg

SEQ ID NO: 17156 - DNA, 542 bp, Homo sapiens
aatttgtataaaatagtaagtggctggcaagtagaatcacaataagggattttacttttgttccaaatatatattccaggtcttgagtaaactaagtgataatactgattaataggagcatctattatacatgtgttatgtatgtgtattatccatagatatataatacatgtatatctggatttattatatgtgtatatatacagatacatacgtatgtatgcaaattaactttaatatctacaaaacacttaaaaatggatattagatcacaagtacagcctcaacaatgccaccaaaatatatatactgtgcaggtattattttattctccaactttccttgatttttgtttttccatcttattggtatccctactgtaataaaaaaaaaaggggggggagtttattttgtcaagtaattgcttaaaattcctttccatctcctcagatatttaaagaaaactcacagttttctttgtcccatcttttctccttggctacttccctacttttccctacaaatactatgtattattcaca

SEQ ID NO: 17157 - DNA, 536 bp, Homo sapiens
gttattggaaaagaaaatctatttgatttacataatgataaaacagtaaagaatgctgtgttcctctagttccctcatattgaggtatctaaaacccaaataaaaaatacatgaaaagcattttctcatcttttttaccttttaatcatttccctttagaacacctgtcatttctgtcaaaagatttttcataaacttagaattttattgcattattattttgagctttaagatggcaaattagaaatggcatatcttctttaaattattatcaaagcaaaagttcctacatatcagtaaggtaatgaataagaattatgttttttcctcatgatctccctattgtgcctattattatacagaacaaaaacaacaatgaaggctgggcgtggtggctcacgcttataatcccagcactttgggaggccaaggtgggcagatcgcttgaggtcaggagttcaagaccagcctggccaacaggtggtgagacccagtctctactaaaaatacaaaaaattagccgggcatggtggcgt

SEQ ID NO: 17158 - DNA, 530 bp, Homo sapiens
acactgtaatgttagaactaagttcaatgttagggccaggtgcagtggctcatgcctgtgatgccagcactttgggaggccaaggcgggtggatcacttgaggccagggattcgagactagcctggccaatgtggtgaagccctgtctctacttaaaaatacaaaaatgagccaggtgtggtggtgggctcctgtagtcccaggacttaggaggctgaggcaggagaattgcttgaacctgggaggcacaggttgcagtgagctgagattgtgccactgcactgcagcctgggcagcagagtgagactccacctcaaggaaaaacaaaaacctaagtttaatgttagaactaagttggagagaaactccattttcagtagaagcaggtttaggttattcagaccaatcttcctacagaaagcaacttttaaaacttgccaaaatatttaaaatcatcttaaaagcatcaaagatctaagaagatatgaagaaattgcctggccagtgagcccagcattggaagccacttt

SEQ ID NO: 17159 - DNA, 497 bp, Homo sapiens
acataatgttctagtaaatattcttgtgggcaattcattggacctgtcttagattacatgcccagagtaaattctagaaatgaaattcctggtcttctccgaagacggaattgagtggggaaaaaaaagaaaatgaaaaaaagaaataaacacaagatattcttggtcaaattgtgtctgccctttctcctccagtgagctacgatgaagccacagtaatccacattcccaggggaacacaggtggtctgcctctccatgtgctcagagtgccaattcttggtaaggagatatagggactggagtgaaacattggaataatgactcatattcatgttttataaacaaatttaaaatattggatcaggttatttatctggaaaccctgaagtttggctgtttaaagggctattttaaatataggcaacagaaaacaaaatacaaagtcttatttctgacactttaaaatgttggcaaagtgtcttccttgttagtatg

SEQ ID NO: 17160 - DNA, 565 bp, Homo sapiens
atgtggtgcccaagtattaaagtatctactatccctactttttcgtccttcatgagcagcccgagtgtactaaacacattactgttacttttgtcatacaaagtttcaaacaccagtgagaatagtggaatgaaccacccttgtgctcctctagctttaacaatgtatacctgtctacttcctctcccaaataattttgaaggaaatcctagacattttatctgtagatgcactatatagctctttaaagacatctaaactctctttaaatctagagtctctttgtccccttgcagtgtgtttattggagaagttaagtcattttcctggagagtttcccagtcttgattttgctgattgcaatctcatggcgtcattaagtgtattctcctgtatgctgcatttcctgtaaattaatagacctagagaaagcgggtgtgtgtgtgtgtgtgtgtgtgtgtgtgtgtgtgtgagaagggtctcactgtatcacccaggttagagttgcagtgttacaatcagctcacgcaacttctgtctcctgggctccagcgatcgtcccacc

SEQ ID NO: 17161 - DNA, 136 bp, Homo sapiens
tatattcttggaaaattttttctacattatgaaaatcttagtaagaaagacttggaaatttaaaaatcatgagttaccaaagaatatatcgagttgaagtcaagttataccaaagcataaaatccatgatgacatg

SEQ ID NO: 17162 - DNA, 459 bp, Homo sapiens
aataatcaaacccaaagagggggttgctttaccagtcagaaatttccatgtttgttcatttgtttctgcccactgcatacttcagcaaatggggacttacccagcttatttggtctgctgcaccactctagcccgcagctcctgggctggccctgctccgctgcctcttcctgtgacatgagtcagctgcttggtgccattggtgggtgggagggctactgtggtatagctcctttccacctgccatttggtgagtcccaactccttgtcccacatccaagaataagattatgcagacaactggagggtgagcaaggtggagaagagttttattgagcaccagaacagttctcagtagagaagggaccagaagcaggtagtcccccacccaaaagcaggtcatccccacccaaaggtgggtggtttcaaagtgtggctcagtctggggtttttataggc

SEQ ID NO: 17163 - DNA, 471 bp, Homo sapiens
agaatcaaaatgaaaaataaatttcatgtaaatgaaagttttgtttcaaagatttctatcacagagacacattgatattacatccatcttaagactggccaagaacaagagagaaatcttattaatgattctgaatgtcgtattaggagatactatgtattgccaaggtgaaatgttcaaatgactaagtagtggacttgcatgtgtgtcaagttattttataatcactttaggtaatttgcatttaagaaaaacttttaaaaacaagctttttccatatgaatgtttcatcatatctttacatcctttaaaagttgatttctaagattttcttgattgtagagatacgtttactggttctcatatccttgaagtgttaagtctgccaggtaagaaccttagcatcaacataagcaatgaagtataaaggaacaaataaatataaagtagaacatcagctgatctttgaac

SEQ ID NO: 17164 - DNA, 448 bp, Homo sapiens
tagagtagagtgcatcactgtcttaatattagagctgctgtcttctgtttcagcagcagtttggcagctttgaagctctgtatctcagggattctccatcccgaatttcaatatttatttccaccacagcatggcttctcactagtatttagtgaagggccaaagagctttcttaccatgtattttaaaacctccagccctattcatagcctcctgagccatttcagtctttgcacccaacccacaaccagattcatatccactggagcctcagcaaagtgtacctgtctttggttttcactccatgaggatgcagtcagggaggagtccaaggagactcctggagaaaggatacatgggcaggaaagatcaggttgttggagttagaaaaaaacatgcttcctaccatcacaacacttacacctttgtatctgctttcctgtcttgc

SEQ ID NO: 17165 - DNA, 440 bp, Homo sapiens
ggaggatcgctttgggcctaggagttcccggccagtctgggcaacatggcaagaccccatctctacaaaaactttttaagactcagccagggttgggtgtatgccagctacgcaggaggctgaggtgggaggatcagaggactgcttgagcccaggaggctgagactgcagtgagccatgttcataccactggacttcagcctgggtgacaaagtgagaccctgtcacaaacaaacaaacaaacaaacaaacaaaaaagaaaagtagtattcacgttttggacattcctatctaaactaggtggaaagagaaaatggagagtactgggttctaaggaggcaggtattctagggtaagtaatttggtattttaatttaagcagaaagacatggtcccctacttttccccttgggatatgccctggagaatgacaaaatgat

SEQ ID NO: 17166 - DNA, 467 bp, Homo sapiens
tgtcaccgtcaagactgactgctttccagttatcatggaatagattgaataagaccaagactggccagattgtttttgtaaatttactgaaaggcacaatgcagatgctgaggctagcaggacttagggcagggttccaaagaagagaaaccctggagaggtgggccagcattctgcagttgctcttgccttgggtcatttgccatttctaggtcaggaacatgatcctgggactctgagtagctaccttggcatacagttactgttatcagcagagaagccaaaacattttggggaagtcttgcagagctaaagagacaaaaattagagacatagagggttcagtttgtcacagaataagaggctgtggaaggagataagataaaaacagtgaatattcagtacgttttcaagaaacttggctgtcaaggagagagcagagacttgtagtagcttgaagggcattc

SEQ ID NO: 17167 - DNA, 603 bp, Homo sapiens
tttgatgtttaaattattttagaaaacttacattttatctttgtgggttttttttgtttgtttttgtttttttgcttaatacaaataaaatcattacaatagccttaattttgtgtaaaaattcaaagtgcaacatatcgactgcattccagcattccctttcaaatgtaccacattgcgtctagacccccaataccagtgccttctcttatcccaacccatggtacaccaggctactggatgatcctattccatggctgtgaatggttaaattaagtttaagctctgccattttatttgaaatcactttattgtatgtgaaattgtgcttttggatctgatttcaaaagtattgtttctaagctttaaattaaatatcattcagagctataaataataaggaaaagaatagaatttatttctaaaagctgcccttcttgccctcacaaaatatttatttcccttatgaaagtcccaagggttggacaggcctaattcaaggctaaaagatagcagggagtagcaagtttcccagttactgtgtgacctcagcctgacagattcacagtgaagaaaaatagataattagtaagggtataatct

SEQ ID NO: 17168 - DNA, 355 bp, Homo sapiens
aggatggccgggtgtggtggctcatgcttgtaatcccacctcagtcttctgagtagctaggactatgggtgcacaccactatgcttggctaatttttgtgtatttttgtggagatggggtctctctatgtagtccaggctggtctcaaacacctgggctcaagccatcctcctacctcggcctcctaaagtgctgggattataggtgtgccccaccacacctggccctcccttatatttttaagcaaagtttctagagataatggaggatttaaaattttagcttttctttaatcctgttcctttcttggcaagtggtacaaagaatagtataaaaagtaaggatctggcctggt

SEQ ID NO: 17169 - DNA, 355 bp, Homo sapiens
  misc_feature 204: n = A,T,C or G
cgacagaaggattaagccaggtttattctctcatcacaactgtatcttgactctgaaagtgtttagatctctactagaaaaatattattcatgtcttagaaaaaaatttattcatatagtttggatatttgtccccaccaaaatctcatcttaaaatgtagtgctcagtgttggaggtgaggcctggtgggaggtgactgaatncatggcggtggatttctcataaatggcttggcaccattcccttggtcatgtcctcaagacagtgagtgagttctcatgagaaccggtcatttaaaagtgtgtggcacctccaatcagcccctccttctgcttttgccatgtgacatgtgtg

SEQ ID NO: 17170 - DNA, 187 bp, Homo sapiens
agaaattgaactgaaccgtaaaggatagctgagaacagaaaatgcttgagaagaatattcccataaagaagtgataggaattaaaacagcaaatacagtttgataccaggtaatagagtggcttgaatccagtttagggaatttggtttgggtgtgtatatgtgtgtgtgtgtgtgtatgtgtgtgt

SEQ ID NO: 17171 - DNA, 478 bp, Homo sapiens
gccctacattacgaatgcaaaagttttcttagaaatccaataactgtaatattggccagaactgtaatcaaatggtcaccctctaggtacaagggaggctggaagaatgaacatttttggctgggcacaccactaaacaaatccagggttttgatggaaaggaaggggtggggatggattgcaggtgacagctggtggtgcctaccacaagctccaataccaagatgggcactgaattcacagggatcttttaaatttagtttctggatttgagtgaaagcaaattgggttgcctcatccttcgaaggaaaagtggatccatagtattctactgtcagaaagggaaatagagtcaccttgaagacaagaggtgagagagtgctgcaggtctggagggccaagtggatagaagctcagcatgacctccctctctctgtctcccctttgttcactttcattagtcccgttcacttgggct

SEQ ID NO: 17172 - DNA, 355 bp, Homo sapiens
acatcactgctatgtaatgtatccatgtaacaatattgcacttgtaccccttaaactataaaaataaactgaaaaaactagaaaaacatggattctggtcactagtggcaaaaagtttagcaccagtataatctgcagtaaaatggaaggtagaaaatgtacctagtgaaatgggtgatctaagaaggttttcaggatggatgtcaaaagcatttcctgattcttctggcttcttagagtaaaatatgagagaagggagataagctattgaaaagaccttatataaaacagtcttttttttaaaacaaaaaggagcaataattcgtgggtcaaaaaatgtctagcatctacagat

SEQ ID NO: 17173 - DNA, 599 bp, Homo sapiens
gcagctctatgtgcccggcctggaggggtccaaggtgtgtcattaagtgaggggaaaaccccaagatacagagtagcaggtgtgggtcaagcccatttccattaaaaaacaaacaaaaaaacccctaataaacatatcaattaacatagaccaggggtgagcaaaccacccttttcctggctaaatccacctgccacctggttaaccccaaaaagccacgcctcttcatttacatatcactcagggctgctcctgtcctatggtggcgggactgaatcatcgcaacagataacagagccagccagcaactgctaaaatatttactatctggcccctgggataaatacaaatatgaagaattgggaccaaatcgagatgtgtatgctttgcctctgcactgtttgaattttaataacccacatgcacagctctgtaaatggaaaaataagactgatttaaaatgacatctaggtcaggtgcggtggcttactcctgtaatcccaatactttgggaggctgaggtgggaggatcacttgagcacaggagttcacggccagcctgggcaacataataagactccatctctacaaaaaataaa

SEQ ID NO: 17174 - DNA, 608 bp, Homo sapiens
gaaggcctctcatttaattttatacagtgaactaaaattcacacttccagtgccaattcagatgttatcttctctgaaatgcctttctgaccctccagtggagaaaatctttccctccttggtgctatttctgtgcttgatgcatgcatccatgtttgcactaatggttagtcgtcattttgctgctgttgttttactcttcttaactgtgaacactttgaggttagaaactatctgagtacagaaccctgtactgtgtcttactcaaaataaacgttttatgacttggtgagtgatgaatggctggttgataggtaacaatattaaacagaatgcttgacattaaatgtgagaatactgtgttaagacatttcttatcagctcttccactatggcttcacttaattcccctttcccgtcaagtggcattaggaataattctgaataacacttctttaaaaagtttctttttccctccaagtggaattaagaataaggaaggattctgagtgacatttttaatgtttttttaaaaatacgtcacataaggcattattaaataactgaaaagatttcatgctcttgaaagtaaatctctgctgtgaaat

SEQ ID NO: 17175 - DNA, 594 bp, Homo sapiens
ctcaggagaaggttagaattcactataacaaaagtaatagggttattaatatgactagtattctaagactctcttaataggtgggagcaggtagctcagtttacgggtagacatttatgggtaagtaacaacattggtgaagtgcaaacacctctctcctagcacacacaacacacacatacgtacattctttttctttcacacagacacaaacacactcccatggacaaagaaatgctacgaagaatttccttctctcaaatatgctggatgactctgttaggttttcccacatagaatggagacttgagtgtttagtctgggccccacgcatgcagataagcaccaagttggacatatactttgaaagtccctttacctattcagactggcaaaagacaggctgatagatggaacattgggttcaattagcctctgttacacttttggctgaactacagaacatgacccctaaaaacaatagcagtgagatcaaagagggtgcccagttcaatttagcaaagcaaatggcatgggatttgtgaaaacttgttgatagaccaggcgcagtggctcacgcctgtaatcccagca

SEQ ID NO: 17176 - DNA, 527 bp, Homo sapiens
acaagggtccagaaatagtacttactggaattcttcatgataaatgtggtacgccaaatgcaggaggtaattcaaaaatgttctcaaaagtattgttgtaaatggagaatggatttcttcaactggtatgtcattattggctaaaataagaaaattggagaggatgcctgacatttgctagaaccttccattttatttgcgcctggtatacaattcgaagaactgaatatatgcgcttatttcaaaatgctctgaacgtgtgtataagcgtccaaccaaaaatttaaaactccgtgaaagccaggcacggtggctcacgcctgtaatcccacactttgggaggctgcagcagcaaattgcctgaggtcaggagtttgagaccagcctgggaaacatggcgaaaccctgtctctaccaaaaatacaaaaaattagcccaggtgtggtggcgggcacctgtaatctcagctgcttgggagactgaggcaggagaatcgctggaacccgtgaggtggtggctgcagtgag

SEQ ID NO: 17177 - DNA, 505 bp, Homo sapiens
gatggccaagctcccacgccctcgtggccgccacctgaccaccgatggggcagaggcctgaggccaagcagtcagtgctggggccctgcttccaaggtctacaaactgctccagtccggagggccaaagataattgggcacgtgagggcccaggaggtcagttccctacgtctgccatccttggcaggtgcatttcgtggtcagaaaaagtcaagaaaggtgacacctctcaggtgttattatgaaggactctcccaagacacatctttttttacatttatttttattgtacatattcatggtggacaacatggtgctgtggtaaacatgtacactactgaaatgatggctgcaattaatatctccaacaccttccatggctcctttttgtatgtgtgtgtataagtgtgtgtgcatgggtgtgtttggataagtgtgtgtatgagtgtgtatgcatgtgtatgagtgtgtgtgtttgtatgattatgtgtgtatgagtgtgtgt

SEQ ID NO: 17178 - DNA, 613 bp, Homo sapiens
tcatttggttgctcaaattatattaaaattataaaaagcatcaaaaaaacacctgactcagcagtctgcaaaagatgcagtggaagtatggtggcattgcctctctgttctgatatgcaatcagcccccatttaaattagggagaacagaatcatactattctccttgcagatacttcccaaattgatatctccaatccagactcctttcctgagtacgaagctcatatatccaactttctactcaatatctccacttggctacaccttaagatgtcaatctttatatgtctgaaatcaggtttttaacactcatttcacaaactgctcatttattgaagccatttccatcttaatccacgataactattcttttagatactaagatgaaaacctggaagccaggcttcactcattattttctctactattttgtcgaggaatgttttctccaccgttttcttagtcattcagtaaaacctgtccgtgcttcctttgaagattccttgcagaatctcaccacttcctatcacctcctttgttaccatgctagtctaagccaccaccatcttttacataaatggttgcaatacacttctaaaagtctcttctga

SEQ ID NO: 17179 - DNA, 578 bp, Homo sapiens
acataattcatcaaaaaataaaaaatattatacttagcacagtatgagccttaatacaataaaaaatcctcctacagacctagtctagttgttgtcaaattttactttaaaattacttcactatggcaatactgtcttctgcaaacacaagctagctttgaatctatgagatacaattatttacatagtcaaaataaaggtgctatcttgttttaattatacatagaaagagctttttaagactcatacaaacttatctaaaagtaatatttgcaaagaaagacctagtgaggaaaaaacaaaaattacttgaagttattcagcaataataaaggaaactcaagaataataaatacatttgttttgagctaaaataaacactgttaaaaaggacgactgtgccagccgggcgcagtggctcatgcctgtaatcccagcactttgggaggccgaggtgggtggatcatgaggtcaggagttcaagaccagcccgaccaacatggtgaaacctcgtctctattgaaaatacaaaaattagccaggcattggtggtgagtgcctgttatcccagctactca

SEQ ID NO: 17180 - DNA, 629 bp, Homo sapiens
aggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggg

SEQ ID NO: 17181 - DNA, 642 bp, Homo sapiens
ggcaaaccctcgcgcagtgcctgccacacagtagaagctcgataaataactgttcaaaggaggaaggaagggagaacaggtggcagggagaaaggaagggattctttgcctctttattggcgaaacttcttaaattcttggctgcagtgcaaggaaagcttggactcccagtcaggagacttgaattcaagtcccagctccacacttagatgtgtagcctgggcgcccccttgacctcccacttcccaccttacaccttacctgcccaggtgtaaaacaggaaaaaatgatacttcccatgtggtatacagattttgctctccttatttctaaattgtgttgtccactcattatcttaaaaagcaaactataaaaacatccgggccgggtgcagtggctcatgccagtaatcccagcactttaggaggccaaagggagcaaattgcttgagcccaggagttcaagaccagcccaggcaacatggtgaaaccctgtctctacaaaaaatgagccaggcttgaggaatgtgcctgtagtcccagctactcaggaggctgagatgggagtatcgattgagccctggagttcgaggctgcagttaaccaagattgcaccactgcactccagctggggcaacagagc

SEQ ID NO: 17182 - DNA, 516 bp, Homo sapiens
gttttatgtcagccctcccatgcatacttgcatttggaaagagatcttggaagtgtgggagataaagtaaagtgggggatttgaggtagggtgagacctgggagacagtgattgctctgggcaggagtgccttctttacgacacctgcctaaatgtcaggctgaacctgtctttggccttccaagtcagggaaaaccccagggaccaccccaggaaaatgggtggcaggagagtgtacctttattggaaatcccacctaccaggatccaaagagattctctgaggccttcatggaagaaagagtatttgtagccaggctgcgctggggacctggagagccacagaatgaccaagttgagacctgaagatgaccccgtccaactgctcactgaccaactgggggaacagaggcctagagaggggcaggtgcttagctaagttcctagggactcgagctaaccattaggctgtggagctccttcggctccagttggtgtagggtgggatgagatgtct

SEQ ID NO: 17183 - DNA, 615 bp, Homo sapiens
gcagtgatggacccaggcttttgctagtgatggcagagagtgggcttttatgagtgagaagtgagagaagagatcaaaaaaacttcctggaaatgatgtttttggagctaaatcttaagggattagtaaaaccagattatactcaaagggagggaaggccacagtaggtgtgtgggagagaacagttaacaagccgtaaaacagtatgttgactacaaaagtgaaggggaggcaggaaaatgacatgcacttgggcatgactggaagcgaggaagatcacagtgagggaaagaaagaaatcaagggctacgttcttgttttggactttgatgcctgacaggtgacactaagccagaattttaagctaaatctacttgattgcaaagtcagagatttccctgctctttcactctgcctcaactgtgattgggtattgatcaagtatatctaaagctgtgtccaagaaagcccatgacattgcattgtgtgcaagttatgtgtatatgtttgcatgttcatgtttttcaggagagaagaagaagcatgaccttcttgtgattctcaaagtttaagaatcatttgagccggccaggtgcagtagctcacgcctgtaat

SEQ ID NO: 17184 - DNA, 475 bp, Homo sapiens
ctaagctccaatgtgatgatatttggagatgggatctttgggaattaattaaggttagatgaggtcatgaggatgaggcccttatgatgggattagtgcccttataagaaaacacaccagagtgcctgcttgctctctctctgccatgtgaagacacagtatgaaggcagcttattgcaagcctaagagagaacccttgccagaattggacttccggtctccagaaccatgaaaacataaacttctgttgtttaagccacccagtctacggaattttgttctagaagcccaagctgactaatatggttggagtccagtgctttgcgtgaagaaggtacatctctaaaactaaacattttgctcattgaagcttgatctgaaataattaagactttggtcgtgaaaatcttagacagaatccattcagtgactacctttattctgaattggcaggcaggcagttctgatagatctg

SEQ ID NO: 17185 - DNA, 119 bp, Homo sapiens
tataatttggtttgaatgtgatgacataactgatagtcttaaagaaagctgcatatgaaatgaaacagaactttcaattgaacagacaatttttagtaaattatttccataaatttcta

SEQ ID NO: 17186 - DNA, 637 bp, Homo sapiens
atatctaatttgtttccctgtgtttataatacatatatatctctgcctcttaaaccaagaataatttttacagggacaagaataaacacaaggaaatgaattagaaaacaaagtgaaaggacaagaaggtggagaccttgttcaaaataatgaaatacatatttaatatatgtgcaagtttgaagaaaagagctactgatagggttttggtgtattagataagataaaatcaatgggaacaccagctgaagtaaacaaacaagcatacacacacaaactgggaagcagagaaaataacaaaactctacttaaaacattatgaatttcagttgtctataaaacaatccacatttgatattaagtaagtagatgactatgcaaagctctaactcagagaagataccaaaattggaaatattctgagatgctatcatgtaactggcctttaaactcatgaaaatgcttgagaacactcaggggaaaaagtgagtaagtagagaaaaaagaaagtactcagctaagtgggttgaagacagtacaggaaatattgaaggagactgtctattgtttgattgatttctttcaaagaaagaatacaaagtaagttgataactgaaggacaacggtaggtcaatgt

SEQ ID NO: 17187 - DNA, 510 bp, Homo sapiens
cttgtatacagagatgtcttaattcttgccttgggtcatggctgtgggacagcatgatcagactgacttctgggagtcctggggccagaaggaagtgctccaaactcctaggggctggttttgaacaacctctgcttggccagcagatgttgggtagggaaggaagtgggtttcctggcttgtttctgacagaaagaagcaggttctgctttgaggagacaaacagcagtctcacttcctaggttcccgtgacctctgacctcagcctaccttctacaccacactgacctgatgaggctgtatcctggcctcaggggataaaattgtcccctgagagaagcttggagccagagacaactttgcagactgcctgttccaaatacatttgtgtctcatctgaggaactcagagagtggaaagtgatcaggaggtcacagggcccgatggtcacaggccaggacagaagccagggtccgtgagccttccgaagctcctcatctaccccggggc

SEQ ID NO: 17188 - DNA, 475 bp, Homo sapiens
  misc_feature 195: n = A,T,C or G
catttaaaaaatgcaatggagcaatctgtaaacgatgtctaagatgaaaagttactacagggaactctcttgatctattgttttatactgttaaagaaagtacattaatgaaatgtgtcagggtaagatggcagtctcagcacatcaaatgatgcaggcaagaatatagcaaagtaatatctatcagcaggtcanctattcaaggtaatgtatcaaagaagtgtaaaaatatacattagaatgggtcagttattcttagatcagaaggaatgggataaagaaatgatctgagaacagaatataggaattatgtggcttggaagtagaaagagaaaagacatgaacatttatcaatgacaaaatgatcacaatacctttgaggtactggatttgagggaaaagattcttccaaataagtgatcactctgattaggactgaacaaaatgactgatttcactgctcagtcctcagact

SEQ ID NO: 17189 - DNA, 636 bp, Homo sapiens
gttggatattcctgtttcatttaaaaaatgaaaatgaaaagtttatcagctaaagattatagttaaaatcagcaggttctatatagcaagtctaagtattctaatggcgcttatattaatacccagacagaaatataagacacaaagcaagcctactaagcaaagcatctgactagataaagtagaaaaatttggcaggttccaaccctgaggtgtcagagtttattgctaataactcaagttgatttcttggctaaacagagggctttaaacaaagaaattttttggttctaattaaacaggaaccctaaactgttaacagtattcatactttattaatacaataattactaaaacatatcttagtaactagtattattgataactactgaacatgtgtcgaatgggaagaggagatcatcaccacatattctttaaatgtcagccgctttcataaaagaaagggttgatgttgttttctgtcaacagaatcaaatgaatcaattctggaaagtcttcctttcctctttggaatttatcttcattcatagaaactgtattcataggtcttaaattctttcttcttagactatagtactattacttggaatgattgagccactagactaaacacct

SEQ ID NO: 17190 - DNA, 583 bp, Homo sapiens
taggactaaaagcttttcctttgggatccagaataagtcaaggctgcttgctgtcactactctgttcagcactgtattagaggatctagtcagtagggtaagactagaaaaagaaacacagggcagaagaaacagaaaggaagaaacaaaactcattcatcacaatgatataatggtccaaaagactctacaaatacattttggaattattaagacagtttagcaaaatttagacttacaggatgtcaatcaatgtcatacgttccatagcaataaacaaaatgaaattttataaaaatataatttacaagcatttgaaaatgtttaccttagaataaatataataaaagatgaaagtgctccataaaaaagtatagaatcttattggctgggcacggtggctcacgcctgtaatcccagcactttgggaggcccaggtggacagatcacctgaggtcaggagttcaagatcagcctggccaacatggggaaaccccatctctactaaaaatacagaaattagctgggtgtggtggtacaggcctgtaatcccagctacttgggaggctgaggcaggagaatt

SEQ ID NO: 17191 - DNA, 531 bp, Homo sapiens
tgtagaaattagatatatggccaagaatcagagaagcaaataaacagatctcaaataaaatgtttagttttgaggttagaggtgggatatcagggtaaccaggcaaaataactgatacaataaataactacatgacaaatcacttctctcaacaacacatttcaaaaaaaatcactttattttataactgcaagattttcttcaaaccagtttcttgctattacaagctcaaaaacttatcctgctctggtggcaaacattttgtgactcatgctgtgtaacaaagacctgtgtagacattgagttgtatattgctgatgcttctgaacataaaggaaaagtacaaaattgccgcctttttcccaatgatttgtggaggagaattattactagactagctgatacctgtgcatgaaatgcaccactattgcttaataaatctggaccgggtgcggagattgcctgagctcaggagttcaagaccagcctggccaacatggtgaaactccatctctactaaaaatacaaaaa

SEQ ID NO: 17192 - DNA, 542 bp, Homo sapiens
gcagcggcgcggcgtccggggaggaaatggatgctgtgctggcctgccggctccgggggcggggaaatcgagtagctgcactcaggccccgcccgagacccggagggagcgccgggccgtccccttttgccctcctttgcgctgggctgagcccagagccgagagcaggagtcggctctgagttccctgcttggtttttgggtggcagcagccagaggaggaatatggcgctcttaggcagccgagcggagctggaagcggacgaggacgttttcgaagatgccttggaaaccatctcaatatcttctcactcagatatggcaacaagcagccttcactttgcatcatgtgatacacaacgggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctac

SEQ ID NO: 17193 - DNA, 577 bp, Homo sapiens
actccacattgacctcaatcactcttacccttcacattgtgtttgctctttttgcctcccacgctttagtcacttctttctcactttcatttcttctttctagtcttcctttatccactcctaacactaatctcgtagctgtagacttatctttttcattgtcctcattttttaagcataggtgaaataccggaattgatatagatttaatttaattttatctcctatgttatgcattattgagaccagaaagtagataaatcaaattggtcatacccaatcctttcctacaagatagtaaatgttttgaagtcacagactattgccatctggaatagtccttctttgtaacccagtataatctccacaaaaatgttatttttaaaaaatccctccactctttaacattctgatgacctgtaagctttcaagaagtcttcagtgaaaacctgtctctactaaaaatacaaaaaattagccgggtgccgggtgtcgggcgcctgtaatcccagctactcaggaggctgaggcgggagaatggcgtgaacccgggaggcggagcttgcagtgagccgag

SEQ ID NO: 17194 - DNA, 592 bp, Homo sapiens
ttaacatgctactctgatattttcatttagggtcctagtttaatatatgaaaacataaacagtaaattagcagtctaggtttctgccattttttgttggaaacctattagcaacctttatctaaaaatgggaggagagctttcacaaaatagctgaatttcaccaatccctaaatcagaggaatttacagcatctcttggatgtttcttctggattgtcacagactcatatacacacacacaaagctgcttcattcattcaacatacttgtgttaattgatcttggggagacaatattgaataagacaaagtcactaccttctttgcttaaggacattgccaagtaagcagataattaccatacagtaggacaatattacaattagggcataaatggagagcttaggtcagattgttaatgaaagctttattttagaatgaaatcaaacatcagtccaaatatcctaaatgagttaatattgaaagacaaaaatttgttacttttagaagcaacaaattcctacagaagagcaaacctaatactaagccatctgttatttgcaatacacttaataaagtcaacagacggatg

SEQ ID NO: 17195 - DNA, 562 bp, Homo sapiens
gatgcttgtatcaaatattatatgtaccccataaatgtgcactattaaatatccataatgattaaaaattatttttttaaaaaaattctgaatgaatgaactactttgaggaatcaaatacatgagtaaaagggggctgggtacagtgcttcacacccgtaatcccagtgctctgggaggtcaaggcaggaggattgctggaggtctagagtttgagaccagcctgggcaacagagcaagactccatctttatgaaaaaattttaaaaattagccaggtgtggtggcgcatgcctgtggtcctagccacttgggaggctgaggtgggaggactgcttgagcccaggaggttgaggttacagtgggctctgattatgccactgcactacagcctgggtgacagagtgaaaccctgtcttacaaaaagggggttggagaatttgaagtgatgagggtagacaaatggtgcatgattcaacataaaatagatgagaatttaagtgggtaactccaggcaaatagccttccagaaaatctgaaacattcccaaaaaaaaaaaaaaa

SEQ ID NO: 17196 - DNA, 589 bp, Homo sapiens
agttacttgctttttaaatagctcaaaagtttttcatccttttaaccaaagttgccaaatctaaagcattattccttttggtcatcaagtagaggaatggatgaatatatttcagtttgcttattactaaaatatgttagtaatagcatattttattcaaatcactgcataatagctctgtcttattttccattttcatgacaaacacacccaaagctcagctcactgtatttactttcttttcatgatactgtttgctaagttttttctgtttgcttcaccatattttgaacaattttctattaaactaggatattttaaaagtttgccttttcaggccgggtgtggtggctcacgcctgtaatcccagcactttgggaggccgaggcaggcggatcacgaggtcaggagatcgagaccatcctggctatcgagaccatcctggctaacacggtgaaacctcgtctctactaaaaaaaatacaaaaaattagccgggcatggtggcaggtgcctatagtcccagctactcggaggctgaggcaggagaatggcgtgaaccctggaggcggagcttgcggtgagccgag

SEQ ID NO: 17197 - DNA, 573 bp, Homo sapiens
cttctttgtcagacagtcagatagtggaacacagattagtgaatccactttttctagtacagaaagtatcataatgaaattttcgggtggctctttatattctgctgcagggaacggccacaaatctattcataaaaagatatttgagaaagacagagtattgctttcaataaagagaaaaatttcagtaacttgtgaaaatgttgaattttacctgagccctaggatcccagaaaacaagaaaggacagtgataagaaacccacccccacttttttgtttcaagaaaagacagcaaagaagcagccttccccacatgcttacataagacttctggataaccacttggtttatctatggcaaatccagacacaaacgtggaccctccaaattcccatgctatgcctcaaaaataattagctgaattgtttctctccactaaccaaatacctctgttaaaagaaaaaccttagacaaattaaattaaacagagtttagttgagtaaagaatgataggcaaattgggcagcccccaaccagaataggtttgcagattctctagcaataatacatg

SEQ ID NO: 17198 - DNA, 615 bp, Homo sapiens
attttcccaattatataactataaaacaattctggaacttgataaatgggagtggcctctcaatggccacttatagacttgttaagtatcacatatacaaccaaaagaatatcaagaggcacaaggcctctttatgttagccccaaaatgataaattcatcctaacgtgggtaaggaagaagcttcacttaaccatatgaacagagaaaaagcaatcaaaagaaacagaatgggccaggcgcggtggctcacgcatgtaatcccagcactttgggaggccgaggcgggtggatcacgaggtcaggagattgagaccatcctggctaacacagtgaaaccccgtctctactaaaaatacaaaaaattagcccaggcatagtggtgggcacctgtagtcccagctacccgggaggctgaggcaggagaatggcgtgaacccgggaggcggagcttgcagtgacgcgagatcgtgccactgcactccagcctgggcgacagagtgaagactcagtctccaaaacaaaacaaaaaaagcctaaaactttccattctctttgcagtgaccctaacactccttaagcttctttctgatagtcagccccaacttgggctact

SEQ ID NO: 17199 - DNA, 562 bp, Homo sapiens
ctagagagcaatgaatacaaacacacacaagaaaatctgtcacttaatggctaatattcgtaaactatcaacagagaaatgaagttcgtaattcagacagaaaacccatttgctcagtgtgttgctgataaaacatgcaacataagcaaattattaaaaacctaactgtagcaggtcgatagagagctctgcttctgtccccataatcccattattcaattaagcaatactacaggtagaacaggggacacaataattatcaccaacaacattgccattcatgcttctaccgtaggccaaactttcttcagatttttgtggaaggtatttgtatgtcataaatacataaaaagtcaagacacagataaattacctctattaccttttccaaggatgatccaaagaaaatgtcaaatctaagctgaaactcttagctgagtccggtaaagatatacttttatgtctttccttattataaatatctggctcatcattttcctcatggcactgacaaattaaatttatatcattgtcatcagttcacatccactttgcatgcact

SEQ ID NO: 17200 - DNA, 590 bp, Homo sapiens
ccatgtacaagtcaaggagaaatattataaaaatattgacagtgctctgaggatgggggttttcacaaagctcaaaacaggtcaaacttcttcactggctgccagctcttcacagctaccaccctggtactaggggttgggtacgtgggaatagttccaagttaaagcaccatagaccccactgttcttatgaagctcggcagttatatttgagtgaatgcttttcagtgtgttctgtgcctttggttaattttcatagttttaaaatggttggtttctattggtgttttgccagtatttttgttgcttttgtgggaagaggattcactgaggtcctcaccctgacattctgaaagtgttgtccctaaccttgtttttgaaatatatttatgttggttagacttttaggttgacaagtttgtttcctttcaagctgttgctccttaaaacattggaaggaaacaaataaacaatacagtcttttggcttgcattgcttggatgagaagtcagctgtcattctcatctctattcttctgcatgtaatggtgcgttttttcctagttgcttttaaaattttctatcactagt

SEQ ID NO: 17201 - DNA, 610 bp, Homo sapiens
tatatcaccaaataatgtctcatagtcattgtaacatagtagtgcaacactttaccttttccatgtttagatatgtttatatagacgaatatcattgtgttataattgcctatcatattcagtaccataatgtgttatacaggttggtagcctgggaacaatatcatatagcctaggtgtgtagtaggctatatcatctagctttgtgcaagtatactctatgccattcacacaatgacaatatttcttaacaacagagcatatctcagaacaatatacctgctgttatgttacaaatggctgaacttagtttgctcttcagaaaacaccaaacaagcctatcttctagatttatctctttcatctctttctgctgcttttctcgcatgattttatgtttttcttcttcattttgccccaacacacctgaatttcttttcttcattttttgtcatttttttccattccttcttcttgctgctcaatgtaatgcaatctttggggagttttcattataaaacttgacagattcaaaatggaatcacttgtgccaaactctggcaatttggaacctgagaagatgttgaagaaagggctcaccatgtgtgat

SEQ ID NO: 17202 - DNA, 576 bp, Homo sapiens
ttcacatctgttatggattgaattgtatttccccaaaagatccgttgaagtcctactgccagtacctgtgaatatgaccttctttggaaatagggtctttacggatgtaattaggttaaaatggtatccttataagaagaaaaatattggggctgggtgcagtggctcacacctgtaatctcagcactttgggaggctgaagcaggtggatcacttcaggtcaggagtttgagaccagcctggacaacatggcaaaatcctgtctctactaaaaatataaaaattagtcaggcatggtattgtgtgcctatcattccagctactcaggagactgagaaacaagaattgcttgaacctgggaggtggagtttgcagtgagccaagactgtgcaactgctctccagcttggctgatggagtatgtctccttaaaaaaaagagaaagagagaaagaaaaatttgggcacagacacagaaggaagatgggcatgtaaagattgagagattagagttatgctgccacacagtaaggaatatctgggactacaagaggcttcagagggaccatggtcctgct

SEQ ID NO: 17203 - DNA, 618 bp, Homo sapiens
aaggggagctttgaaaatatggcaaaaatatgagacatcatctttggaataaaggtgtggccttctaaggagatggcttgtcaatatgagttagagtgactttttataaacttcttgcttccctttgttgtaaacatttatatattacatattgacatacacacctacatatgctttagagactacatatgtactttcttaggcatacatattggagtctttttataagataaaaggcctatatttttatagatgaggctgctttgcaataagattcacttggaacttcactattacagaaaaagataacccttaaaacagaaaagatgatttctcctcctgctgcacatacaacacagtttggcaggggggactctattcatttcagtctctcaggaacccagaacctcatgatgctgccttctaaacaccaggcttcatagttcactgtggcaggatgaagaggaagcgaaaaacccaggactgactattcaattttctgcctagaagtgctgggtcatttctgcttactttttcattggcaaaagcaagcaccatggatcggtgggtgggggagtccaattatcttctgggcaaggaaggagaggcaagaagagc

SEQ ID NO: 17204 - DNA, 638 bp, Homo sapiens
ttccctggccctgcccaggtcctggcactggcctggccctgccctgccttggccctattctttcctggccctgccttgccggccctggccctgccttggccctaggctggctttggccctgccctggccctaccttggccttcaccctagccttacctgggcactgtgttggacctggccataacacagacctggttgtggccctggccctgccatgaccctgtcccagaccctagccctgccaggtacctgtcctggccctgctctgggcctggctttgtccctggttcttagatgaccgtggccctgcccctgcccttgcccttgccctggcactggccttgtacatgtccatggtcctaaccctggccctgccctggagctgccactgtcttggccctgccctgctctggccctgccccggccctggccctgccccggccccatccatagacctgccctggttggtcgtgccctaccttaaccctgtgctaccctgggcctgctccaccctgccctggccctgccctccctttggccctgccctgaccccgccttggccctcacactggccctaacacagacctggtcctatctgtggccttggcctggcattgacccctgctcctgacccctgt

SEQ ID NO: 17205 - DNA, 615 bp, Homo sapiens
ggcactgctggggctttctctgggtaccagtacccccatctccaaaggccactcatatctttgctgtgtttctaagacactcagtgagctgaatccaggggttccatgggatgtggagaaatgccccctcccccattatctggtcacctgcttatgcaaagtaactgttccaataacccagaaaccttgagtgaaaaaagctgggccttcaggttctgcctgaagatcagtagtttttctctatcagtgtcagttagggatttctggggccaggctgtagacagacatcactttgaccttctgatccccttttcccccagaagtccatgagcttctttctgtatcagtcagggttatatcacaaaatcaaaagcaaatctaggtatttctgagaagaaagaagattaatataggggactggaagattccacagacgttggaaggctagggaagcaaaagtcaggttggttactttcagaaaatccaggacatgacactgccaatgatcccagccatgtgcatcacaaagtgggtatttttcaggaggacaccccaaagtcacaggcagaaatcccatgtctaacatgactgatcctcacttatccacctgcagct

SEQ ID NO: 17206 - DNA, 546 bp, Homo sapiens
ggaggatacagaataaaaactaacagatttcagcaatgaattacaaaaatgaaaattatttcagtagtaaagaccgaactaaaagaaattatgaaacatttagggatgaaaaagtttctaaaatgaaaaacacactggaagagtttaacatcatattagacactcaagaagaagaaaaacacatagcaaattttaagtcatagtttttgaaacattccaaatgaagtacacagatgggaagtgactcaaattatcaagcagccccagaaaaacagaagagaacacagggaactagaaacaatgtatttctaaatttagtaactgcaactcttgatataagaagttcagtgaaaccaaagccaaagtaagattacaaaattacattcagaggtatcataataaaatggttaaaagggattgataggctgggtcgggtggctcatgcctataatcccagtactttgggaggccgaggagggcggaccaccagaggtaggagttcgataccagcctggccaacatggcgaaacccgtctctactaaaaa

SEQ ID NO: 17207 - DNA, 521 bp, Homo sapiens
  misc_feature 34, 35: n = A,T,C or G
gatgcccatgcagggactgtaaacgagttggggnnctggggctgggctgtgagctgaagacttaaaccaagccagccccctggccgcatatcccacccctccccgtcccagagaggcaagcgggcgcagcactgggaaggaggaggcggttctagctcacccctttccacaggccccaagggcacagctgggtcagggctgaggtggagaggggacaagcatggtatgtagcttgtctcaaaggcacgcttccccatgggcaggaagaactgccgggaggggcatctcccaagctacctagatatcctggcatccgccttcccagccaggagcagcaccttatccggatgcatttgctccccagcatcagcctccccgcagccacatgggacggtggcacagtctttggagctgacggacctgggtcagaagcctgactttgccccctgactagctgtgtgtccctgaagaagctgcccagattctctgagcctcagtctcctcacaggcaaagcagagac

SEQ ID NO: 17208 - DNA, 553 bp, Homo sapiens
ggagccagcagtaggcctaaaattgatctaaaaccaccactagatagagaaatttatcctaagtgcaaatctactataagagtgctagtagattggagttcttatgacaaggaaggggcttaaaggacagataaaatgacaaaaatcaacatccacaacttaattagaagatggacaatgcccaaactttatttaagttaccagtaaatagagtaaatttaagttatttattatttaagttaccagtaaatagaaaattcaacaaatcccagtgagctacctctcaagcactcctgtcacattccttcacagagaacaaggacaatctgggaaaaactacatggagaaagaagtggggaagcatcacacccaagatgaatctaaagtatttgtcacaaagactaagtcatactaagtgtgaaagtaccgaaaatgtcctagaagaccgaacattttactacaagaagagaatttaaaagtgccctaagaccaaaagtcgtcatttctggtagagaagaaggtgaaaaagatgggagaagtaccctttgaagac

SEQ ID NO: 17209 - DNA, 573 bp, Homo sapiens
gatatagaaaggggtgcagtggtttaatattagagactagaaaagcagacaatctaccttaaaatctaatgaacatatttattttaatgcattagtacaatgtatgaatggtatcttaaaatgacttttatttaaagcttccataaaggaatatattaagagtctggaatatacccatgattatctggaaacagctggttccgtttcaccatcgtttcaagtgaagccccagttttgtgcttttctgccagaaataacgtcagcccagaagccctgaatcccaacagcactgaactgccggagttccacccagtgtgggcacgtaagtggcttcctcaacccacagaaagatgtgttgctaagaccgtaaggtgaccttttaacttcttcagagatagtttcagtcatgcatatctttaaactgctacatctcacccttggttaagccattttttagaaaattatgagatctaatgttgtcacctagtctgaaatactgtaatactgtggcaaagtcctacaacaggcagtcattaataacaggtagaaagaaaagaccgaggagaatggcta

SEQ ID NO: 17210 - DNA, 544 bp, Homo sapiens
ttggggacagcctcctagagaaggtcgttgagctggtcttcatggatagaggagtggcatctagaaaggaaggagggatgcaccctcatcccaggcagaggaaggaggaaaggacaggagggaattgtaagagggaaagaaccatagctatttctaagtgaccagagcaaaaggtgggcagtgacaatagcaacagagaagactgagagctagaaggacccagtgtccggttttgttttgttttttaaattaaaaaaaaaaagtttttgggggccaagtgcggtggctcacgactgtaatcccagcactttgggaggccaaggcaggcagatcacctgaggttaggagttcaagaacagcctggccaacatggtgaaaccccatctctactataaatacaaaaattggctgggtgcagtggctcacacttgtaattccagcactttgggaggccgaggcgggtggatcacctgaggtcaggagtttgagaccagcctgaccaacatggagaaaccccatctctactaaaaatacaaaattagct

SEQ ID NO: 17211 - DNA, 571 bp, Homo sapiens
agtcttccatggatttaagtcttctgtatttgtgcctttctccccagctgtattctaagtcctgaaacacctagcgaatatgtaccacttatcattcatgccatttagttctcatcttttggtttatgagctgagtttaggctgtatgattgggaacttttttcctccaaaaacacaagcaagagcttttatatttgatcataccagtcagttggcaaatgaggtttggttacttcctctgaagttcagtgttgtttagcctcattatttcatcaggatcaaggcttcatatgccagttagtgtgttgatgtggaggagtggagtggaaagaatatgttgattggttaggaaaattctcagcagaaattatccttgggtagaatgttctatgtgatcatctacagggctgtgtacttgtgcattctgtgactctaaatactgctgctggaaaaagtctgtttacactaaataccaccatacgacagcctttgagcagtttaaaaagaaaccttccaatctcctactatggtggtttagctcaggctggttttgtggcatgtttgtgctttt

SEQ ID NO: 17212 - DNA, 650 bp, Homo sapiens
atttgctgatttttttttaagagataggatctccctctgtcacccaggctggagtgcaatggtgccatcctagctcactataacctcaaactcctgggttcaggcaatccctctgccccagcctcctgagtagctatgactacagctgcacaccaccatcctcagctatttttttttattttttgtagaagcagattctcactatgttgcccaggctagtcttgaactcctggcctcaagtgatcctcccacctcagcctcccaaagtgctgacattacaggtgtgagccttcacgcccagtctaatttgctgattttaatgaacagcagctggttctattaggttggtgcaaaagtaattgcagtttttgcaattataattatcactgtgacagataattccatttcctaaatgagttggagatgggattagaaataaatacactttctttgaatcctcttatatttgtgtggtttttgtggcccagaacctgagccagcagaaatgacctcttgggaaaagtgtcttctgtgcactttgctccctggcccaagatgacaactttcaacttccaccacgtctggcaaatttttaaattttttttatagggacaaggtctcactgtcgctacaaaaaaaaaaaaaaaaaa

SEQ ID NO: 17213 - DNA, 635 bp, Homo sapiens
ggaagtaagtaaaaatatttcctctggtggctgttacaattccacagacatccagaacaattcctgtgaacaaactcaaatgatttcacattgaaaatttacagctggatcaaggaacaagattacatttgtgctttcaatgtcaccaaaggtgctagagcaatgaaatgaaagttgccgtatgcatgacctacttatgataccccacactaagtctgtacttcataaatctacctggaagtttatgtagaaatggcctaacgtaacagtgcaattaggaaggaggaatacttacgtaaagttgtttcttttcaataatagaggaaaaacaaatcctttcagtttactaaacccgcggtcagaccctattcaaatgttcaaaatgtttccagaaaatgacaaacaagttagttccgggcttgcagataaaatatttaaatcagtgtgcttctaaatccatgcccatcaacctcagttgtacctccaacactgcttccagtctgattacattttcctagtaggttctggcccattgaccacaccaacaatttcaaaccttttctacagttcacctccaaacactgactcattttctcctccagctcccagcagataatcatgtctcataattcaca

SEQ ID NO: 17214 - DNA, 489 bp, Homo sapiens
  misc_feature 397: n = A,T,C or G
cctgaatgaggaacagccattcccctccagcagggcctcggcaggtgggcccggcaggtgctcccgtgactctgcctccgcctccagccctggtctctgggatgcgaagatggatggaaagaccatatgaagcagccccgatttcccggagctcccagctgaggtcgcattcatccacacaggcaacagaagcaagtgcagcactgcgcggttcacctgctgtgggaacggcaggccagaattccctgtggaaaagggaggatgggaagggccccgatccccagcccctggctcaggtaggtgccatcgcctcccagggccgttgtccagattcaccgcggtgcatgtgaaagcccgggcaaacagatggtgcccaattaacagaactattcttgcntccttggggccccaagcctagaatctgagtctctgactccctgccagaacctggtcgagaccttgaactctcctagctgcttcctcacccag

SEQ ID NO: 17215 - DNA, 608 bp, Homo sapiens
gacagtggagttatgtcaccaattgagcctaggagccgagaaggagaagagagttcaagatggaaatactctgttcttcttgctctacacaggtcatgtttgcaacacgagtagctatatctaaatggggtttggaaagttattctggagaggaagaagatatacgtaggtaagtaaagaagactgtgtaaaagttctcaagtacttacagaaggcacagttgcaaatacgctggctgaaattccatcaggcatagcaaagagtggctgctgggtgattagaagctgagtggagataccagaggtcattcactattaacagactttgaggttccagcctagccagggtagaaaaaaggattgaaaaagaaattgaagaaactaagaagcctgtgggaaagtaccaagtggtgaaatgaggatgaaattggagtctcagaatgagaggagttaaagaataggaaataaaaatttgggagggaataaaagcaaaaattttcgaaatttggtgacattttattaacccatatattcaagagtctcaataaacacttagcaggataattgcaatacacacacacacacacacaccacctacacatatcatag

SEQ ID NO: 17216 - DNA, 556 bp, Homo sapiens
aatcctacaatatacaaatgccatccactttttgcagataaggaaaaagaaacacaggatttaaatgttgagcctcgctgtaatacaaggatattcttccttaatacccttaagtatatctaatcctaatattttttagaactttctataagcaaagtcttattttaggtgcctcaagccatagacatgttaatgaggcaagtttctactctccataggttcaaaacacaaataaataagtatcaggtatcacagccctatccacagataatctgacactcagaagttcccatgcccaggagtctgctatagagtcctcagcttggtaacctccaccatcagcatcagtgggttcaggctctctgggtctccagctaatcctgcagaggcagtgagtacattaaaacatcacacctaattccactctccccttacccctttgttctaatgtagtttgagctagcctctcacatctgaactctgttaacactgctaggttcttgctacgcatcagagccaggtctgcctccagggattatctgtaagtattcacact

SEQ ID NO: 17217 - DNA, 510 bp, Homo sapiens
cttgctatgatagtcaaaccaggtactgtgattgctcacctgattttttgtttttccaaaaggtgctttattgtgtggatagttgctaaatttagtgttcctacggggacagtgattactggagagttctattccatctttctctgcctcctccctcttcagtgcccagctccttttaaattaaacattatattgtgaacattttccatgtctattaaaagtatatatatattttttgagacaggctggagagcagcagtgtgttcatggctcactgcagcctcaacctaagctcaaacaatcttcccacctcagcttctaagtagctgggaccgtaggtacatgctaccactcttggctaattttttgttgttattttttatagagatggggtctcactatgttgcccaggctggcctcaaatttctaggctccagcaagcctcttgcctcagcctccaaaagtactaggattacagttatgagccatggcacctggcccaaaagtcta

SEQ ID NO: 17218 - DNA, 513 bp, Homo sapiens
tctctggctgactttttggcaggcccctttgccattacttgagtgcctcagtttccctgctcttacgttagactagtgcgtcaaagccagtgtccctaggggcagggaaagagaaaagacattagctcgctaagtttaacagctgattcttgtatcttccagctgtctacgtttgttttcaaaacattcaatgagtcacagcaactcagagagggtttatgacagtttgccatttttaggagaactgtataacccaaatgatgaaggtcagatttgaaggagttggatctctaataggaatctgaagttttttttcttactgtcatgaagaaaggtcctgataacaggatggtaggattaggatttagatccagcccagtgtcggggtgaacagtgactaaaatgtgattccccaagagagcctcggcgatgacagtttctggtcctggagtctatgggttaacccctgtagcattagcccccgtcacagtgacatcagaataagaacaggct

SEQ ID NO: 17219 - DNA, 561 bp, Homo sapiens
agccaatcagtggaagattacctgaatgatagaccaaatatctctttgaaaaaacagcctctggaagctacccaggcaaacctaaatgtataaagtttatgtcaccataacaaaacttaaacttgatccatagctctgtggaaagtgactgagctgattcagtaaaaagggtatatacccaaaggattacaaatctataaagatacaggcacaggtatgtttattgcggcactgttcacaatagcgaggacttggaaccagcccaaatgtccatgaatgatagattggataaagaaaatgtggcacatatacaccatggaatactatgcagccataaaaaaggatgagttcatgttctttgccgggacatggatgaagctggagaccatcattctcagcaaactaacacaagatcagaaaaccaaacaccgcatgttctcactcctaagtgggagttgaacaatgagaacacatggacacagggaggggaacatcacacactggggcctgtcatggggtggggggctaggggagaaatagcattaggagaaatacctaatg

SEQ ID NO: 17220 - DNA, 530 bp, Homo sapiens
taacatgtttattgtctgaagaggatggatacttttacttttcctgttaaggtatgaaatataagtgccttacaatttccttccttgctataaacagtgaatttgagtgattttactggaatcttcaaaccctgggtattttctcattgaaaattaaatgcataaccttgactgggaaacagagacagcagactagtgacttgaaactaagaccaatcttgagccttcaaagagaggacattacaggcccagtggttcttgctgaggagcctcccctgcagtgtcccagctgctcacaactgactttgggtggagccctttatagtgagagaagctcagagccctggaaagctggggattcataggcagaggtggttgaggtgatgcctttctgagaatgtacttgctattatcttgggtctgtttgtagacgtttctaatgaaacaaatctggatttaggtaaggagtgatttattttatttttatttatttattttttttgtgtgtgacagggtctcactctgtctct

SEQ ID NO: 17221 - DNA, 271 bp, Homo sapiens
caagggtacagtgaactaaagatcatgccagccactgaactccagcctgggcaacagagcaagaccctgttttagggggaaaaaaaaatctatcttagctcctatgtgccataaatgttacaacactcatagtctggaggaatcacaaagtctttaagaaaatggagacaggacctatagtgatcactactcacaaatcactagaatcacatgctgaaacactgctgcagaatatcaatgtgtggtctgttcccactggccattaacccaa

SEQ ID NO: 17222 - DNA, 476 bp, Homo sapiens
tggtttggctgtgtccccatccagatctcatcttgaattcccaagtgttgggggagggacccagtgggaggtaattgaaacatgggggcaggtctttcctgtgctgttgttgtgatagtgaataaatctcaagagatctagtagttttacaagggggagtttccctgaacaagtctctctttgactgctgccatccacataagatgtgacttgctcctccttgccttccaccatgattgtgaggcctccccagccatgtagcgctgagtccattaaaccattttcctgaataaattaaaaataaattgcaaccaccaactgacccatcaaccaacctacaactaaaaggtcctgtgaatgacaaacagatacactgaatagtctttttttctttcaacagagaaaactgggtttaactttattttttattgtcaactgacaacttggaattgtataaatttatggcatacaaagtg

SEQ ID NO: 17223 - DNA, 538 bp, Homo sapiens
tcccaaagtgctgggattacaagcgtgagccaccgcgcccggcctagatcgattttaaacttttaaaatcttaagtaattcctttttttgcttgatggttttcttctacctcaaagcggggactatatcttacattttcttggtattcgatacagtgcccaggatagctatggaaatacagctgatggatggatgggtgaatgagtggatgaatgaacagttggatgaaagaaagacgaatgaaaagcagatggctgggttctacaacagctgctgatttactggatgtggggacagaaggggttaaaaattaaatcaacttgagggactcttcaacttgagcagctctttactctcaaagataaaattgggataattatcttaattctggtaatcattagtgcttaaggctcaacatttttattgtgcttcaaaccacagaaaatccacagataacaactgtgattcacttgtgactttccacaggagtcaacttgtcagacatggccctatagctacttgcgtagggctggagctg

SEQ ID NO: 17224 - DNA, 584 bp, Homo sapiens
agagtttcacactttaagggcactgaagatatagaatccaaaacaaaggcgggaagatgaaatgtgcagggtgtgtgctcagtgtacatttcacagccctgaaacttctcaattaaacaacttcagtttcgggccgggagccgtggctcacacctgtattcccagcactttgggaggctgaggcgggcggatcacgaggtcaagaaaccaagaccttcctggccaacatggtgaaaccccatctctaccaaaaatacaaaaaattagccgggcgtggtggcacccgcctgaagtcccagctactctggaggctgaggcaggagaattgcttgaacccagaagtcagaggttgcagtgagccaagatcgcgtcgctacactccagcctggcgacagagcaagactccatctcaaacaaacaaacaaacaaacaaaaaaccaacttcagttccaccactctaaacatagcaaggggaaacttcagttccaccactctaaacatagcaaggggaaacagtaatgcctataaaactttgcttaaaggccaggcacagtggcttatgcctgtaatcccagcactttggg

SEQ ID NO: 17225 - DNA, 520 bp, Homo sapiens
tttcaggggaatttccttatgttaatgtatctcttgtaatgtggctgaatgtacaaggaaatttggatttcctctacataaatttgataagaacattctatagctaacctgtgtttttgacaagttctataattaagctaattataataatagcttgatggtaatcactacaataatagctaacatttattgagtacttgctgtgtgtcagcactgtgttaaattactttaattgtgctctttcagggaaattaagagacttgcagaatgaaagagccacagcaggataaacaattgccagtctcccttgttggggactggctgactttataaagcaaacaaggcattctgtagtcactccaatgagtgggagattagaatgagaacggcattagaaagcacagatcacatctggtcatgagaaagcttctcaagacctgtgtcctctggaaggctaatttatttccatttattaaatgcagcttttctttctggagaggcagtgcaaggaatctctata

SEQ ID NO: 17226 - DNA, 545 bp, Homo sapiens
gtttattttgtagtatcttctacacataatattatacatataattacatgtaatttttaaaacatactaatgaaagaaatacctatatacctaaaatctaagaaaattactagaacattaccaacataattgaatctctacttttataattctcttcatccttaccttccaatgtctatctaacatatttttagtaaacatttccttgtttttatatggttttaaatatatgtatttttaaacaacatatgttttatttggtgaaaatagtattacaatttgtgtatgtatatgtatgagttttttttaatttaaaacttacttataacgttttttactttgttggtgtaatactggctcattttttcactagcatatattacactgtgtgaatacaccataacttatttgtacactatcttgacaatggattatctgggttgtttctaacatttttgctattttaaacaatactgtaagatatcccaggctcagccatgataatattttgtgcttggagattgaattaatctgctgagaatttg

SEQ ID NO: 17227 - DNA, 483 bp, Homo sapiens
ctgggcttttttctcctgtcaaagcagggctatgttttaaagaagagcagagcctaatgtgtactatagtttgagatgactttcctcagaaaccagaaaacaggagcaatataatatagatggttgtgcaatggaaagtcctccagcatgcaacacatacacacacacacacacacacgcatgcgtgcacacacacacacacacacacacacacacacacacacatcagtgtataccacacaccacacctaacttactaaatttttttaaagcagttccttagtaaatcatctggatagaatagaacagaattcatggatttgaacacacaagtcaataacattagtaaaatgacgtgctttctataacaaagacaacttttctatttatattggtggtgacattggtgttataacataagagaaaattctgcggacagcgttgtagagaagactgtctcatggctgggatatatacaatttt

SEQ ID NO: 17228 - DNA, 575 bp, Homo sapiens
ggttaacttccgtgattaaagaattaaagaattaaaagatttcccaaagaatggatacgaagcaggctaatgcacattaatccttggcaattcaagactctgaaattttattgtcaagcttacatataaattccaaatattggaaacaaggaagtgtaaaaagaaaaatcacatattaacagtgtggtgtagagattatattctctttttgcaatctcttttttttttgagacagagttttgctcttgttgcccaggctggagcgcagttgcgcaatctcagctcactgcaacctcggcctctggggttcaagcgattcttctgcctcagcctcctgagtagctgggattacaggcatgtgccaccatgcctggctaattttgtatttttagtaaagacagcattttgccatactggccaggctggtctcgaactcttgacctcaggtgatcacctgcctcggcctcccaaagtgctgggattacaggcgtaagccactgtgcccagcctctttcattaatgttttatacttttcagcatacagatcttgcacatactttgttagatttatacct

SEQ ID NO: 17229 - DNA, 506 bp, Homo sapiens
aaataattttctcctcccccaagtagtagtgtttctggttgctactttttaatggctgcatagttcaagcaagtgtaccgtaattttacttagcaagtatttgttaaacatttaggttgcttctagttaccttttaaattgtcgctattattgtgctgtggtgaccatattcatgcatatggcttttctcgtattttggtatataacctgataatttgtcagtttaaatattagagattcaaacatgttttttaaattattaatctacctaattacttccaagagattaacagttgctatcatggaagtggtgagaatatttggagttttggatttgactttattttacagataaccagacttgtagctagaggtgacactaagcacctgactcctcatctaatgttttgttttcgtcttttatataaggccgtgattttagtgcttttgaccgaccagttggtatgctgaagaatgctttgtgggccttcgtgaacccttatttt

SEQ ID NO: 17230 - DNA, 573 bp, Homo sapiens
aaacaaaacaaaacaacaaacaaaaaaagtcagatcataattttagatcaaagaaacttttcatttctttttccataaaaactttggtaaatatcaatcctcctgttccctgtaattaagtgggaaaataaattagtaaatgtttccaaacataagcattaaaaacaataaatatgcctctatggtaaagttttccttttggaggggaagaagtaacaaaatctaaattaaattaaagtggcgttctgggaaccaaagtgataccatagctcaataaactaatgtaattagataatgtaagatttttttttttctagactccaagtttaaaacatgggctttgtaaggactcaggatcattgttggaatccaattcagtattccagcttctcaaattcacaggcagaactctgcctttcaggtatcgcttgtctgattattgtgccagtctctctccatctcaaaatggttttgtgtaacttccaagtgcagcagccccctttggaaactgacaagtgttcattttaaaatggagtcatcaaatgcacgcagccttcaggaggctcctttttt

SEQ ID NO: 17231 - DNA, 541 bp, Homo sapiens
tggaggttgcagtgagctgagatcatgccactgcactccaacctgggtgacagagcaagactctatctcaaaaaataataataataccagacaagaaagtagattctatcaaagaaatagtaaaagtagttatatttatatctatacttgctacgactacctaacgaactctttgacagcagagactacaaaaaaactttatatgttgttcctagcagagtttgccccataataggatttaagaaaccttagtagtgaaggcggcaggtaagcaggcaaacaaatgtgccactggaatttactcagaagatatctgagataaaactcactgttacaggggagaataccagattaaactgccagatttcgaatatatttactgaatatcttaatgtgataaaagtgtactgggaagatctagtacaggacaagtgatcgattagaacaaaaaggtttggtagaatacacagtaaaatgaaatcagcttgagggccgggtgcagtggctcatgcctgtaatccctgcacttcgggaggctgag

SEQ ID NO: 17232 - DNA, 518 bp, Homo sapiens
ttatactcaaaagctgagttaactaattcaggaatataagtgatcaggtgtttccaggatttagtaacttagtatgttatatctagtaggtgtaactgtggcctacagtaggcactgttatattttttaaaatgaactcatccgagtctgttgcactggatgttctgtggtgaaaattatttgggttagagagcttttggcaacacaaaccatgctacttctgagtctctgaatgttgggattggaagtgtatggaaaacttgagtaagttcctggctctgccactaaatagatgagtgaacttgaacaacttatttaaactctctgagctcctgtttacttatctgtaaaatgaagatatttagagttaaaaacctaggatatttagacttaaatttagacttaaattggctgctgctttggtttcttgaaagaaatactttggtccttggcctccaaagcctctgcttagctgctttaccgattctatgtggtatgtcctcctttttaggttcttt

SEQ ID NO: 17233 - DNA, 621 bp, Homo sapiens
tatgaaacatgtcacaaatattaaggagctttctttgcccaggaaatgacattcatctacaaactacaatacagatttctaactatgcatacacttgttaagaaattggttaattcaaataaaatgtagaatcatcattgatgtaatgaatcattaacaagctctggacaaaagaattccttgactacccgaggggcacagaccgctgataaaatctagaaagtgatttggtacgatcaggtgtatttttactctacagagattcattgatcggtccaaattttaaaacaggctacataataaatgcagttttaatgatctacatttcctcatattcacaggcacttttaatatatttaaatccaaactggaataaatccaaaaaggaatcataaatgcagctgaaatcagccccatgttctgccaagcagtaaagaccactttaaaacaattccaactatccatccatatttctagagccaaaaaaaagctccacatttgtataacttatataataatcacagcaaagattactcatctatatgtgtaataagaaatcactacatggctatagtttcacttatttcttcagatgtggctgcctattacaatccatccact

SEQ ID NO: 17234 - DNA, 587 bp, Homo sapiens
aaatatttgttgaggaactaattataaagactattccaggtgctttagggttcagccacaacctattataagtaatacctattataagtgggtgcttgtaatagatattaccatattatctaagcactcactttaatactcattgttctgggctccacctgatattatgatatgaatctttttagctatactctgatccagaagatcacatgattagcatcaatttctaaggacagtaataaacttgatagttctgagcaaatacatacactacagaatagtcattcaacaaatatttattgcctgcctactatgtagtctatatatacctatatgtaacacacatgcaaagaacagtctagttagtagtttagaaggaaggaattggatgttaaacgggcctgggttcaagcactggtgccaccctttaaaagcagtgaaacattgaacaagtcttagattccttatcagtaaaatgggaataaaagtacctatctggaagaattgttgtgaggattacatacaataacactgatgaaatactagcccgggacctggcataattgccaatttaaaaagagcaactt

SEQ ID NO: 17235 - DNA, 281 bp, Homo sapiens
ccgggtacaagctattctcctgtctcagcctcctgagtagctgggattacaggtgcccaccaccatgcctggctcatttttgtgtttttagtaagcccaaagtgctgggactacaggcgtgtgccaccgcgcccagcgaattcttcattttataatctgtctcttccactgtgagggttgaaaggaacactgaatataacaggtgagttaattaaggggttaatgccaggaagagtcacgaaagttcaaagattctttaaaaaaacttgtctttttagggc

SEQ ID NO: 17236 - DNA, 569 bp, Homo sapiens
agggtctttccagtggccccagtggtcttcgttcctggctgatcctacaagccaatatcccccaccaatgtatccctcccagccttctcctcaccccacgggagggaagaagcatggccccctctgagaagctgatgcaagttatgagcaatttctgcaggaaaatacaacgtcagaaagttcacagaccccctggaggccattcccggcctccctggggtccaagggaaaaggaggactgatccagacagagggagcctaaatcacccagatctggatccctagctgggccctgaaccagagcgggagaggctacaaagaatgtcaaggagaaacgcaggcaacagtgtagcatcaaggttggtgcagtgggtgagagtgtagcatcaaggttggtgcggtgggtgagagtgtagcatcaaggttggtgcggtgggtgagagtgtagcatcaaggttggtgcggtgggtgagagtgtagcatcaaggttggtgcggtgggtgagagtgtagcatcaaggttggtgcggtgggtgagagtgtagcatcaaggtcaacacagggggtagc

SEQ ID NO: 17237 - DNA, 544 bp, Homo sapiens
gcatgtagtgcttttatatttagaaaaatgaaaatatataaagactatttcagttgaaatggacagaaatacaactctagttcaagccaaaaagagagagaaattgaagggagtagggagagagaaaaagaattatttcctggatgaatttggcttcaggcccagatggaaattaatcgtcaggtctctctctttccccctcccccaatatctcagctccgcttcctctgtgtggtgacctcattttcttccattttccaggctgccagacaagtaggttgcccacagctctaggcttacatcatctgctttaggaatcccagtggaaagagactgctctctcccaatgtctctatatcaattccagacaagaattcttagaggtgctgcttggcccacatgtccacccctaaactaatcacagtctctggggaatagagtattaagattgggcaggcttgtgacttatgcccacatctgtcccagagaagaagatatggcactggaagagagaactcacacctgcaatctcagcactttggga

SEQ ID NO: 17238 - DNA, 479 bp, Homo sapiens
gctggagggggtcactgggacttatacagcacagtgggtctgataggtatccacacgaatgtattaactatttttttgttttttgttttctattttttgagatggagtctcactctgtcaccagactgcagtgcagtggcatgatcttagctcactgcaacctctacctcctgggttcaagcaattctccggcctcagcttcctgagtagctgggattacaggcttgcgtcaccacgcccagctaatttttgtatttttagtagagacgggttttcaccatgttggctaggatggtctctatctcttgaccttgtttgtgatccacccacctcggcctcccaaagtactgggattacagacgtgaaccaccgcgccccggccgaatgtattaacttttagcatattgtattagttgggaatgttcactttgttgctataacaaaaacaaaaatatcaatgagtaataagaggtttattt

SEQ ID NO: 17239 - DNA, 360 bp, Homo sapiens
catggactgaaataacagaactgaagaaatgtattctgcaaggaaacatttaggctgagataaatcatttttaaaagatgaaagagtagggagaaaaaaaatagaggcatgaccattcgagtgtgagcttaagtcaaggaagaaaaggaaaggctttaagtatactaaggcacactgagaaacacagacctgtaacagacttttgttcataggatatccctgataatactgattagtatttacaaccagttttttaaaaaatacttctgtagtaaacagtttaattttaagtcatccaattagttaaaaatgatcatctactactacctgaaagctgtaacattcttactacagagagag

SEQ ID NO: 17240 - DNA, 469 bp, Homo sapiens
caatggtgagataccagcccctagaggagaagactccaaagtgcctctgtccctcacccatcaggtgccctgaacaagattaaagctattgcccggaagaccaaagaggtgattgaccgggtccgcaagttctttcggtcaatcatggatggtgtgaaacacataggtaagcacattagcatgtctatcccggggactcaaaatgcacccagtcctggccgggtgcggtggctcatgcctgtaatcccagcactttgcgaggccgaggtgggagaatcacttgagcccaggagtttgagaccagccttggcaacatggcgagaccctgtctctataaaaaataaaaaaatagaaaataaataaaactagccagatgtaatgacacatgtctgtagtcccagctactggggaggctatggtggaaggatctcttgaacccaggggtttgaggctgcagtgagctatgatc

SEQ ID NO: 17241 - DNA, 518 bp, Homo sapiens
atcctggaggctggagggggtcactgggacttatacagcacagtgggtctgataggtatccacacgaatgtattaactatttttttgttttttgttttctattttttgagatggagtctcactctgtcaccagactgcagtgcagtggcatgatcttagctcactgcaacctctacctcctgggttcaagcaattctccggcctcagcttcctgagtagctgggattacaggcttgcgtcaccacgcccagctaatttttgtatttttagtagagacgggttttcaccatgttggctaggatggtctctatctcttgaccttgtttgtgatccacccacctcggcctcccaaagtactgggattacagacgtgaaccaccgcgccccggccgaatgtattaacttttagcatattgtattagttgggaatgttcactttgttgctataacaaaaacaaaaatatcaatgagtaataagaggtttatttccaagtgccctaatagcatgggtgtgagca

SEQ ID NO: 17242 - DNA, 544 bp, Homo sapiens
tagcataccttccaaaaattccttttaagtaaaaaacagtcaaggaacaaaagtgtttaattgatttttttttttaatagagatgaagtctcgctttgttgcccaggctggtcttgaactcttggcctcaaatgagcctacctcagaggatctcaaaatgctgaaagtacaagagtgagctaccaggcccagccaaaagtgtttaagattaaaacataaaggaaaaaataacacattatagcatacaaagtagattttaatggaagtgactttctattgtcatagctttgtatacaagtctggtgtgaaaaaatagttatcttgctgattcataactaaaggtaagaaagaagctggcaaaacatagcacaggtataccacatcaaaaaagagagtggtagtcaacatggcacttgaaggaagtaaaaaatatatacttcaattctaaactccaagactttgccttgaccaacaaaccatttttctctataaggctttcctccttggtttttctcaactctcactccctgcagatacacacata

SEQ ID NO: 17243 - DNA, 620 bp, Homo sapiens
taccttttcatgactgattcaaaatcagtcattaatgtgaggcattgagcaaagctctcagtttttctggcctgtcagtcctcctagatgaatctctacatcactgcaaaggagttgacagtggcttcactagcactcacacatgccctacaagtctgcgctggggtaggtagggggatggtgtccccaggtgttttgtcttatcccttgagggatggaagatacagccagtgggaaacttgggcatagcaacactagacctcctgttccggagtggagagtctaccctatcagtggaggttgtatgtgcattttctaatccagtcctcacaattataagaaaaacatatttctctcataaacttataagaactgccaattaaactgaagcttaaattattggccatatttagaccaggcatggtggcttatgcctataattccagaactttgagaggctgaggtgggaggaccactttctcttataattgtgaggacagaatgatataatgcacttaaagttttattatccactgcctgtacctagtattccttctattaatgctagtcattttttataaatgaattttcatattttcatgaattattcttaaacttta

SEQ ID NO: 17244 - DNA, 583 bp, Homo sapiens
aaatcatatagaaaaattatatgaaaaacataaatttattttagaaaggaatatcagaaaacaatttaaatttaaaactttgtgtatgttgtgtgccaggcactgttttaagagctttacacatattgactcattattagttgtcataacaccatgagctagatattattatcattctcattttatagacaagaaaactcaggctcaaaaaggttaaataattttcccaagtctacacagctaagaaagcatggccagcatttgagtttaggcaatctggctctggaagttatgctcttaaacattccccatcttctcatacctccatgtctctgattatgttgttccctctgcttggaaggctctttggctcttccacctgattaactcttatttgtccttcaaaattggttcaatcctcactgtttcagaagtgtttcctgacaacaccactccatccaggtgagtgagagaccccttgtcactatatttctggaatacctgcccatatctctattaacaacatgtacgctgaatacagtatgtttccccaactagattgaattatttgcaatgactattt

SEQ ID NO: 17245 - DNA, 460 bp, Homo sapiens
ttgatacatttgaccctgggccttctgttaaccagtgctccctatatctacagcaatttatttgtctttaattcatacaggcaatattcttagcattgttttgtggtttaaagttagtctttaacacttttcaaatagcactcagaagagtagctttctacaagagagctcatggcctgtctgacttcctaaatataataactcatagatactagagttaatgcctatttgattttttactctattcttttacactatgtgtgtgaattagcttttgttgttggtggtggtggtggttgcttctttttttaacactcaaaaataatagtttttggttaaaattttaatttcaacgttttggggacagttgggaaaatctgatataataatcttacttccatggtgttatcattaggatcaaaagaaattataggctgggcgtggtggctcatgcctgtaa

SEQ ID NO: 17246 - DNA, 601 bp, Homo sapiens
tttagtatagaaaatacactaaacggtaaatatacaaatgttaaggatagttgtcctttggcagtgggatgatggatgattttaacttatattttcttttgcttatctgttttttcataatttattcaaatgactttttaaaaattagaaaataaaattattcacgcaaattatttgttaaactttatttcattttgttttgaaattaaaattacaagtaatgtatttgcatcttactttgcaaaatattagtgtctattttaacattgcttaatcagcaattaaatgatttctctaatattttgtttttcttagttgttgacagagataaacaattgaaaaaaatattgctttttcctcagccattagtcaatagttgtcatctactttaacacttgaatttttactgtagctgctagaaatggacacactgagtggtttggataaatatatatacctttgtcatgaacccactggcaaaagtattattaagtgccaaagagaacagaagtcaggtacagagaaaacctaaagagataaacaccctatatgttatttctatttaagggacaaaagtagttatatgtttgttcagtgacta

SEQ ID NO: 17247 - DNA, 636 bp, Homo sapiens
atatgatgcatataacacaaaaatacatgttttgcaactgtttatgttgtcagtaaggtttctggtcaatagcaggttattagtagtaaagcttttagggagtcaaaatttatacacagatttttgactacaaggttggcgcctctaacccctgcattgttcaagggtcaactgtagttggacatcagaaagtgagtatgaagggattatccttttatgttttttaaaccttcttggtaactgggcatatggatcaaataatttgtgtatataaatgtatatatatatacacacacacatatatacacatacatatatatatatgttttacatttagctttgttaatcactctcttggctttatttcagcagagctcaaacatagctcaatatagtgtaaaagatcattctttctgactttgtaataaaatctctgtcctgcagttattcgtaaaacaagaaattaagatttttcaaaataaatagaaataaaggagattaaatgtaacagatatcaattgtgtagagacaaagaaagtgtatgaatggatcattgatcagcgacaagatgagaaagaacatccagaacgtacttagagggcacagaaaacacacacacacacacacacacacaca

SEQ ID NO: 17248 - DNA, 629 bp, Homo sapiens
ttcaactgaagtctttgaccaaaggagcacaggtgacccctctctccttcattttctgacctgtagagttttggactcaatgactgattctctcttctagctccaaaatactgggctaaactccatggaactcccttctgagttaaaaatagtagacatgcctgcactatcaacatttttagaaaattatgaaatgcttagagtcactttgtaattgagtctaaggtttgaatgcatagagttcaaatgcaataactgtgttgataacacaacaaagacatgtacatttttatgtacctttatgttctatgcattagtccttcattccttggcatgaggagaagtgatggtttttcagtgaccttccagaactctaaggctgtgtttcaccaggcctcagggtttctacagtttgaacaaatttctgatattgtacccatgcacacctgagtctaagaactctgctgtaaggtgacattaaacagcacccgaagttatatttgagatgattattcagtaatcattgtacagttgattttcgtagtagggattcaaacactgaatagagtgcagttttaattaaatctgcatttctcagttgaaactttattttagcagtacatgatttc

SEQ ID NO: 17249 - DNA, 584 bp, Homo sapiens
ctaaagaagtcatatagtccaacctaacatatccaacagaaatataatacaagttacatatgtaatttaaaattttctagtgtctacatgtaaaaacaggtgaaatttattttaataatatattttatttaacaccatatattcaaaatatttatattccaacatgtaatcagtataaaaattattttctcataccaagtcttcaaaatccatgtgtgttttacatttatagcatatctcaatgtggatgctaaattttcaatggtcatagtaaaatgtattcctaccaaaacgataaatttgtcttaatagaaaaatgttacactacttctgtttctaaatttaaaacaattagaacttcagttccttagtcatattagccacatttgaagtccacagttgccacacgtggccggtggctagaccgcacaggtcccacctgatacgtagcaaggtgcccaattaatgtttattgaaatgaatgattgcataatctgcccaaattccacagattactggctgccactttcatacttttccttaaataattacttgagaggaattgaatatgggagaggaaaatg

SEQ ID NO: 17250 - DNA, 636 bp, Homo sapiens
tattatcagccaataacttacctgttaaccttctttgttgagtctttttaaattttccactaccagaggaaatctcaagcaaactttgtaagatttccaatcactttcaggtattaattaagtagtcttctcttcagataggaatgaaaggaagaaagagagagagacagaaagagagagagagagagagagaaggagggagggaggaacagaaagagaaagcaagcaagcaaaaagcaaatctggttctttttatagggtgacttcctcatatgacagcctccttcttgcctctctctcagcacagggctgacttctgcttggaagcctgcagcagagaaagaggagatcttgttagttttctctctctttttgcttcacttccttcccaacccattagctgctattttgggtccctaaagaaggagcaggggcaggacaagagggttaacaatgaaggataaagtctttcttaagaaggcagctacagtggggctggtgtcccttgagtgagtgccctgtcgcctgctgcctctctagcaacccttctgtagcttcttcagagactcatccacctgctgttccctgatgctatgatgcctctggccaactacttataatgcccctactgctcct

SEQ ID NO: 17251 - DNA, 577 bp, Homo sapiens
gtatcaggaattcacccatcaatagtgtcttatgcttttgccattgcttatagcgggcttgttgcccaggtgcagattactccttgtgggtgagggacgtcaggaagaaaagaagaaatagggcaaagactaaggaagacagtgtatcacacaggacaggttaagttatgctgcgctgattaaacatgcacacacacacacacacatacacacacacatacacacacgcacacacacaatcccaatggcttaaaacagtaaatgtccatttctgactcacactacattgaccttcctggatataggattttggctctgtttgcattatcaacatctgcattcagggatacagactgaaggcacagccactgtttatgacaatgcatttcaccattaccatgagaaaggagaacatgttgttgcatgctctagctattaatgctcccattgagagtgacaggtgtcagccatgctcacaggtcattaaccaaataataatcacataatcacacctaatgagcaaggaagtacaatcctaactatgtacccagaagggaagagttgaacacttattatt

SEQ ID NO: 17252 - DNA, 557 bp, Homo sapiens
tggggtgcatgtgcagaatgtgcaggtttgttacataagtatacacgtgctatggtggtttgctgcacccatcaacccatcatctacattagttgtttcttttaatgctattcctcgcctagctctccacctcccgacaggccccggtgtgtgatgttcccctccttgtgtccacgtcagaaccagtatcttaaatatgatctatcttagcataaaatcccttcttggtaagttaagtaagcatcaatcaggctctaagagagagtctatgaagtgctcagctttactgctggggccttcatacatccaggagcatttgttcatttacttcaaagttcatgactgggttctagtgggatgcgtttgcttgaacccagacctttaagtgaaggggcattgctggggaggaattcaattttttgggtatctaactttttttccttggaatcactggtcatttaaaatgagcatttattcttgcaagccgttaggatttagttttcctccaacgtgggcacttcagcataggtttcgggtgctactgtgacatacagctc

SEQ ID NO: 17253 - DNA, 286 bp, Homo sapiens
attccctcacacccggccccactctccttttttctcttcccacctacttggtgaataaaacgataaaagcatatttggaaaataatggtgacatgtcaaaaataatttgtttcttatttatctcctctcagacactgccaataagaaaccattgccactccatccccagcccactctgctgtaagttggaagcagatgatttgctctcctgaaagagcagcaaatccgttgcctgggtgatatctcattactaaggcaaccaatttggcgcatcagtgtgaatccc

SEQ ID NO: 17254 - DNA, 487 bp, Homo sapiens
tgtttactatctgtccctttatagaaaaggtttcccactccctgcagtaaacgaaacagaaattggaatggtgagagaaggggatgcagtgtagagcctctggcaggcctttaggagaaattatggcccagattcaggggtttatagtgaggccaggctctttctttctaggaataagagctgtttgtgggttcaatatcaaagaaattatctcacccagactgatctggatattggcactattaagtgccccaactgttaacctcaaagaccattaaagttgctcctaacttgtttccaagatccaaactccttaaagtagggcatgaagtgaaagtgtgacctaaactgtctatgataatatgggtgttacctaagttagcaaattataaagttgggcttgtgcatcagcatttcactgaaacctggagagaaagtgtatgaagacaaagaaaggctgaaagaaactagcacacaaacagaaagc

SEQ ID NO: 17255 - DNA, 480 bp, Homo sapiens
gggttcaagggattctcctgcctcagcctcccaggtagctgggattacaggtgcccaccaccatgcctgactaatttttgtatttttagtagagacgaggtttcaccttgttggtcaggctggtcttgaactcctgacctcaggtgatctgcccacctcagcctcccaaagtgctgggattacaggcgtgagccaccacgcccagctcctattcaccacctttctacccatccatccaccgatccaaccaccctcactccctccctacctcatgcactcattcactcagaggcaggctaacccttatgctcatctttattcctccccctgcctgctttgtgcccttgagccaggccctccctgtctctggcccttgctttcctcctctgcacagtgaggctgatgagagcacagacctccaagttttgcacagtggcctcaggccacacacagttgttatttgttgtgacagacagcaaa

SEQ ID NO: 17256 - DNA, 342 bp, Homo sapiens
tgtcctcctcagtagaatgtaagcttcttgaagtcaaaggcatattatggtatgtacttaccatgaatagtagatgagccaatggtatttccaaggtcacatgtgtataactcaagcttgcagctttttatagtgttttacttgttttcaaccatatcagaagagctttgatttcacatttttacattggcttcttccttctcaactgaggctttctttccactaaaagggacctgctaaataaagaaagaattcatggtctcattataattctccacatgccagaggaccttgtggtgaggtcctggatcacatgtgatgcttttgacctttactgactct

SEQ ID NO: 17257 - DNA, 498 bp, Homo sapiens
acatgattagataatttctccactattccaacatgatataacctagtcttaattgtagatcccagtattaaagtcgttttttaattaacagaaataacgtgctgctgattcattttcttagttgtacctactgtgtgatcttttgacttttttctcataaacgacttccatctttaatcattacttacgttatatttacagagttgctcttatttaggggcccgaagtggcactaattctagtaaactttcttccatttacagctgactatttttcagtatttacgataactttcagcattagaaaagaaaccccaaaagacgagcagggtgtggtggctcacgcctgtaatctcagcactctgggaggccgagacaggcagatcacttgaggtcaggagtttgagaccagtgtggccaacatggcaaaaccctgtctctactaaaaatacaaaaattagccaggcatggtggggcttgcctttaatcctagctacct

SEQ ID NO: 17258 - DNA, 537 bp, Homo sapiens
aatcagaaaagtaattacaacgccttttaaaaagagcaaatttaaaaataaaaagattaaagtcttcttttcaaaaataagattgatttaacaaaggggtcgcaggtagtaaaatactttatcctgccgagaggtagaataccgatgcattacagatagtagaagaaaaacagacattcaaatgcagtcatgcagtgcatggtaatattttggtcaacaatggatcacatatatgatgtcagttccataacattaaaatggagttgaaaatttcctatccctagtgatggcagcgccattgtaatgtagcacaatgcattattcacttgtttgtggtgatgctggtctaaacaaacctactgtgctggcagtcatttaaaagtatagcacataccattatgtacagtacatactatttgataatgttaatatacgactatgttactgggttatgtatttactataatgtactttttaattgttattttagcgtgtactccttctatgtattaaaaaatagttaactataaaacaacc

SEQ ID NO: 17259 - DNA, 552 bp, Homo sapiens
ggagctttctgatgcattcccatcatagacttcactgtgccttaaggatctgtatctctttccccctgaattgagcaggactgggaagtagcggagcgttgattccttttatcatctaaggctaacccaaacagagctaaagcaggttactgcagaaagcacaacaaaaaaaacaacaaattgacctggacttttctttctttcttttttaatacataatccatgatgctcatctttctagaggcaattaataacatatgtgacgggtctttcttttattagcacatgcttttgctacaagattatgtcttgctgtgcatcccacaatcatcaactaatatatgtggcattaacttgttcctttttaatgaggcactaaaaagtctcaatagattcaacagattttttttttaaaaaaaaacaaagaacaaattgaaaacctcagctcactgacattgtaacaatttaattttaaatatgtagaaaataaaccataattatgtccaaatagcttaatttactcaactagattcacattttaagttaacaaag

SEQ ID NO: 17260 - DNA, 515 bp, Homo sapiens
acccatccacccatctactcatccatccatccaaccatccatccatccatccacccatccacccattcatccatccatccacccaaccaaccatccaccttttcatctatccacccacttgtccacccacccattcctccattcatcattcaaccctctcttcctaccatcactgtttcatccatgaagatttataaagaagtgtaacatttggagtttataaaccagtatttgagacctaattctaattctttccgcctgtgcaatcttggacaaatagttaaaattatctacattttttgtttattctttggtaaaatgggagagagtgcttatctttacattatgaaactactatgagaagtagatgattcagctggttgggtgtggtggctcatgcctgtaatcccagcaatttgggaggccaaggcgggctgatcacctgaggccaggagttcaagaccagcctggcaaacatagtgaaacaccgtctctactaaaaaaaaatacaaaaa

SEQ ID NO: 17261 - DNA, 557 bp, Homo sapiens
ctttgtaacactggcagtatttaataagcgcttaccagaaacccaggtcctttattttatttaaggccatatatcatgtttaatagttagtcataatcaaggggaatgattatctagaaaagatatgaaaaatatacattccagagcagcttaaagtcacattttttaaaagtccaaaataaactcttgagggctgtggatagctttaagtatgatataatttatgaaatgagataaatctcaactgttaaaatatttagtggaactgagaataatgagtccagataggattagtttaattagtttactgaaatggagtcttcatagtggctaagtgtgatatattggcttttgtcacttgaaataaaaaagaggtaattagtccctactcaaatatattgttttctcagaataggttgaattttattttaggcagtaatccagaaccaacttccaactgatttataaatgctacaagaaaagatcatccttcagacaacttaagaatccaatcgcgtaaaagcaggattctcaaagggagaaacatttcatccccc

SEQ ID NO: 17262 - DNA, 347 bp, Homo sapiens
acactttccatttccctaagactcctcttttggtaccctgacaaacctagggctatagtaaccttgctctgcatgtacttcatgactatatctgtgtctggagcacagtgctaggaagaatgaaaaaaaaaaagctttcattaataatctaaagaacggcctgacaactcttggtactatagctccaccagagaggatggttcccctttctcagtattttggcttatgtgaattcttgatgttaccactaaggtcgggggttggggcagcagaaaataaaacaacaggaaaggggtggtgagcatttggcatattctgagtgttgagttcctttctcattcctcaaa

SEQ ID NO: 17263 - DNA, 522 bp, Homo sapiens
tgctgttcaatttttaaatttcagcaaccaattaagaataactatagaccaaataaaacctgaactatagactgaatctagcggagaagaggaaacacaataagagagactattccattcatttcatgttcaaataagtcaacaggcattaagtcatttttaaaactattgctgttttagcagtaaaatgacagagctaggtcatcttctttattgcactgatagttccaccagtcacgattcttagtgttgtctggttgacatactccaaagtctttctaagaaatttacatacaattttgtgagtttcttttagttgtattgtcttatctcaaacaagtccccctacccaactttttgctatgttactattattttaaattcaaattttattttagatacaggggatacatatgccataatcctaaataaattaacacaggaataggaaaccaaataccacatgttcccacatagaagtgggagctaaacatttagcacacatggatatcagcatgctat

SEQ ID NO: 17264 - DNA, 590 bp, Homo sapiens
agacagcccagatatctattaccgtaagtctgcaaatatattgtacctagagttaaaatgcaatctcatgctctataagctttattgcatataaggaaaatgcctaagaaaaggccagtacctgaagaaagagctatgggaagggtcagctaaccagaaggcacctttttttctgacacagtgagaccatctaagaactgcaatgaatcagggaaatgaggctctaaggtaaaaccaggaaggccaggcagtctgcaaataaggggaagggaactatcagcatgaagctgtgattcagacaccagacaaacagtcagaaagtagagaatacagggcaagccaaggtcaagacagtgatgcatgaaaagccaggtccaggtcagaagaacagatctaacagtgagacattggagacttggtctcacccattcatcagaacctaacacagactacctccaacagagagctttggaattcttcccactgaagacaactgagacaacccgaaaagtggcccaaaaatgtaactgatatgtaggcagctatctcaatcacatgctgatccttcccacatttatggcaaataccat

SEQ ID NO: 17265 - DNA, 577 bp, Homo sapiens
tcaccgtgttagccaggatggtctcgatctcctgacctcgtgatccgcctgcctcagcctcccaaagtgctcagattacaggcatgagccaccacacctggcctccctcatgtcatttttatccagttgtgaaaatttatttctcacatgttagtctgctggttaattaaaatgacttttattggatggtgatactttgatcgtacctgataatactatcttaaatgaaataaaaatatttattgatagttcttgctttttattgaatattaagtgcagtacagctcacacattaagtcaaataaactagtgattggataacaccttaaagggaggtacttaaatatttgctaccgaacgtcttgttaatttattgatattttcaaatggagtctctttcaatatcaatcaattgaaatgtgattttacttaacaaattttgattacataagatacggatatgtttctagtctctgatcacagcctcatgttgttggagtcttgctgttctgcagcccatcatctgctgaactaacatgccctgttagaaaatagttaatgcttatgggactcaact

SEQ ID NO: 17266 - DNA, 641 bp, Homo sapiens
gtattaaaaattaatggttgggctggtggcaggggttaacaccggtaatcccagcactttgggaaaccaaggcagggggatcacgaggtcaggagattgagaccatcctggccaacatggtgaaaccccatctctactaaaaatacaaaaattagctgggcgtggtggcaggtgcctgtaatcccagctgctcgggaggctgagacagtgagacaggagtatcgattgaaccagggagttggaggttgcagtgagccaagatcacaccactacactccagcctgatgacagagcgagactccacctcaaaaaaaaattaataataatcaaaatgggtttattgaagtaataaaaatatattttagcattagaaactctagattaaggaagaaaaatcacatgctcttttaaatatatttacataaataattgaataaaatccaacatgccatatccactttcacacagaatggagagtagacaactagaaaagccagataaaagactaaactcctctgtttaacagaatcagagagctgttgaatgtctaagtttaaatactaagagctagagtcttgagagagttgtaccacagaaatcaactgatatctgaactcacttttcccctggaagcattactt

SEQ ID NO: 17267 - DNA, 474 bp, Homo sapiens
tagaattttagtcatgaacaagagacatataatcttattacatttacacagtttgcagtagactttgaaattcatattagcattcctgaagggaagatagttctgtgactgagaaccgtgtagctagaagagaaatttcttactaccagttttacaaatgactgcattcaccaatttaaaaaaaattaccccacccacccatcttcacatccaacatcaattttatcaatgaaatatctactgggatgtgggtgcagtggaggtacaagaaagggttactctgttctttttatcatagcttattatgttaaaaatgggaggctggcacaggacagcatctctgaatctgcagttagttcatactgtgttactaaagcatcactgccttaggttgctcatctcttttaatatttatttttaatttatcatcaatttaaaaaagtgtgcacattctacctgaagcaaccataaaag

SEQ ID NO: 17268 - DNA, 580 bp, Homo sapiens
acatatcccagtcattcccaattaaatgtactcccagctctactgctctttagctggctcccaaaatgcccatgcacactaccatactccctggcaagggtgtgtgtgtgtgtgtgtgtgtgtgtttgaaggaggaaaagttggagtggaaggaagcaatcttaatggttgtggtaatagatttcattttctcaggatttagaaaaacataagtctatgtgaaaacattgctagggctcctcctatgttctcggaagaggcccttacaagtgtgggtcccaaggcttaagcttcattatctttacagtaaatttgtctttgctaacacgtattgaggattcatcaaattctccagagaaagggtatggcactttccctcaccaacaactccatctctcaggctcacattcagttgtcgtaagtcaagcatatgctttaaaatcctctgtttttaattggtgctgtcttaattctcccattagcaccatcatccccctcactacaaaagcctttcattttttttaagtgagcatttgcaaatattaggctgactctggacataaagtagagttaacatcca

SEQ ID NO: 17269 - DNA, 498 bp, Homo sapiens
tcttccatccacagttttcatgtagtttagggcaaattggaccccagagcaaaggcaagaagaatgttttgagaggcaatgatgagacgtctgtgtggaattcgagataacttctttttgttcataggaaaagttataaaaactaatttctagaaaatcagttgtaatgtcctcatttaatttctaatttttgttgagtcttctttttttcttaatctagctaaagtcttgtccacttagtttatctttctgaataacaaacttttggttttgttcattttctctactgttttatattttcacttcatttatccctgctgtaatcttcattatttcctaccatttgctagctttgaatttagtttgttcttctttttctagtttcttatggcataaagttaggtttttgagttgagatttttcttcttttataatgtaagcctttatagctataaatttctctcttagtgctgctttcttttcatcttgtaaattttg

SEQ ID NO: 17270 - DNA, 523 bp, Homo sapiens
agcaaaggcgatcttaggctgcagcaagaggagtgaatcttgcactgctcaggccaactgtatctggagctctgccttcagttctgggaaacatttgaggaggaacatggagaaactggaacacatttggagcatttcaaccaggagggtgaagagattaaaaagtattcaaatgaaggacagctaaagatgccaagtctccttcccttggagaagggaagcctcagagatacataaatgctgggtttcaacattttggagaattgtcttatggatgaggacccaagtgccaaggcagaaatggtacagagaaccagggctcagttcagtgttcccatacccttcaaacatgtgtctggttaggggaagggctgccccggatgaagttagctccctaaccccacccctaaagttagaaatgtgaaagcagtcgatgggtaacctttggccagggatagggtggagggaatgggtggccatcacagcaatgatggacacacctgagatggaatgcagaaagagt

SEQ ID NO: 17271 - DNA, 443 bp, Homo sapiens
gtttcaccttgttggtcaggctggtctcaaactcctgacctcgtgatccgcccccctcggcctcccaaagtgctgggattacaggcgtgagccacagcgcctggcctgtaccatgcattttctttgcgttctgctattccaaaagaaatattaaatattggcattttaaaacataaaataattagaattgaaattttaaaaactcttgtttaatctgtagcatcaacttaaatgaaccatcagtggtgtgcatcatcctttgatatgactgagtctgctttttgtatccagatatcaattatttatttgtttttgcttctacctaacttcttccttctctaacaattcaagactcacaattttctaggattcaaagaacattgttttttgagtgctttagaatcatttactcattcattctttcacttactaaaaaacattta

SEQ ID NO: 17272 - DNA, 525 bp, Homo sapiens
tatttgtacttagcagaaacgattgccttttgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttcggtgctacccaagtacactagctcttt

SEQ ID NO: 17273 - DNA, 564 bp, Homo sapiens
taacatctttcctgatggaaaattttgaggttcaaaaatttttactttataaattacaaatgatccatcatagcttcaaaaatccccacattgtaatcacctttttagtatatatacttgaggattgatttattcagtcataaccacacattcagagacaatgacaaggccctgggctaggccattatgaattaagtctctcttcttggaacgactaacttgtgaccttacggtgcacaatactcaaacttatatctcagaaaaagctgccatgtcactgagcttcagagtaattaatgaagaggagacacagcagatgttaaattcccaaatgccaggagtcttttgcaatgaggacttcttgaagacaatgaccacacctcatactgtgctggataagagccttacacatagagcaggatgaataaaattgtgttcaatttaagcgtgatgcattcaattcaagtctatctgtacttttgtatttagaccaggaaaaaagataacccataaggctaagaatagaaatagtggttaaaatgtaatgaatgcatgccatgtctc

SEQ ID NO: 17274 - DNA, 478 bp, Homo sapiens
aacctagtgtgtaaacgtggttaatctccggcttctgtttaagcaatggcccatcttcctggaaacatccctgctctctgagccctgggatcttggaatagaaccacttgccggaagtggccattgctgctccaccactgtagaaaaatctcctgcccaggtgcccaggcttctctgttttatcagctgctgcaagattctccatcacctccccaagcagacccagcaggaatccaaccattgcaagcctatcacttttcaacaacgtggacacttacatggtaagactagatccacgttatgctggagtgaggagaggctcagtaaagcttcctatctcccagagaagctatgtgctgagaactgacccagccagttgtcctggacagtaagtgaatcaatcggtagaagcctctgctatgcgcctgggctctgtgttcagtactgtagtttatacgaaagaagccaagaaagatgt

SEQ ID NO: 17275 - DNA, 365 bp, Homo sapiens
cctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccggga

SEQ ID NO: 17276 - DNA, 452 bp, Homo sapiens
acaagcaaccacaaaatctcagagtcacaaacatttatatttcactgggcacctgtaggttggctgtgatttagctcatctaagctgggctcagctgggctgggttccaggctctgcagtaggtccagtgtatacagcacccttgatgtaagtaactccatcttagaaaaatacttcaacttacttttcaaaaggcatcaagccagctgggctcagatgttctcctaatcaacagagataacacccaaaaagataagggcataaccttttactatcagtcctcagcagaggactccagggccataaaatgagcagaacatcaccagctaggaatggccttcttgacagactctgtcttgctgtcactcattattagcacctggcatctgctgctgaaggctctgcccacattaaggactgttcttgccagacattgatgactgtcggggtca

SEQ ID NO: 17277 - DNA, 489 bp, Homo sapiens
gtcatttatgagactcaactggctttgtctgctcagggcttcttcaggcctggtcttcactttaacacaactataagtgaatatagctataattctttaagactaaattcaaaaatataaataaagtgaataaattttttaggaaaatatagattaccaaatctaactgaagaagaggaagaaaatgtgaatataccaataatcatggacaaaattgaaaatatattccaagaattactcagcccagatggttttacaggcgagactatagactgtcagaaatagatgaattttatacaatttaaaattctagggcatagcaagagacggaattcctcaagtgctgttagtaagttagcaaaactttgatactaacacatggttttaccataaagtttcataaaaccgaaggtaaacatcacttgctaatatattaatagatataaaaagaccaaataaaacattaaaaaatatgagtatatatatcat

SEQ ID NO: 17278 - DNA, 457 bp, Homo sapiens
ggcagggcatggtggctctcgcctgtaatcccagcacttggggaagccgaggctggtctcaaactcctgggctccagcgatcctctcacctccgcctcccaaagtgttaaaattacaggtgtgagccactgctcccagccagtataaatgtttgtgtcagttttcagccccctgttccatgcccccccataccatgcgcacgcacacacacacggacttagattctccccatttgagcagctttcctccagctgtttgggcgagtgtgcagtgctgccatataaatgtgctcaataaagcccatggtgatgactcatctcggcactatctgagctccactttccccatccagagtcccgagtttctgcattaaacgtggtcgtcataacccagttctgtccggcaggaagcccttgctacagacctgggtccagtgtgtctcctctggacagttggg

SEQ ID NO: 17279 - DNA, 582 bp, Homo sapiens
aaaatattaggcttaaaattcctttgcatatccttattcctgtgattcctgacgaatgatgttttacagagttcagaaattctgaaaataaacagtggttgaaagtacacagcaaatgggacgttaacgcatgacatcatctcaagaagctcatcctcaaagactgaaagtcagattttaagcctttaaaaataaatgaatttacttggattcaaatcaaaccacagtaaaaaataaactttattttaggaaatacctttttaaatgttctaagcatagccacttaactttttaaaaatagtattagcagagagaacattttttttatatccaattaaggtatgactcattgttcacttggaaaagtgcggattttgaactattcccttttaaaatcattgtctacatttttccatcttaacatagaaatcatttcaaccagatataaaaagataaacatgcagaatatgtctcagactttcaaaaccatatttttttctgagaatgatatatttttagttcaggtttctttcaaatgcatacagaagcaacctgtagattcttattatgaatatcgaaaag

SEQ ID NO: 17280 - DNA, 477 bp, Homo sapiens
taatcccagcactttgggaggccaaggcgggcggatcacgaggtcaggagattgagaccatcctgcctaacacggtgaaaccccgtctctactaaaaaaatacaaaacattagcctgacgcggtggcgggtgcctgtagtcccagctactcggggggctgaggcaggagaatggcgtgaacccaggaggaggagcttgcagtgagccgagatagcgccagcgcactccggcctgggcgaaagagtgagactccgtctcaaaaaaacacaaacaagaaaagaagctagttagctctgtcataactgccagtgattcatagtcccacatgtttcagagcaggcaggttgtacagaaagccaactaaggatgatcaaaaactttcagatgatcttgactgttcagttgaggtttgaaattaaaaatctatatgagcacctgactgtataattatgtaattttttttttccagtaatataa

SEQ ID NO: 17281 - DNA, 627 bp, Homo sapiens
gttctatctgatggcgaactttggttctttcttgaatagtatgctagttgacaggttgtggtactggagaaattccttcatctatggctgaagagttatgaaacaaattgctataataattataacattttttaaagtttatgaaaacttctaaacagatgttgcctaaagagcaaaataaaataaaaattaatgtaaataaagaagaacagttgtagacaaatactctagggcattaggtaatagcacataaaatctataattttaaactactttttacttataaaaatggcaattttgtatggctcaactaaatagtaaaacctcaggataaacctgcttatcatattggcgtgtatattaaaatgctaccaatggcatgaacccttattaatatattaaaaatgcaacaaaaacaaaaaaattgacaaatgggacttaatcaaactaaataacttctgcatagcaaaagaaacaatcaacagagtaaacagacaacctacagaatggcagaaaatatttgcaaactatgtatctgacaaagagctaatatccagaatctataaggagcttaaacaaatatacaagtaaaccccatgtaaccccattaaaaagcaggcaaaggcc

SEQ ID NO: 17282 - DNA, 479 bp, Homo sapiens
agagaatcggcctgaagctccctggagctccctggagggttccaccccccttgctccagctcacccagagttctacgattcaaaacagctggaaatgtgtgccctgctctccccaacaagaaaacagaacagaacatggctgtttctgccaagcgaattctgaataagctgcattccatttcattaaaacaattacctgagctccagccaagaattacataaagcttcctcccagcatcaccccctcccccataaaacacacatcatgctgctttcaaataggcagagtgaagctctgagccctcgctagaagacctcatagtcctcgccaagtggccagcctcggcatctctgcacgctgacatagatgacatgaggctgaaagaagaccttggcatgaagccctcccctcatgagagcctgctggctgcccgaaatgtttctagtaggcaccagggccctcacctctgcctcagagc

SEQ ID NO: 17283 - DNA, 603 bp, Homo sapiens
gggctgctttcttacctcatcattgataggcacacttgcactaagccttacaatacctctgtccataatagctgacatgtgtatgcaaaaggtaaggaaactatttattattcatagatattttaggtgtgttattaaaacaaacctaatgaaagttgagatgtgattaaattataaggatacaaacataaataatacttgatgctttctctcccaaggtgctttactacatagaaatatagaaagtaccgaagaaatagataatttccatttttagcttttccatttttttccctaaatttctaagttaagggcatcatcttcatatgtagttctccagtttttgagctgattctgttccagatgttctttggtaagtcacattttatcatacaagcattttagtttctgcgataaaccctatcacaggctccttaacactgtgctgaatgagcagcacaggaatcatgctgtttgcagtaaaagttagccatctctctctggactcagcagagtgggtatcccatcccttttctctgaaggcctagtatggatgtggggattcttgtgataaatattggcaatgctaacaccacagaaaag

SEQ ID NO: 17284 - DNA, 603 bp, Homo sapiens
tctggcctgaggacactatacacacagagcgcagtctatgtggaggccagaaagtggaggtcaaacacatatgtctacttattatttgaatttatttcttattcttcctatttttttaaattttgtagagatagggtctcgtcgcattgccaagggtggtctctaacctctgggctcaagcagtcctcccacctagacctcccaaagttctgggattgcaggagtgagcgactgcacctgaccacagttttctttgttagcagtcaaaaaagacgaagaaagaacgtgttcagctgtaattcctaggaaaaaatatgttcgggccgggcacagtggctcacgcctgcaatcccagcactttgggaggctgaggggggcagatcaccaggtcaggagatcaagaccatcctggctaacacggtgagatcccgtctttactaaaaatacaaaaaaaaattagccaggcgtggtggcgggcgcctgtagtcccggctactcgggaggctgaggcaggggaatcgcttgaacccgggagccggaggttgcagtgagccaagattgcgccactgcactccagcctgggcgacagagcgagactccgtc

SEQ ID NO: 17285 - DNA, 623 bp, Homo sapiens
gatatagaaaggggtgcagtggtttaatattagagactagaaaagcagacaatctaccttaaaatctaatgaacatatttattttaatgcattagtacaatgtatgaatggtatcttaaaatgacttttatttaaagcttccataaaggaatatattaagagtctggaatatacccatgattatctggaaacagctggttccgtttcaccatcgtttcaagtgaagccccagttttgtgcttttctgccagaaataacgtcagcccagaagccctgaatcccaacagcactgaactgccggagttccacccagtgtgggcacgtaagtggcttcctcaacccacagaaagatgtgttgctaagaccgtaaggtgaccttttaacttcttcagagatagtttcagtcatgcatatctttaaactgctacatctcacccttggttaagccattttttagaaaattatgagatctaatgttgtcacctagtctgaaatactgtaatactgtggcaaagtcctacaacaggcagtcattaataacaggtagaaagaaaagaccgaggagaatggctagtaagacatggaagtaagtgattaaaaaaataaaattaatcttgacatct

SEQ ID NO: 17286 - DNA, 586 bp, Homo sapiens
gacaagcttccctgatagacaacacttcacacaagtttccataccttgttattcagaaaattaagtgcatcctatgtgactccacaaggagaatattctggggagtttgtatctgatttcccttgttcattttgctttctaccttttcagtctaccacatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagaacagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataataatatacatgtccaacaaaatttaacttgttctgctatcatgaaaagagga

SEQ ID NO: 17287 - DNA, 497 bp, Homo sapiens
ttaaaccgaatcatattgtttcatttcacaacttgggctagtgagaatatgattactgtttaagaaattcttctctgtgaaattgttccctaactcagttatcaccaccatcactatcctagtcatcttgtctagaagtgtagaagttatcttcgatcaatcttgattctatgactccaagaattagaagtatctaagataggcggtatctgaagggagagtaggctgctattaagtgactcaaatccaagtcttccgtctgctaagccacattctttccattatgctgtactagctcttcctcaataacttaaatctaaagcttttagagctagcagagtcagtatctcatttaatcttggtaatgaccctgagatgtaagctgaggcagacctaattatttctaacatacaggacactgggtatctaaaggataaaattctttgttcaaagatgttatatctaatgcctagtaatatctataagacataactatt

SEQ ID NO: 17288 - DNA, 598 bp, Homo sapiens
  misc_feature 335: n = A,T,C or G
aaagcaagcatcttcctatttgccttcaaataaaacaggtttagggattatctgctcttttcacatacttaaacacaccttgagtttctttttatagactttcctttctcctgacactgtgaaatcccagtgctgtttcttatttgaatgttttatcatctgacacctaataataaaaagtcattggcacaataacagagtttcatctttcttaaagtttaaaaatgtttagaaattatttcatttcttaaataaaaattgcagtagaattaagtatttccctagagagataaagattgaaatttgaaagtaaattgctactaactttgagccanattcattttttttaatgtagtgctaaaaccaaggagtatcatataaaacaggcccaaggcacgttttgtacctaagctaaaaattacttttgtggcctttgacatatcaaggaactttgctattataatgcaagcataagatgaaatttattcaaccttttgaaagtttaaacataaaaagtttaacataagaaactaaaaagtttaaacataaaaaacagttattgtctgtgcaaggactcaaattctttcactctcttctt

SEQ ID NO: 17289 - DNA, 612 bp, Homo sapiens
actccacgtggctggggaggcctcacaatcacggccgaaggcgaaagccacgtcttacatggcggcaggcaagagagaatgagagccaaatgaaaggggaaaccccttataaaatcatcagatctcatgagacttattcacaaccaagagaacaagggggaaaccatccctataattcaattatctcccactgtgtccctcccacaacacgtgggaattatgggagctacaattcaagataagatttgagttgggacacagccaaaccatatcatctgtatatttattttttgactacttgttttttttctctaccatttggagtccccagagcacaatctcttagagcctcttgtctgatggtttctttttccagtctactctattcaccattgcttatcagagaatggtcacccatgtatttttaagctttagagactggttgtataactaaataaattgtgggattttaagacattatgtgagatactgttatccacaccatgtgtcacaatagaattattttatccttcatttttaaataatgcccaactcattttctcccttcaatgcccataatttgtcttggatgttttccctacttcaattaaa

SEQ ID NO: 17290 - DNA, 591 bp, Homo sapiens
agatcggagacagttcctttaatgctagagatttaaaaaattgcattcaatgctgactacggaaaatattaagggcaatatttgtgatttgctccactacacatttattttcaggaaataaataaagagggtaacctgtcttgttagtaaagagatgcatcgtttgaagcattatgcacttcaagaagaaaacctaattcttaaatcaatgcttaaagtatatttggacaacaataggttttattcatgaacagtaaaacaagctgttaaagtgcatctgataaatataccaggctaaaaggaatcaaatatagtgggaaggagaatgctatttgaacagaataaaaatgcaatggcttatatgactgacaaaagctaaaaagaggctgggcatggtggcttacgcctgtaatcccagcagtttgggaggccgaggcaggtggatcacctgaggtcgggagttcgagaccagcctgaccaacacggagaaaccctgtctctactaaaaatacaaaattagccagggcgtggtggcacacgcctgtaatcccagctactcggaaggctaaggcaggagactcgcttgaaccc

SEQ ID NO: 17291 - DNA, 654 bp, Homo sapiens
tttattactgtccctgtctctcaataactgcgtgacttaacaagttttttaaacatttttgagcctcattttttatgtatgttaataacatttgttctacagagttttgttttaaataatagatgcaacaacaatgacaaagtacttttaagctatataaagttaggattttcagaattattttgatatcaaaatgttactgtgacacaattcaaatttcagattaagaaaattaataactgtctcacctgaattatatggaacaatacacaagtattctatatacacacaagatagaaagctaagaataagaagtaaacaaaaaccatcttgtatttatagaatactttctttaaaacaacctataactcagccagaatttactggttacaaggcatatagttatctataaatacaaagaagccctcaaggaaggaaatactgaatcatatttttatgctgctactcatgcatttttattaagaatttcaaaaccaacacttgaaatgaaactgagacattgtaaaacatcggttttacaactctccatttctgcctactccaagtccaagaaacgtttgataaattttgaagatactatatcctgagttatttctaattgctcatttactcatttatgcattcatccaatca

SEQ ID NO: 17292 - DNA, 627 bp, Homo sapiens
gaatcgcttgaacctgggaagtggaggttgcagtgagccaagatcacaccattgcagtccagcctgggcaacaagagcaaaactgtctctcaaaaataataaataaataataaacatagaaggtgtatctatgcaatgagcaactctgctggccactttgtctattctgtcagcccactaacaatgatacacatcaaccattctcacatccatcctctgcttctagaatgtcagctgggctgaagagcatcttgcactggtttaccaacaagcccacatgaacattccatttcaggctcaagtaccacaggatattatacatagatgctgagactttaaattagatttctgtacctgagggaatttgtaaagagtctttgtttcttaacttcttgtatttgacttcattttaagctccccccctggaagaagggccttggagaatgaaagttgtgtctctttgggaggcacacaaagcttttcctatgtggtaattgattaaagaatggaagaatgcaggcttttaggaatataaggcttgggaaactgagtcctgctgggtagagagatgatctcaagatatcaggaaagggccgggcgcggtggcttacgcctgtaatcccagca

SEQ ID NO: 17293 - DNA, 86 bp, Homo sapiens
agcacctgtcctcgttttgccagaatgcaggatgcagatgccagtccccactcccacacccaaggcagactctgctaacagactat

SEQ ID NO: 17294 - DNA, 649 bp, Homo sapiens
cattccttgtattctggggagagggacctcctgtgctagatgctggattgattgtgaatgggaaagtgttcacatgtatagaatgccatccctggtgggcgtaagataggaatcttcactgagaaaaaaccaacaacaactaagagttaagtagtagggaagcctcactgaggtgccatttaaagtcagcaatcttgagagagtacagtgtcacactgcagtagagaaacagctcagaatccatcagtgacagcaagctgtactggtagtttattatattctttgtgattactttctcatttgttgtcctttagcataaagactttcagaagttctacactgctttaactgcagagagcgtcaaagaaaagagtgtccacaatggaagagaaagaagaagaggtgaagttagggtatgtctgaggtcaagcacagtattgtggaaaggatgtgagaatccccccaggaggggaaccctcagaattcaagttccagcctcacagtctagtcatctacacctgcaagattctccttcctaaaaccagaggtttgaagttcttctcttaagggcaacagtattctcttttagttgttcccactaactcttaagaatggggcaacaaaattacctacttattaaaaagagaat

SEQ ID NO: 17295 - DNA, 653 bp, Homo sapiens
gtagctagtacaatagtgatgcaaattaaacttcataagctcataggccacctgaccattagatgccatacaagatttttgggtgtggtggtaatttcagtttcttcttagaagttaaattctcataatattggaatcttgaaaataaacatatatttttaaatttttctgtgtcaatcttcagcaagatacacagctatttaatataaagaacaactttctcattttggtagatagacacaaaagtatattcagatgctggagaggatgtggggaaataggaacgctttttcactgttggtgggagtgtaaattagttcaaccattgcggaagacattgtgctaattcctcaaggatctagaaccagaaataccatttgacccagcaatctcattactgggtatatacccaaagaattataaatcattccactataaagacacatgcacacatatgtttattgcagtgctgttcacaatagcaaagacttggaaccaacccaaatgcccatcaatggtaaactggataaagaaaatgtggcacatatacaccatggaatactatgcagccataaaaaatatgagttcatgtcctttgcagagacatggatgaagctagaaaccatcattctcagcaaactaacacaagaaca

SEQ ID NO: 17296 - DNA, 457 bp, Homo sapiens
aaattagataataaagtgcttttagtaacatgcctggcacagttcattgattcaaacattgaaaaaaaatttttttaattatcatagtagtgtgtacctttggaaaaattagaacttaacagataaggctaagtttgagccttccagtcctttccttctctgcatactcttcaggggtaactgggatcatgttctgggagcatgtcattccaagtctgtttctttgcttttataaacacatctgtttccatagaaatgctgtagtgtttgcagagggggcggggcgtggtatcatcctggatttgttattctgcgcttttttgcttgacctaccttggatggctctctagtcgttacagcttttaccttttaactattactcagtattcttactaaggtaagactatgctgatgatgtttatatttctctagtaaaaggctgggcatggtggctcac

SEQ ID NO: 17297 - DNA, 639 bp, Homo sapiens
cgacagaaggggctcttcaggccacacgcagcctcttaagcccaggggcagcctgggaacccagccactggctcagggccgccgcggctgaggcccccgctgtgactccaaggccggtgaggtgagaaaagcgcctcctgtggtagtcccaaatcactcagagtcctctccctgcaggcagcccggccctcccacctagaatagcagcccaggaaaccgatctgtccacccgccctccctcttggcagatctcagaggggcccagggtttgagttacactcaggggagggagtgggcagcagttacatcatctcaggactctccaggtcactggcagccactctgggtcccaggccagctcaggggaaagccagggacaggagaaggtagggccacagtatagggtggaggccaaccttgggcagtcaacacccaacagatggcacccccaggctatttgggggagggtcccctgtcactccttaaatttggtcacaagtcttccttccagtttctgccccaaagtgtcctgtgcccttgtcagggcccagctcccacctcgagcctgtctccccatggcccctcctctgtcctttgagggatctaacccacagacctgaccacgagccccaagtcctc

SEQ ID NO: 17298 - DNA, 649 bp, Homo sapiens
actcaaaccagggctgtctggatggttgcaaaggccgtactattttctgcagaacaccaactatgggaaagcatgttccggagatggtcccagagattgctggattcaatacaggaaatgttttattgagtgtggggaacctgaaagggaccagcttttccagtccagggcccccttaggccagtcccccaattcatccatcaaatacacatgtccagtttctgcagcattggaaaatgcctgggaaattatttcacaaagaatttcaagcaaacagaaaaggtatgtgggataatatcatgttccactgccaagcttaagaatgaatgttacggctgggtgtggtggctcatgcctgtaatcccagcactttgagaggctgaggcgggtgggtcacttgagatcaggagttggagaccatcctggccaacatggtgaaaccgcatctctgctaaaaatacaaaaattagccctggtgtggtggctcacacctgtaatcccagcactttaggaggctgaagcgggtggatcacctgagatcaagagttcgagaccagcctgaccaacatgatgaaaacttgtctctactaaatacagaaaaattagcttgggcgtggtggcgcatgcctataatcccagctacttggga

SEQ ID NO: 17299 - DNA, 545 bp, Homo sapiens
taaccaaatcacccaaaataaaaaagatttttaagtagaaaactaatactacacagcagaacttctctatatgttcaaaatcctaacgtttttcttaaggagttgggatggagtcaacaagtcccaaatcagtcattctatattaaaaagagacaaaagggagaatctaatgagcttaaactcagagccacagagataatgagagcaagagaccttggtctgtaagcagcaactccctttgtttcacattgaataccctcatctagttattagttcttcctccagtaatctgtcaaacaatgagggactagaattttaaaaggtgcattgccacagaaagcaagccagtgctgagctagtgaaaaggtgagataatgagattgacattgctgacactggaaatctggtaatataaagattagtttacaatcaaattactctcatattcacttatagccaaataagtaaagaggccacctgtaaagtattttccccacgagcaatggtatggagactgttatataaacacatgttttaggcagcaa

SEQ ID NO: 17300 - DNA, 487 bp, Homo sapiens
gctcccgctgagctccagctgtgccagaggcacccgagccctgagagtccgccgccaacgcgcaggtgctagcggccccttcgccctgcagatattcccactctggccactgcccaaaggggctcttatctgaggaatactgctgacttcgtgtacctagttttacagagccatctttctgaagcataaattagattacattattctacagcttaaatccctccatgaacttcccatcacccaagagtggatctgaaacgccttagagtgtcattactttatttccagccttgcaatgtacatacatccatctctgtcccacgccctctgcagggctttttggttccagaacgtgccatgtgcttttctcctttggagctctttgaataggatgcccttcctcccttgtctgcctgtagatagaaaaatcctgtgcattggtgagttggccctgaccaccattttcttagcatgctgaattacttct

SEQ ID NO: 17301 - DNA, 568 bp, Homo sapiens
tttctaagactatgttctctcgtcacgtcatgctacatgtgcccttaataccatggttcaacgttcttcagttctcttactgtcatcatttataattgccttttgagagatctcatccattcttaagatttgaatgtccacttctgcatggatggcatgcaacatctccagtactggcattttccatatattgcagtaccactttggaaatgcactgactctttaaaagccacataaatgttcagccattaaattcaaagttattatgtcttaataaaaatgatttcctcccatctcaaatcattattttctttcaactatcaatacaataacctgttacacaaatccgtacgttgtttatggtattttgaaaccatatttttatcttcattcttgtttgtaaaagataatctattattgaattctttcacacatcactctaaactcctttgcatttttctcttatccacttttactttcaagatttttatctaaccgctttatcccctacattgtgattcatacgcagcccctgggaagggaggagtgcctctgcccaaccacgatg

SEQ ID NO: 17302 - DNA, 594 bp, Homo sapiens
actaaattaaaacttcaactgtatttttcaatgacttgcttcttcagttagaagagttttatatttttcacagtgaagctgtaaacgcttacgggcacgtggactctgcgaaacatctcagcacccttgtgtgcatccatcaatgcgatgtcctggggcgtggagacaatcacagcacctagccaaagataaacaaaatactattatcttttaattctctatggagaaattacttccagcattatgttgcttacatacgcaaatagtctattacgttaactatttaggtcattcatatacattttacacacatgaatgagaaagacaagaaaatgtcgactttgttttggcctacctttgaatcctcgcttctaaaatcacaactgggccgggcacggtggctcacacctataatcccagcattttgggaggccgaggtgggcagatcgtttggggtcaggagttcaagaccagcctggctaacatggtgaaaccctgtaactactaaaaatacaaaaattagccgggcatggtgggctcgtgcctgtaatcccagctacttgggaggctgcggcaggagaatcacttgaacct

SEQ ID NO: 17303 - DNA, 493 bp, Homo sapiens
tgaaatatgaatagtagtttattatttcaaacttttaaaagttgggaaaagaggaatttcaaattaaaatctataaagtattggaagaatctatagaaaagagcaactaaagccgggcgcggtggctcacttctgtaatcccagcgctttgggaagccgaggcgggactatcctggccaacatggtgaaaccccgtctctactaaaaatacaaaaattagctgggcatggtggcgcgcctgtagtcccagctactcgggaggctgaggcagaatcgcttgaacccgggaggtggaggttgcagtgagccgagatcgcaccactgcattccagcctgggcgacagagtaagaccccgtctcgaaaaaaaaaaagagcaactaaaatgcttaataaatatctctctttcaaagccctctgatatgattcattacacagatttaaagataacaatgttataaaccgttcaggagagtagttttgaagacttaactt

SEQ ID NO: 17304 - DNA, 614 bp, Homo sapiens
gtacaactgtgcctggctaaatgtatattttataagataaattgataagtaagtttatatccatgattttcaagagaaagcagaaacaaatgtatcattgaagaatttagataaaatcctataatcttaaattggaatttgaaacatcattatgtgttatgatttttttcccctcttaaaaatcacatttcctaattctatttactaaaaagacctagaaagtcacaatccagtggtccagactgtgatctctaaatgctatttcatactaaaaggaacaagggctccttggagaaatgattgactccaggtctgggcaggaaatgaacccgtcaagtctgggacatcttaggagtgtcctccctgccagtgggtaacaagacttcacctccccccaaatctgtcagtaaagcccatgtagggagcctggacttccacgtccatctggtggtaaagaaatgcccctcctcccctctgctggggtggtgtcagctgaggtctagtgggagtcagaacttttgtcattacccagtggtcctgggtagtacggctacccctctatttttccatgcagagtcagtggagtccgtgtggagagtagtaacaaggcactc

SEQ ID NO: 17305 - DNA, 605 bp, Homo sapiens
ctgggaatacaactgttccagcaaaagggcccctgtcttgggaaggcccaggctgaggaggggaggatggcccgaccttaggggacatagtcagagactatgctttcaagcctccatggcctcccttgcacggcagagaagtgggtatagaaagtatggtcagggagcccagtggagacggagctggccagccaggaaggacctaggtattctgggcaggagggtgagaagggctccctcctccaggcctgcccaggccgcctcctgctccaggctccgctagctgccccgggctccgctagctgccctgttccccgcaccaccacgtcccctcacgcctgcggcagggaaacaggagatgctgtggttttgtgacgtctgccctcatgtccccagctggaggccctctgcgggtcagcctgtctgtctctcacccactcctggttgtccctgtctgtaggtgctggctgtgctggacaaagggctgtgccttggctggcagtcctctaggccattggtctgtggctgtctgtctgtggtggtcaacctgcccagggcagacagtgagctatgccagccaggccctggctcccactgctcagctc

SEQ ID NO: 17306 - DNA, 539 bp, Homo sapiens
tttacagacagctctgaaaagtgaatgagtgtttgataattttacttaccagagctcactgaagcagatacttgtgaagccactggggggtgaatcatctacaaatcaacaggttaattttggagatctgagagatatttttggctcactgcagaaaagtaaccatcactaaaaacaacatctacttacatgatttctttaaatgaagcttattcattcccccaaatcccttgcatctaacaaataactagtgtctttctgaatggtagattatattcaggcataataataataaagtgcttgctcttccatgtgctttatgcacagttaagccatcatattcttgcaacaactgtatcaagtacgcactaatgtcagcgatagcaatggatgcagcatttcacatcaaggaaaccaaggcaaagagagattaagcagcttgtctgaatccaccatttacaaagtggcagagctggattgggcagactctgccccatagtctgcctgagttcagtgcttcagcttgccacactgagcgc

SEQ ID NO: 17307 - DNA, 612 bp, Homo sapiens
tctacaatgagcatatttattgatggttctgttcttaagcaactggtgacatttattactagagcattcttagcacttcagaatggtgctttcttttatttggtaaaattaccaattttacttgtattttaccgttttaaatgttcctaatgctgttggtgattaatttctcagtatttagaaatgttaatatacatagcaattgtcagagtatatatacttcattatatataggcagcttgtgatgtacagagatccagtttacagatttgtcccacctactctcacttcttaccagagcacccaatagcatgagacctgttgtaaaaaagtgtgacacttccaacaaacccgtgggtcacaaaaggggagttgggcagtgtctgtaagaatacatatctgggccgggcactgtggctcacgcctgtaatcccagcaccttgggaggcacgaggcgggtggatcacgaggtcaggagatcaagaccatcctggccaacatggtgaaaccccggctctactaataatacaaaaatcagctggacatggtggcgtatgcctgtaatcctagctactcaggaggctgaggcaggagaatcacctgaaccgggga

SEQ ID NO: 17308 - DNA, 644 bp, Homo sapiens
ttcatcactctccccaaaattttcaaccttcacaaagatccaaaccactctgcagctggtcaataaagccagatgtaatccttctgtggaagtcttggaactatacctcaatgcccctttgaggtttttgggttgttttttaattatttttttcttttgtagagacagggtctcactatgttgcccaggcttgtctcgaattcctgggctcaagcaatctgaccgcctcagcctccccaagtgctgggattacaggtgtgagccattgcacctggctggttttatttttgtttgagacagggtctcactctgttgcccaggctggagtgcaacggcgtgatcatagctcactgcaatatcaaactcctgggctcaagcgatcctcctgcctcagcttcctatgttaccaggtggaccacagatgtgcaccaccacgcctggctaattttttgattattttgtttcccaggctggtctcaaactcctgggctcaagcaatcctcctgtcttggcctctcaaagtgctgggattataggcatgagccactgcacccagctcaaggttttttcttgtttgtttgattggcttttacatagatggggtctcaccatgttgcccaggctggtcttgaactcctgggctc

SEQ ID NO: 17309 - DNA, 518 bp, Homo sapiens
gacagaagggatttggcaataataatacaaaggaggtacatggaaacaaagctatatcgtgcaaaggaagttactaggagatagtaatagtgaatccacaggaaaactgagcatctttaaaagccataaaattataggaagtaataagtataacaatatattgttgggttttaacatctgtagatgtaatatatataacaacaagactacaaaaaggacaaaaaggaaaagagttgtataggagcaatctttttgtatctcactggtattaagttggcacaaatctgaagttgatcttgataagtcaaaataagtatatggtaaaccccagagcaaacactaaggaaaaactaaaacagtgtcatgggaaaacataaagaaatcaaaatgctacattaggaaatatgcacttaatataagagaaagtagtgaagcaagaatataaggacagtggtgacaaaaaaaaacccataaacccacagaaccatataaaacatatgggaaataaaaagtaaact

SEQ ID NO: 17310 - DNA, 575 bp, Homo sapiens
ctctccggactcacacgccctatctttgatcgctcaggtaatggcctggcctgctctctgtggagacagggaatagagttagcacccacgctctgggagccctgacagcccgtttaacaaggtgtccaacatcccatttcctctgcacttcctctcgctttaatccttttatgtgaaacccactcaggagcaagccctgtgaaattgatgcctctctgtacacatggcctggctcgctccctgtttctcacggagcacagacccctcccattccagacactaggaatagccgggcctggcgtggggggagcctggtgccccagagggtcacccccaagctctggagggtggggtgctgatgaggcacctcagaaatggcttagagttgctggccccgggttggggcttcttggagctgcagctcaggactgacacccaggccaccaatggactcccctcctccctagttcactgcccctcctggactagaaagaaagaagggaagctcctggtggctccaaggaaacctgtgaccccatgcctgccccccagacctatcccctccaaaaaaaaaa

SEQ ID NO: 17311 - DNA, 656 bp, Homo sapiens
tggccatgctggtcttcaactcctgatctcaggtgatccacctgcctcagcctcccaaagtgctgagattacaggcattagccactgcatctggtaaagggccccagctctaaccgactgcttcctaagtttttacagcagctgacaggtgatccagaaagttagcaagtgccctgggattcttatgctcatttgataggagaaatgatctgataggaaaaaggacatttgggaagtatcatagggctaacgggaaggaggacaagccagtgagaaccacagctggcttctgtgatctttaaaatgggaacaaccaggactaccttgattgcctaaaagcaaaagccttgaacaaatggcttcttggggttcctttcagctttggaccagagcagagaaatgaggaagattttagcaactggaattttagccccaggaaactcccttagggaaagagatggcagttaaggcagaggaagcaggtatccccatctttcccctaggtgctgagacacatctgaggagttggtgtcttggggccctctagagccccccggggcttcccacccactcagtagccttggcagaagaaaatgtgtcagctgggcttggcagctctcccagcaccagcccaagatgctctgaacagaaataaa

SEQ ID NO: 17312 - DNA, 590 bp, Homo sapiens
taaactgctatgctaggggtcatggtcaaggacacaaagttcatagaaatatttctcacttctacagctggaaaatcaccttacacaaaatcactgagccacagtacttatgttcaaatttgcagcctcttgttctagatgtcccatatgacttcaagctttttttcctatatttaattagaaacctaccttgtccttagtgaatcctctgttcacagactgtttccccaaggcatctgtctgaaatatataagacaagatattaatctacactttactcataagaaaaaaaggtaactaagctaggtgaagtacccaatctcattaaataattttgcatgtgagaactcacttctctccactttttataataattgttctaaaattttaacactattttaaaaattattgttggctgggcgcagtggctcacacctgtaatcccagcactttgggaagccgaggcgagagaatcataaggtcaggagttcgagaccagcctggccaacatggtgaaaccccgtctctactaaaaatacaaaaaattagctgggcatagtggcgggtgcctgtgatcccagatacttggg

SEQ ID NO: 17313 - DNA, 597 bp, Homo sapiens
ggagagccctgtggcactcctgaaaaatctcccctcccagttcacattgacttattaaccaacactcaggatcatgtgaaactctagaactggatctgggtgcctggcaggatgacatggtgtgaggctcaagcagcactgtgggaattcaagcatctgtttatttctgagagaaaaagtgtaaagcaaaataatatcttttaacaaacgtttgtatttgactaaagaggaagcaagcacttaaggtatgaatttgctaattgctcttctgagctgagaatatctgtgttggatattagtcattatccatatttggcacagaataatcccgagggttaaatgacattgttcctacagtgggcacctgaagactggctataaaagcaatcctggccaggggcggtggctcacgcctgtaatcccagcactttgggaggccaacgtgggtggatcatgaggtcaggggtttgagaccagcctggccaacatagtgaaacctcatctctactaaaaatacaaaaaaattagctaggcacggtggcagacacctgtaatcccagctacttgggcggctgaggcaggagaatcacttgaacc

SEQ ID NO: 17314 - DNA, 382 bp, Homo sapiens
ttagtgaacacaatggtaattcacttactctgtatcatagaagaataaggtgtttgatataagtaaatttcaaagttagcctaaaagttatccaaacacctttgctaaaaaaacaaaaacaaaaacaaacaaacaaaaaaagaaacctatgacaattctggtataaatatttctaaatctatgttatagttatattttcctttcttattaaagactgttcttctttccataaataaatctttgttgtacagcatgctttaacagatttaaaaggatgaaaggtgaatcaaaacagtattccaacctcaagtggcttacaattgaaggaggtaggatggataattagacatgtacacagatgattctagtggtaagaatcaca

SEQ ID NO: 17315 - DNA, 594 bp, Homo sapiens
gcatgtgagaaatagatttctaattattgcacagagcaattaaatatccaaacctgtgatgaatcaggcctacgagtggtcttagtatgtgaaatagtagtgtttcctgatggccagaagtacaacatctctattaggaatttagtatcttgtttgttacatgtagaacaaaatcttttatatgtaatataattcattatgtatcagtgaagtcactttagatgcaggagctattcagttttcaggccttgggccatgttcagttgttcaccagaagctctcaaaagaaattcacaatgcctactttcacccaaatgtgtattagatcacccaaatgactaacgagatgttatatttccaccaagaaaaataagtaaaacctggccctgcacggtggctcacacctgtaatgccagcactttgggaggccaaggcaggcagatcacttgaggtcaggagttcgagaccagcctggccatcatggtgaaaccccatctctactgaaaatacaaaaattagcccgggcgtgatgatgcacgtctgtaatcccagctacttgggagaccgaggcaagagaataacttaacccgggag

SEQ ID NO: 17316 - DNA, 596 bp, Homo sapiens
ggactctgcctgctgtttgttcttggtgatgtaactaggtctcttccccgagagaggggtggagatctttccctgttgtggactttggggttgagaacccttagatcccaagcattttaaaattgactcagtagattccaatggctcagtttaaataataattttctttaatagtgtggctcgtttaagacagttggaggagttttgcctattaaaatgatttgatttaatttaagcccagtcttggaattctgaattagggattccaacaataacattgttttgattattctgtaaacaactacaaaaatgttgtcttctcgtgctccttttgactgcagtgcaaaggaatttttttgtgggggactggcccttctttggaagcagcagccaccctgcaaaccttattgtttaatgacctttgtcatcaggaatgccccaggaaacagcttcataattgtttttcttaagcctcaggtgaagtttgtgataacgtcctttcaagttacttttggttagtttcttaagtttactttgtttttaattggaagctccacctttttaactttgtcatgaattgtcagtgctgagttcct

SEQ ID NO: 17317 - DNA, 205 bp, Homo sapiens
aaaaatcatttctcagctggcattgtcttccccagagaatgtgttgttctcaaagctagtgcatcatgttaagtaccatctttttctcaatactgtgctggtcatgaagatggaagaagaggtgagttaaatattctagaagaacacatctgcaaaactatcagcagatttatctgccagaaagggctttcccatgcacctttcc

SEQ ID NO: 17318 - DNA, 536 bp, Homo sapiens
ggagtagtggctcctacctgtaatcccagcaccttgggagtccaagtgggtggatcacctgaggccaggagtttgagaccagcctggccaacatggagaaactctgtctctactaaaattacaaaaattagcttggcatggtggtggatgcctgtaatcccagctacttgggaggctgaggcaagagaatcatttgaatcttggaggcggaggttgcagtgagccaagatcatgccactgcactccagcctgagtgacagagcaagactccatctcaaaaataaaaataaaatagccttcaagactccatatgtataccagcagaaacggactttatagatttacagaaacctgtcagatctgaaatatgcaccctggaaaatggacaagaaaatactcccagaggatagagcaaatatccataaagaacaagggacaacgatgtttcttccaaagagcagaaacaggatttaattaggaaatgcacctgctttcttcagggtggatgaccttcataaagcctgttcagtgggaca

SEQ ID NO: 17319 - DNA, 559 bp, Homo sapiens
gttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagcaagaaggggttaaaagtggaatgtatgttgtaatagaagttaaagttgcaactcaagaaggaaaagaaataacctgtcgaagttatctgatgacaaattacgaaagtgctcccccatccccacagtataaaaagattatttgcatgggtgcaaaagaaaatggtttgccgctggagtatcaagagaagttaaaagcaatagaaccaaaaaaaaaaaaaaaaaa

SEQ ID NO: 17320 - DNA, 646 bp, Homo sapiens
gagagccctaatattgaagaggaagtatcaggtgttttggatgagttgccctgaagtgatatgatgatgttgccagggctgggaacactgtctgctcctggttggagttagctggactggtgattatgactgaacccaggttgtgcggtggctccagcaggagcagctacggaggaggttactcccaagctgctcccctagataactgcagcctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcggctggctcaaacagaggcctgccaggatgtggccagaatagagggcattgctgaagacctaaggtgtttctttccagcaagtcaaagacagagccgttgatttcaccaggctgtgaccgtatacctcctgcattgatttctgagggtaaatattcacaggctc

SEQ ID NO: 17321 - DNA, 608 bp, Homo sapiens
actttatgtaattctagcattggatttgtaattcccatcatcttttgacaccacataagtcctgggaatacaagtttgatcatgaagcaaaaactgttatagtgacagacaaacttattgcatgttatcctatacttggctaatacaatattcattctcttataaacgtcccagagctgagaaagaaaattttctgtaaggtaggctaatgatgttttccatacattagagagtgcatttgtccctatctgcatccgcttttacgtgagaaaatttgaaaacccagtgagcacattcaactatctctaacagaaaaattatataactttgacatcttacatacaaattcaaatgtttaatgccaaggcaaatgtatttgaatttcatatgtgaaagagatgaatacattgtgttcacaagttcttttatgtttttaaagaataaagaggctcataaatctatccacataccttaactcttacaaaagggattattggtaaagataaaggcctctattttgtctcagaagtgacacattcatttgattgtaaactattaccaaatgtttcagggtactttctaaacacagggcactaaatgagataaag

SEQ ID NO: 17322 - DNA, 438 bp, Homo sapiens
gccaccatgcccagcctagcttttcaagtttacaaaagtcttgctaggattttgaccggaattgcattgcatctgtaaggtgaaattgagagctgatattttaaaaatattaagtcaggcaattcacgagcctgggctttatcaccatttatttgggtcttgtttaatgtctcacaaaaacactgtataattttccccatgaagatcctccatatgttctgttgggtttactccaagttactttatgcctttgatgttgtgaatggtgtctttccattttcattttcattttgaccatcagaactggcttctgacgaccctaaagtagaatcctcacccctagttaggacccacgggtcccagagccctcacatcctcctctctggcttcccagaagaccagctcgacaggggcctccttgggcacccagcagccatt

SEQ ID NO: 17323 - DNA, 578 bp, Homo sapiens
acttttctaaaattatgattttattttccggtttaaagaaaattataatgcaaacaatttggaattgggagagacaaaaagtaaaataatatcttccaaatgatttccagaaataaacaatagttacaaactaaaacttctgaagcatgcttctgacttaaaaatctctggttctctgtcttcaattctgcattgacagcatcaacagcaccaattgtgggttgaagaccatggtcaccaggctatgggcttgtgggacatggatgctgtaaagacactagagtgcggcatttcttttgagaaattgaaacagaccatctcttatttcttcatcttcagagcatattttatgtttcacttaaataccactttctggcttatcctagtggaagattttccctactgctcacaatagatgagatgggattactgcctgtaatcccagcactttgggaggccaaggtgggtggatcacctgaggtcaggagttggccaggtcagcctggccaacatggtgaaacctcgtctctactaaaaatacaggccaggcacagtggctcatgcctgtaatcctagca

SEQ ID NO: 17324 - DNA, 620 bp, Homo sapiens
ttggccatgcatactttaattcttataaatgaaaaccacatatacaatgtaacccagtgagttaggcatggatatgataaccatgagatcaactaaccctgggaagtggcaggacccgacctatgcaaatgccatgtcttcctgaaaccctgttccagaattgctttcatgtgactctctttctactctttcacactatctctttgtttacatacttcccccaacttacatattcccaaccacaccattttaatctcagtgcatgactgatttacagctttgccactctatgtgagcactgaccccaaaagggacttccaatctgtttagttactagattataatacagaagagaaaaataaacgtaacattgaattcctatacccatattagctttttacaaatcagatcaaccatggcagtgaagactcaccattcatcttttcgttcattaatattataaggaaatctattcctgtgggcagacattaaacatgagagaaattaacacagttgcactaatgcaaacacaatgtcaataatttataatctgggaaaagcaactggtaaaccacattttaattatacaggctcatcgtgacacatcacttatgtgacat

SEQ ID NO: 17325 - DNA, 568 bp, Homo sapiens
gtgtgtgtgtatgtgtgtctgtgtgtagagagaatgcttggtcaagttgcacatggcagctgtctaatgcaaatgaaagccatttaaaaactagtgttagatttcagatagattttgataaactggatacgttgtgagaattactgaatgtatttaaatagtagccagatacctaatgcaggaaattgtacatagaaaatatttgttatatacaagatttagagactatagtagataaaaaactgattaagtaagacactgtttttaaaatgaaaactcactgggttagttattataacatgtgacaaccatgaggtaatctttccatcctgttcagcacaagtcttaacctacctaaggtcactgtttaattttgggctttacaaattgaatagacatttggaaatttaagataatgtttatttatttaagggttaaaaatttaaagcaactgaaatagtctgagagaagaaagatacaggcacttaataatggttattttcaagtgtacctaaaggctagccagagactaaatgaccaagagtattttctttttgtttaggacagc

SEQ ID NO: 17326 - DNA, 657 bp, Homo sapiens
actttgtgaactaaaaactactgaattgtatgttttcaaattgttaaagtcatgaattttatgtcatgtgaatttcagctcaatttttaaaaaaatgttatatgtgctcattgtgaaattttttaaaaatacagttatataaattaaaagtgaacattcctgtcttcttccattactcagaaataaacattatgttttgctctgtgtccttccagatgtttctgtcatataaacacactatgattagatttgaggttttgtaaaatggcatgacaatcataatccgtctgtaatcttctctattcatttaatgtgagcacctttcctcatcagcgcagatgacaaatgctttacattctgtttttaacaactacttaagtttctgtagaatagagaaactaccatttttataaccactgtcctctagatagatgtttagaatgcatacaactttttgctattattaacaatgctgcaactatggccgggcgcggtggctcatgcccgtaatcccagcactttgggagtctgaggcgggcagatcacgaggtcaggagatcgagaccatcctggctaacacggtgaaaccctgtctctactaaaaatacaaaaaattagcccgggcgtggtggcagatacctgtagtcccagctactc

SEQ ID NO: 17327 - DNA, 555 bp, Homo sapiens
ttcttgtcaaaatggagaagatataaaagaaaagagagacttacttgatcatataagaatttaaaacattttgttaaaagaaagattccacaacaaggtcagtagactaatgataggtttggaaatatttgtggcatcagcaacagctgggttttttgtgtttttttgttttgttttgcaaattgacaaaagcaaagacaatgaataacggaaaaaaaggataaagaattcaaataggatatttacatagggcaatgaccaacaagcaaatgaaaatattctcacattaaatcatagtcggggaaatgtaaattaaagttacaatgatatatatatttttatgtccatcagactggcaaaaattgaaatgatcaataacctctattagtggtaggtatatggaaaaatggatgttcatacatgctgagaaaaatttaactgtaaaaactgttttggaaagccatttcgcagcagacataaaaaaactgaagatacatgcaccatttaaccctgcaatctctctccttggcaactctcccagaccaatattacata

SEQ ID NO: 17328 - DNA, 578 bp, Homo sapiens
catctgaactagagattgcctcctggttctcaatgattatcatgtcctttagtcttgctttcttcatcaaaataaacggcctaagcatacaatgatctggaaagtagcaatcagaaatctgtgctcaatagtccctgagaccccactctccatcccgggcttctgaatgtggctccttgtatgactcaaccaccagagaggttatgacattcttcatgcttagttgttcatggtttctgaaaccacggttattcatcattgctgagaaactgaaccagaacaaccacctaagggagatccttttttcaccatcacattgtcaggtgtgatgtcaggacccaatcagccggggtccagttctcctataagtctttggtaacagtatcccagacctacgccagcttgccccactaccattctacctgttttgtttccattctcaggattcagaaatataacatacacatctcctaagaacgactttatatccatacagtagaatattattcagtcttaaaaggaaatgaaatcctggccgggcacggtggcttatgcctataatcccaatactttgggag

SEQ ID NO: 17329 - DNA, 627 bp, Homo sapiens
acagaacttaaagtataatttttttaaaatgtgaatacgatggaagttccctcaccgtatcccaagtagactgattgaatggctacaatgattaatgactgatggaaaatataccttatgtgggatgaagggaaggaagcttgatatttaggcagaagaaaaggcatagggatatgtaatataattcaaaaaaataaagaattaagccataagaaagatgaagaagaatatcttgcttatgttatactttccatagttctccttatgtgtattatcttctcttatacttagagtattcctgagcatgagtccctctttatagaaggcacagagctcttcaaataagaaaaaacaaaacaaaccgtcaattgccatacataacaaaacaatcaaacgttattttcttttcgattgacctaaaagaggtattaaaatatgagtatttttcagattgctaatgtctcatactaccgatgctaagtttgttgaaaagattattatattctttattgttaaatgtaccaaaacaatacaataatgtcagattagatagaaactattctagctatagctacatgatagcctcaaaccattttaaaatgggaaaaaagaacttatgaatttatg

SEQ ID NO: 17330 - DNA, 459 bp, Homo sapiens
gccggcccttcccaggctccccaagcctccctcctgtcctctgccaggcctgcagattcctcagcaggccctgaaagtcagaggaggggctctgatggggaactcagaagccctgccccagccagtgaaggagcccgaggccctgttctcacccaacacccagccctcctggccctaacccagggtccaaggctgtgaatgtaagcatgtgctccctggtgagggcaggcaggcattttggatggtgtgctgggaaaatcatgggccctggacctgggttcaaatcctaactccatcctttttgatctcaagtacctttttacctttttctgtgcctcagtttccttagctttaaaatggcataacagggccgggcacaggagctcacgcctgtaatcccagcactttgggaggcagaggcaggttgatcacctgaggtcaggagtttgagaccagcct

SEQ ID NO: 17331 - DNA, 186 bp, Homo sapiens
tgaatgttgttcatcaaaacaagcagttagagagctgcaatggtgaatagcctccttgtctggagattctaacaaatgggtttggcagtgttggaaactgtaaatcctcagggaacagatgatctggacaatgtagctgattcaaagggacggaagcctcttagcactcatagcactgagtataat

SEQ ID NO: 17332 - DNA, 641 bp, Homo sapiens
gaaatttgataggttaatcattatttcagcaaacaaatctgtgttgtttaaaatacttttccttccatatttcatttctaagcattttccccttgatatgatttatcttttctaaagtgactagatcattcaaagcaaaggaacaatcaaagctaactttgcctcaggctatttgcagtcgatgtcacttgagtttaaaccacaaagacatttcaaaaagaaaacatttctatctcttaatatgtaagccaggagatatgaaatcatggcatccccagagaaacacctttccctgatgtcaacttggcaacttgcatctgcttttctgatgaacaaagaaaagtatttggctatgacagttcaaaaactgtgtatccttaaactttttaccttcaatgctgcattaatgaagcatctctgctcttctaaaggccattaaaggcttttagctctctctcaattgtattagcaagggaaaagtaagatgcattgtgaccctgtatctaagacacatgcctagattccctgttatgtaaagtaaaaaccatcctgaaaatgctttctgttctcaacattttatatctaccttctctgaacagataagcaccacatataatcagcaagatcagcaagttcacagc

SEQ ID NO: 17333 - DNA, 647 bp, Homo sapiens
aggtaacgttacaaggttattgcaggaggcatttattaactaaacaaatttgtgttttcaacacatgtgggtgctctgctctcatgaacggagatgtaagaaagttaagttaggtccacatgataaacatatcaaatgaattaaaatatttctgtgtagagttttcccctaggtataggaacaatttactgtgggctataataaccccaggatgtgtagacagaagacacatggtgtctgtgtatactaaactctaatgaggttacaaaccacttctactctattccagatctattgaggctcctacttatcttggttggtatttgacccagtggacctcagatgcatggagagtcaacatttgtcatgtttttggtatggaaattagataaaattattacaacataaagtgtagcttcataaaaactaagaaaggacaaatacgtttcttcacatttcagacgctcacatctaggtgtgacattactttaatcaattagataataccagttacaattctctgtacctagaagatagtaatggctgacttcattcctctgtttgaatttcaggctttcacttaatcagacctgagtacttagatggtcacagctgggtattagatcctaatatcaaaatctgctatg

SEQ ID NO: 17334 - DNA, 642 bp, Homo sapiens
cctccatttcctctcttcttggataaaatgaggataccgtgtctggcacttaatagatgctagcttctgagatactgaagcaacaatataggaaaatatcgtgattataggcaacaaagccatgatgtgcctaaggccacagatccggggccaggcttctggaatttaagccctgactcctctgcttaatagctgaggcaaactactaactgtgactcagtatccccatttgcaaaatgggagtaataatagtgccaccttcaaagtgcagctatgaggatgggcaagttattattttctagtgtttaggtcagtggttcacacatagtaagtgctatgtgagggtttgttacatcaatgataagtactggctggacgcggtggctcacgcctgtaatcccagcactttgggaggctgcggtgggtggatcacctggaggtcaggagttggagatcagtctgaccaacatggagaaaccccgtctctactaaaaacacaaaaattagctgggcgtggtggcacatgcctgtaatcccggctactcgggaggctgaggcaggataattgcttgaacccgggaggcggaggttgcagtgagctgagatcgcgccactgcactccagcctgggcgacagagcgag

SEQ ID NO: 17335 - DNA, 673 bp, Homo sapiens
ccccaagttgagctgaagattgatgagccccgtgcttccctggagtgcaaactagcccagcacaccaccttcacagtagcagtgctagtggccagtaagtcccataatgcttctgagtgcagaccagccagggccttgctcctatgggatcaccaaccaagctgaggcaccagctcaccagaccctcacttccccagagtgtgaaccagcctctgaaccagtgtctgagccgagcctcaggccaaccatctctaggcttcttccccagagagcaatctagccatgcactccataaccatagaacacagccagagcaagtttgctagccaatcagctctgtgcttccctggagcagggttcagcctggtgtcttgctcccaaggggagcagagctcaagtaggtggaccagtgacacaaatctctgcagtataagccactgaggcacttgcaggaattgctggcttggtaataactgaagaaactgcagagactacaccattgcacacacccagaacaaaaccaacacacacaaaccagctgacatcataagacacatctgcaggcgaaaacctttccctatgaaaaccactctacaaaattggaagaggtgaatggttcaccagatgaataggtgaacaggatgaacaggttcaccagatgaatagggataca

SEQ ID NO: 17336 - DNA, 616 bp, Homo sapiens
gtaaagtaggatcctatggttgttttgaggcttgttagagtcagtataaatagtgctacctgcagaactgaaggacaaaatataccatggaattgaagagagggaccgcatctttgataattcttccaggggttctggagcagctttggcacctgaaggctttggaaccaagggcagaggaccccctgtgctcagtgcaaaaatgagacaaacaaaatcagtctacagaggaatagttccataaatgagaactgacatatagatggagaaattgtgctaagcagtttcttgtgcacaaatttgcggagaaaagggaaacttggaaaaacttcgtaataactaaccattagactgggtcatgagacgtcctctgaaactcccaacagttctccaatacctttccatacacttaaattaattgccaacatctagcagtgacccatacatttctgcctaatatgtcatctgccttccttaccaacctcatctgttacctgctcaactgcactttttctaatacatctttgcctgatgcattgaaagttgtctactcttgctgcacccatgtctttctttgttaatataattcattgtcattattcaattttcatttcac

SEQ ID NO: 17337 - DNA, 594 bp, Homo sapiens
atcactgtgagacattatatagaaggtaatggtaagaatgtcatgggacacatatataggtcacaatttccatgcatcagtcactgtgttaaccacttcctagggattatgcagttcttctcatttgaatatgtattagcttacaagtgtacaatacaagatcccattagaatcccattcaacagatgagggtattaagacagaaattttgtgatttgctcaaggcctaacagctggggtcagtgtttagaaatccatccctgtttggcctgactgtacagcaggacttctcaaccctggcactgttgacatttggggctgggtcattctttgtcctatacattgtaggatgtttcatgcaaaacatccttacttttacccactagatgctagtgggacagccaaaactatctctgtacaccgccaaatatgctctgttgggcaaaatcacctgggttgagacctgctttgtctttcattcattcattgaatactcattgactgcatggcctgtatcaggcactgtgcgtgtaccagacattgatggacaaaacagacatgatccttgacctcgtagtctttctagtgagagct

SEQ ID NO: 17338 - DNA, 570 bp, Homo sapiens
agacctctgtatatctaccataaaaaaagctaaaaatcacatctcaaaaagtttaaattggtctgcaaataatttgcctactttaaagaaacaaagatcctttaaagtaatgtttgattgaattttatgctctgatggaaatattatttttcactgtctaaacatgaacatgtagttattaagcacttaaaatgtcactagagtcactgaaaaatacaatttttaatttaatttaattttaaaaatataaattcaaattttaatgttcagtaatcaaatgtggcttatggttaccaaaataaactttgtagctttaaagaaagagaataaatttcagaagctcaaaagatgcagcatctaataattaatcacatgtaaaatgccacaaaataggaatcatagtaagaagagaaactcatcaatagaaaaccatagaaatgacagagatcataaaataaaggtaactgtaaaataatgaggaaagaattggaagatatttttaaaatagtattttttcttgacttacttggtttgttctgtatgccagtcaatgagtcaataatcattggt

SEQ ID NO: 17339 - DNA, 550 bp, Homo sapiens
gcttaggtatgtagtgggctataccatccaggtttgtgtaagtacactctagatgtttgcacaaagatgaaatcaccacaccattggttctgttggatcataagggaaaaaaaaaagatgaaattgcctaacaacacatttctcaaaatgtaaacctgttgttaagtgatgaatgactgtacttggccatttttatgtcttcttttgagaaaaatctattcgggtcttctgcacatttttagaaaatcaggttgttttcttactattgagttgtttgagtccttctgtgtttcggatattaaccccttatcagatgtatagtttgcaaatattttctcccattctgtaggtcccttcttcaccctgtggaatgtttcctttgctgtggggaagctttatagtttgacgtaatactgtttgtccatttttgcttttgttgcctgtgcttttaaggttgtatcaaaagactcatcggccagactaatgtcaaggagtttcctgtttccttgtagtagtttcatagtttttggtcttatatttaatccatttt

SEQ ID NO: 17340 - DNA, 565 bp, Homo sapiens
attattactctttccatccagctatggcatatttctttgttttctctagttgtcctttgtatcgctcaataaaatttgcggctctggtatatttcataataatcatacattatatttcattatttctattattataatggatcgcatatacatttactatgtaccacatattatgcaatatattcattatctcaattcataaaacaatcatgtgatttagttggtgttattactagattaccattgtacaagtaaagaaaataaagacaaaagaaaaaagaaaagagactcagcaaatccaaaccaataaagacttaattagaattgttgggcatataacaaaaatttaatacaactcaatgaaagcaaaaaacattttaaaaaatgaccaggcagatttgagaaggagccaaatagaaattccagaaataaaaacataattgttgaaattgaagacagattcgacagcagattacatataattgaaaaggaaaatgtaaactggaagacaggctgaagaaattgctcagaatgaagcccaaaaaaaaaaaaaaaaaaaaaaaaa

SEQ ID NO: 17341 - DNA, 580 bp, Homo sapiens
gcataaacctgtgcccaagcaagttgagacttcaaagagcagcaagactcaagaccacgtttacagagattatagttagttggaaggcgtaacatccaagacttgccattgttgacttactttggacacttgcactgttttacctgttaaatggagtctcttgctaagccctctgtccttatgccatcacttgcccaggtgcttacaacttggcactgaatctgtaatagttttctagctgagttatttgtccagtctctcccagtatgggagagactgaaacgtatgagacccagttctttttatctttgggcacagagataaaccacatttcctaggcaccttgcatctaggtggaaccatgcgacaaattctttccaaaggaatgtgagtgtattgataggtcacttctggtccaaggcaggtaagagcaaggacgacttctctatgaacacactctccttcactttccatgcctaccttggtagctacatattaaagacagtggcttaggccaggcatcatggcttacacccataatcccagcattttgggaggccaagaagggcgaatcacttga

SEQ ID NO: 17342 - DNA, 529 bp, Homo sapiens
tcactgcaacctccaactcccgggttcaagtgattctcctgccttagcctcccgagtagttgagattataggtgcatgccaccatgcccaactatttttttgtatttttagtagagacagggtttcactatgttgcccgggctggtctcgagctcctggccttaagcaatcctctcacctcagcctcccagagtgctgggattacaggtgtgagccaccatgcctggccagaatatcctaataattttacattgattgcatcttgaaataggatttttgctatgtaggttaattattaaaattaatttcacctgttgctttttacctttttaatgtggatactagaaaaatttaaattatacagatggcttgtattgtatttcccctggagaactctgttctagagttgataaaggagaaaacctgaagaattgtagacataagggccgaagtcaaagccgacagaggagaaggccccaggagagggtacagggtaagaaggcagaccaggccgggtgcagtggctcat

SEQ ID NO: 17343 - DNA, 614 bp, Homo sapiens
atctcatctgaaatatggggcagtttcttggttctcagttgtttcttttctgatatgttgctgacctctgatttctcatatcagtgctcttcccttagttcagagatgtttccccagttgtagatgggggttggaaaaggaaggtgcttgtgatttaaaagccctgtcacttactgtgtccataatatagtgagtccacctgtggactgagcaaggctgctgtcacatctttcaaggttttcctcattgatcctacatcggtttagcaaaattcttctgtaaaaggctagatagtaaatattttaggctttgtggaccatacagtctctgtcacagctactcaactctgccattgtagcatgaaatcacgtggctgtcttctaataaaacttggtttacaaaaacaatcagactgggcgtcgtggctcacacctgtaatctcagcactgtgggaggacgacacaggaggattgcttgagcccaggagttcgagagcagcatgggcaacgtagggagactccatctccgcagatttttaaaaagttagcttgggcgtgatggtgcatgcctgtggtcccagctacctgcaggggctgaggcaggaggatcgtctg

SEQ ID NO: 17344 - DNA, 250 bp, Homo sapiens
tgctttctgcatcaccttactctccccttggcctcagtatccatatgaactcttctcattaattcttttgaccttcctgtcttttgatttcgaccttcctgcctttcttctcacttccagcagaacacctcatctcctattttgcaaagaaaatagaaactgatggaactgggtttctctcacctcaatttcttgcgatccaaagcaacctgtatttccactctttctatcttccgccctcagtcaggaa

SEQ ID NO: 17345 - DNA, 132 bp, Homo sapiens
gttcttgggtaaattttatatgttatatctatttttgtgcaactgtttgtaactttcctaagatacagacagtggtttattttgaatcagaactacttataaacacacaatgcaactaattatttgtgcttc

SEQ ID NO: 17346 - DNA, 103 bp, Homo sapiens
gattatgggccctgatctactgaacttggcatctgaatattgttaatgtttcccttttacttggtataattattttcctctacctgtagcataacttttatgt

SEQ ID NO: 17347 - DNA, 258 bp, Homo sapiens
tctaacgggtaggacaggtcttaaataaataattatgaaggtgattaaatgctatgaaggggaagtacaagatgctgtgaaagggtgttaacagaggagcctcatcttgtttggaggtgaaaaggctgtcaagacaggcttccagaagtagtgataagtgccaataaataaattccgcacagcatcccaccttcctaatttatacttaaaaccccatatcccacctgctgggcaaagaaacttgcctcattcgcctcc

SEQ ID NO: 17348 - DNA, 627 bp, Homo sapiens
tccaccaaaataaaataagaatgtaaataaagaaaaaagataaatggcatatttgtcaaactgagatcttacactcatggagatcttacaaactgggtgaaaaggtaagtttgataaaggaataatagggtagcctgaggctagcaactgtgtgaagctattacaatcattagtcctaaaaaacaggaacaggagcaattaccaaatacgtgagttttccagtaaagtctaccgggcaagagatgtggcctttagcattggacacagtcaacctgtagtcacttctcagggcacaagctagaagaataagtgcctcaaacttactcttttcgaagctgccagcttccagcagcatccatcattgacataacccaacaagaaaccatagaagtcagtaccctgggcaaaaggaagggtgagaaaagtttgaaaatagacccaaggggacaaacagaaaatatctcatatataccaagaaacagtgaatcacgcaataaagacttcccaggaaatggtgaagaacagtcccaggcaggttcactttaaaatgtgtgtggtctgagacgaaagtacatttaacctccacagctgcaccccaactcacaagtccaatattcctccaatatt

SEQ ID NO: 17349 - DNA, 679 bp, Homo sapiens
tctttacactgctgattcactgctttgagaacaagcccacataagaccaagtatgccctgaacctacgggggcctgtcttcccatctgcacatggctctgggtgtgaccttgcatgggggaggcctggggatttggctgtcgtgggacgtgcaggtggacaactctctatgtaaaccccgtgagtccactaccatggcttacagtgatgttttatgttaaaggattttatggggagataacaacaataacattttggaaacaggaaagcaaacaaatgaggaatatttgactgaaagccaagtctcgagcttgaattgcggaaggccaaacccattgttgacacacacagacttctcaaaccacagacttggggctgggtgccgtggctcaaacctgtaatcccagcactttgggaggctgagacgggtggatcacctgaggtcaggagttcgagaccagcctggccaacatggtgaaaccccacctgtactaaaaatacaaaaaaaatagccaggtgtggtagtgggtgcctataatcccagctacttgggaggctgaggcagaagaattgcttgagccgggaagacagaggttgaagtgagccgagatcattgcaaccagccaaggtaacaagagcaaaactctgtcccccaccccaaaaaaaaaaaaaaaaaaaaa

SEQ ID NO: 17350 - DNA, 78 bp, Homo sapiens
ggggttgaacctcagaaagaggtgagaaatccccatgacgggcatttgaaactcagaaagacgtgagaaatccccacg

SEQ ID NO: 17351 - DNA, 315 bp, Homo sapiens
agctaaacatactcttactgtatgatccagcaagtgcacacctagaaatatatccaaaagaattgtgtgcttacacacacaacagtatataaatatgattacacagaacagaaaattttataatagtcaatactagcaagtgacttaattgtctaacaaactagaatgagcgcttaaattgtgaaatatttacagaatggataatgaggagtcaataaactctatgcaacacgaataaatgccatatcaagtatttagtgtaaaaagcaaaacagtctaacgtgttgtagatttcttttaaaatgaagtctgaaa

SEQ ID NO: 17352 - DNA, 375 bp, Homo sapiens
gaatatgtcagaaagagccagaggttagagacccaaacaccacagtttctaatccttaatcaatcatttttttcgctctctggagtaaccagtttatttcattccaattcaagatgactcttagggggcacaattgttccttatacttgaagagaagcccatcatttcccaagagcttaataaccacaccatggcaatagcctttcaaagtattatatgacccttcttaaagcatttgcctccatttctgaggtaatgaaagacatctgaaaagaatttttctcgggctaacaagaaataggtaactctgtttagtctttgtgttttactcctttctgtagacataggatgttcttggtacattctgagccccat

SEQ ID NO: 17353 - DNA, 229 bp, Homo sapiens
ggcttgaaatcctagcataagtacatgagttctatatcatgtagtgtggatgtgctcacatggataagtgtgtgtgtgtgtgtgtgtgtgtgtttctgtgtgtgttggagggagggaagggtgtaacagtttttgaacactcctatccattatctttaaataaagaacctcatttactcttcatgccaagccttttcagatggcattattattcccagttgcagttggg

SEQ ID NO: 17354 - DNA, 563 bp, Homo sapiens
gctggctgattctctatccagaatgttactcttgatgcaggagtaattcagatttttttaacagtgtataagctgtataatgttcattatgtttatccattttttaaaatatagatgattacattgtttaagatttttcaccagtaccagccatttaaaaatgaatattttagacattatttattgacttttgtctaagaaattaggatcaggattaagcccttcatgcctaccctagtctgtcaaaattgcaccccaacagggttgctcatgaaagtttctactgtcaatgaaaatttgcactggacatattaaaccggcaagaagatttttttcaagactattgcaatacgggcaatacattgaacttgactcctccaaaacaaaaggcaggggagtttttaagcactccggtgagctggtagaaaaataccagaggaagttaggagggaggtgagcaaatctggtcaggctatctgtgtttgctaattgtgtttatcaaattcaattttacctgcaaatttttatttgtcaaagttaggcttctaccttgtcacaaagac

SEQ ID NO: 17355 - DNA, 82 bp, Homo sapiens
cacatgacctgaatttagaagcaggtgggatacttatacttttctcagtctgtgggcaccacaccattgaagtatatgtcta

SEQ ID NO: 17356 - DNA, 411 bp, Homo sapiens
  misc_feature 38, 341: n = A,T,C or G
gttttattaaagaagaagagagaaattaatttgaggtncaagtaaccactggaagcctttatattttccattggtgaaatatttgaaggtcttttaaagttttgttcaaaataaaaatgaaaccagtgacaatgtggaaatgtctatagtaaggtgagtaactaccaggcagccttctccttgttattatagtttgtatcttgttgttttaatgaggagtgatgagacaaaatagagcaaagagaaaccaaggcagaatgttagcaactcttgcgtaatagtgagatctgttagactgtggatgggtctccatggggagcttcttcacctgagttacttanatccgaactggacagagaacatgccatgtgtacaatctcgcaatacagctggacatactagattacctag

SEQ ID NO: 17357 - DNA, 454 bp, Homo sapiens
cttaaccctgtcagctaatctttaacttaggctctggcttttgccacaagaggatacagctctctccaaggtcctgaagcactacttaagcatagttaaatctagtcactttttattagctttcattctcttcctacttctgattgtatttacatagcttttcagtctctaagatggggaataataatgattcctattttccagaggtgaggattaaatgatataatgtgtgtaaactgttgagattcatgccagacacacagtaggtgttaacttgtgctggttcctctcttccccactccccttatcatcttgtgcctatgttctgtctctccaatgagactttatattataaatatcaccatgtcaccccactgcctacagctttcaatagcttttcagtttactcagaataaattcttctctaaggctctaaattattcagcccccacat

SEQ ID NO: 17358 - DNA, 310 bp, Homo sapiens
gcagagcttgccctgtagaaaaagcacatcccaggtagagagggtagcacattaaaaaatgaaagcataaaaaaatacggagaacttaaaaagattaagttctacaaactgataaaagtgagttaggaccaagttgatgggccttagagaccaaataatactttccgtgtgcatagtatttttcagattctgagatgcaccctatctcatttgattctcacaaccgcttgtaatgtgtaagagcatgaggtctttcagaaaagctggctggcctagcagggcgcggtggctcacgcctgtgtggatcatg

SEQ ID NO: 17359 - DNA, 368 bp, Homo sapiens
cctaccacctgtcattcagattttcccaaaattgaatatttttgtttggaattttatcatacttgatttttatatgcagagagcaatgagcaaaatctgaaaaatcattcttataaatgtagttgtctttcactagtaaaaaatacgtagtttagaatttttaaggagaatttatcaaaaataaccgaaataaaaaataatttggcatcttttccctactatgtggttattcgttcagtgaaaccaatacttactgagttaatgagagtaaacaaataagcagttgtttatcatgttcctggcactgattttggtggttttttgtttttttataatcaatatttgttatatgtggagaatattttagt

SEQ ID NO: 17360 - DNA, 421 bp, Homo sapiens
tgtagagacaaggtctcactacactgcccagactggtctcgaactcctgtcctcaagcgatcctcccacctcagcctcccaaagggctaggattacaggtgtaagctattgcacccagcctcgttacttttctttgaatattctaggtcttcaagatctcatagtaggctgactctttggaagttacatcaaaaacagccttttatcttttctcaaactggactcgcacatagaggctggagaactagatcaatttatattccatcatctcactaccacctccttccccagcctttctaggcacctacactactctccttggcctcaaataatctcacgactatatacagccctggccagccgtggtgtctcacacctgtaatcccagcactttgggaagctgaggcgggcagatcacttg

SEQ ID NO: 17361 - DNA, 471 bp, Homo sapiens
tgttaaacttccttcagacatggaattaaattttgattcaattttatccaactgtcttgggaaaaggggaatgcttcacctactggatggtttaaattattttgttgtaatcattataaaaatgtgtacatctgtggacaaaaagaaacaatgaatgagccaaatacatacttggaaattcgcaaaaatgttagttttatatagacataatctgatcgaataagctcagtgtttacaatagtcttgtttcttttacttgtcaaaggctctgctatctgaaaatattcaaaccatgagtttcatgggccctgcctgtgagaaaatgtgcattttccacataaaatccatttccttgtcagataatttacaactcaccctgtttaaacagactctgtatttaaagctagaagatttatcacacagcaagttcaacctcaggaattccatataagtccacaagcacatgtgtct

SEQ ID NO: 17362 - DNA, 349 bp, Homo sapiens
ctgtcgagatagcagagacacatgagcatcaacatgaaaaacagtgataatgatagtgtgcaccaggattcaggtatcttcccaggagtgttttccctctttatgcctaattaaccatttgtaaagataaaatagagaatgaaggtggtgtcggtgagattggacatcaaaagacacaaaaggaatgtgacatggtgacctgagaaaggaatagagagagaaattaaaatagacaaaaaggggaatcagcaaggagatggaggaggcagaatagaagaggggactcaacaaacaggagcagttggtgcaacagagggtgcatcgcatacttgtacgacgcttctttcat

SEQ ID NO: 17363 - DNA, 620 bp, Homo sapiens
gtctcaggttctgcttcctggagaacccaaattgtgtcatcaggaatcaatttggcattatcccttgggtttttaatcgatacccagtacaaaaaaaggtcaaaatgcttctgtcttttttttaactcattgatgaaccacagcagttttctcaaggcaagatagacaggggcaagactagcatctaagaggataaactctggcaggagggtttctgtaaagagacctagaacccctcatagttcaggcaaataaacagtcaccataaggagccaagaatagaaatatatctaataagctatattcgccagggatgacaagtatggggcagaaatccatggggatgtcagcccaaagataatagggtccacgaagagctagaattctggaactgggctgtaggcctagagtgaggaaaagcaaaagtaagacaaggcctggccttcggatagatttggatttggaagagtaactagggtgccaatgtagaaactcagaaagagtggaaaaaggagaaggccaattatgctactgagacaggattcagatatatcaacacaggtaccaagcaagggcaccacaaagcaggtggcagctgggactcaagccccatgcacact

SEQ ID NO: 17364 - DNA, 547 bp, Homo sapiens
ctgagagaagtgtccctgaccacccacctaaaataggccctccctcactccatccctttccctgctttattttccccagatgtggatgccacctgccatggcacacacttactcctccattctttatcatctctgcctaggacccagctccagagggacagagactttatctggttcactgtgaatcttagacctgatttgtgcctagaacatagcaggtgcaaaataaatacctgcgagcagaagaaagtcatctgtccctctgttttggcacactgccccggggagccactccgaaaggggccagtgcacctctttggctctgcaaagctcagaaactagagggcacgtttctgacttttccaagtgcaggaaagtggagtggctggaggggtgcaggttgcatttgagtgggcagaagccagtctgccattctgggaagctatattttcacaaatgccacgtgtaggggagccacggaccaccccccaaaacacactcctgtcctcggggtcatactgcagagaacccccggcacatccatgac

SEQ ID NO: 17365 - DNA, 618 bp, Homo sapiens
  misc_feature 560: n = A,T,C or G
acagaggtggaaataataccttcagaggagagaggaggagaaataggaagcttgagtgtacagattgctataggcttggtggcaagaaacttaagttcacttcttgcggcttctctgttataggagagaaaatcatctgctataaaagaggggcaggtgataagattggatgttttaggagaatgaaggctatgggtgtatgggagtctgtattaactatggacacagggaggatgatctaataatgtgtaggtcccacttgacaatggaatccagggatgtcctgtagcactaacctaggtagttttattattttcacaggcaatacaaggcatctctggaggaataaaaagaatatatccatttggattaattgagaggttcacttacatacacctgggagatgctcctagtgtttaaacctgtaaaatattgcaattgtttaaagaattcaaaactgcattccaatgcacactctgcctgggaacaaaagcactctcttaccaggttatatcaaaagattaaagggacataaagctcatagtcattatgtttcctanaggcaggaactatggaaaaacatttgacgtaagttgaacctatgatcaaaagtgaatt

SEQ ID NO: 17366 - DNA, 584 bp, Homo sapiens
taactattccactatcaccaaacatttaagatgtttcatttcttcatggtcatacataatgctgaaatgagggtctttgtatataaatatttttttctttcatatttaggaaaaatttcttgtgtagtgtttttataagctacaccactgaggcagagtattactacatttaaagttcttgatatctgttgctaaactgccttcaaaaaaggtggtgtcaatttgcactttcaatggctgtatatgagaatgtctgttttgccatacttctagcagcagtgagaattgtcaaaactattttctagttattttgagaaaaatattaatactatctccttattgctttaatttgtatttctttggttattagcaatgctgataatttcctcaagtttgttaacttgctttcttctgtgatttggctgggcatactttaaaaagcatcttataataaagctatttataatgtacagtgatatcatatagatagtattgtgataatatattacacattgtgtattgatataactcacacaccataccattcacccgtttaaagcaaacagttgagtgacttttgagta

SEQ ID NO: 17367 - DNA, 672 bp, Homo sapiens
aaatgtttatttaggattaccagcataatgatgttttctaatatttgttaagtacttttagatgtttagcaccatgctggggaaatactataaaaactttcttataattaacctcctactcaaaaggttatacatgatccgaactttttccttttcctgccaacactgaggaatgtcatacaaagaagtcttgaggtgagtagaagtgataaagacaaaaaatttaaaagaaagggaaaaagttttctgcaaacttgttgccacacattagtcttacatgaatttatccattaattatgttaatgctgaatggaccacattacctaaagttgtacaagtgattgccccaaaacttaacttccccaagaaactggaataaacaaaagcgaactctctttgaaggaagtcacatctatcttagaccttgatgaacctcgaaaataattttctctaggcaatgactagcaagcagcagaagataacatgctcacaaagaagtaagacaatgtgaaagacgccagaagagaaaaataacagaaacaaatctgcaaagacatcaaatattagacttatcagacaaaaatattaaaaacaactatgcttttatgcaatgtacccatgtaacaaacctgcacaggtaccccaaaaaaaaaaaaaaaaaaaaaaaaaaaa

SEQ ID NO: 17368 - DNA, 410 bp, Homo sapiens
gcatgtgtaatcagttgaggattgacgcatgcaactattaaaaacaagattctaaccttcacgtcaactcttccctgaataaaaagatgatcatctttcagtgactacggacttcataaagtgttttttattttttttgttgtttttaatattagagttggttcatcagtgcttggaaatatgttgccataaaggatcaggagacagcacaagtgacgcctgaattttgcactgtttttcacctttagagtcagatattagattgaattatagcaaatagctgcagctgacttgtatattttttagtattaaaattatataagccactgaagacagtggaatcaatatttgcaaaagctgacctataacaaagtaaaaggtttttaaatgatactataaataatatttac

SEQ ID NO: 17369 - DNA, 334 bp, Homo sapiens
actcactgaataagtgagtaaatgcgtgttcctgtagtacccagggatcttcctcactgtatcacagatgatttacaagaaggcatcacctcccgcctgccattgtactgtcatagtggcagagggtagagacggcaggcagcgtggaggggtgcaaagagtgtgggctgggagatcagctggtctgagttcaagctccaacaactgtttttcttagaaagaaaaaggagcaaatggagaaggaattattaagcagtatatttgacattgtctttttatataaatgttccactgaatttataataaatccatggagtgagcattactatatcat

SEQ ID NO: 17370 - DNA, 585 bp, Homo sapiens
aatgttttgccatgctctggcatttttttaaataaaacataaaaacagcagcattgtcagagattggggtagaaccaccttgtttggccctttcattactaatccaggagaggcaaagcacagggaagcccacgaggttttaggcaacattaagcttttacaggccaggcaatttcaaactaacaggaagtaatgcatggtgagaaaaaccatagaatgaagatgtcatcaacatgcaagagagtgggaaatactggccagctgcctcactgtaagaaaaggaataaaatgcttctgggggtaaataatacaaataatactctaagtgtagagatagattctgagctctgacttacactcctagaaagtaacctaactgagccggatgtggtggctcacgcctgtaatcccagcactttgggaggctgacgcaagcagatcacctgaggtcgggagttcaagaccagcctgaccaacatggagaaaccctgtctctactaaaaatacaaaattagctgggcgtggtggcacatgcctgtaatcccagctacttggggggctggggcggaagaatcacttgaacct

SEQ ID NO: 17371 - DNA, 483 bp, Homo sapiens
  misc_feature 398: n = A,T,C or G
aagggtgaccccacaatcgcctgaggggatgctgggaagcattcctgtgccttcctaggggacaagtcagctggaaccaacaggatatatcttatattttaagatgtgcagttaggctgggcatggtggctcatgcctgcaatccaagcactttgggaggccgaggtgggtggatcatctgaagtcaggagttcgagatcagcctggccaacatggtgaaaccccatcgctactaaaaatacaaaaattagctgagcatggtggcaggcacctgtaatcccagcttctctggaggcttaggaaggaaaattgcttgaacccaggaggcagaggctgcagtgagccgagactgtgccactgcactccagcctgggcaatagagcgagactctgtctcanaaaaataaataagtaaaaaatacagatgtgcagtaagcattttatttttatttcttattttttacagacagggtctcactatgtt

SEQ ID NO: 17372 - DNA, 600 bp, Homo sapiens
ttctagagcacgcaacctagatccctcacatgtgcagttcacaatagggttcacactcctatgacaacctaatgctgccgctgatctcacaggaggcggaactcaggtgggtaatgctcgctggcccaccgttcgcatcctgttgcacagtccagttcctaacaggccacggaccagctgaggacccctgctctagagaatcgccaaatgtgagggtggtcatgaaagtttcaaacaggtgttaaaggcaaagtgatataaaagaatcatcactgcagttttaaagagtcctataaggaagaactctcatctttttctcttgatcaaattcactttcagaccaaagagacatgcatatagaatttaagcagaatactgtgattcatgtaagaaaaaataaactacagagatccagaaaacaggctgggcgcaatggctcatgcctgtaatcccagcacttcgggaggccaaggtgggcagattccttgagcccaggagttcaagaaaagcctgggcaacatggtgaaaccccatctctacaaaaaatataaaaattggccaggggtgggggtgcacacctgcagtcccagctatttggga

SEQ ID NO: 17373 - DNA, 595 bp, Homo sapiens
  misc_feature 291: n = A,T,C or G
tgtgtgtgtgtgtgtgtgtgtgtgtgtgttcacagattatagagattcacagctgacaaaaaataacttctgggagataattttctagtgggaaagaaacatcaacaattcattacaaaccaataaggtcactgtcaagataagtgtgtggggacctccaaggaagctctctattttactaaagtccagagagtctgtccgggaaggcttacagactgcatctcattggtttattcagccagtgtgtactgaatgctttatataagctttgtcctcattgaggttctgganataaatattgtcaataaagcatggcccctgccttccatgaggcaactcacaatctctgctaaaccccagggaaagggtggttcagctactttataggaagaattctggaagaactgagaatgtttacctcttctaacagtcttctctcattcacgtttaatttaattagaaatggtctaaattgaacttcggcagagcaaagcaacaaaacaacctgagaaactctatttgttaatagggtagatttaagtcgatgttctctaacacagtaagcataagcttaaatgttccctaattagagata

SEQ ID NO: 17374 - DNA, 609 bp, Homo sapiens
gacaaagatcagagaagggcagcggaacaaagaacagagctaataaccctggaattatttcaccccctccagagccctaccgttatgtgaggctgactgcctttgcccatacccactctcacatgggatggagcccttgcttgaggcctccagctacttggccgcaactcttgggcgggagagacaactaggatgggtgaaaagtgaggaggtgattggaggtgatagagaatgaggaactcaaatgggattataagaagggagactcaggaactaaatttgaactagaattaaatgctctccaaaaatgctgttacaccttgaggtgtagatacccttacttaatctgcatgcatcgctatggtcacagcctaaaatgctcactgttggcatatgaaacctcatttctaataaaaagacaaatgccatcccaggtcaatttagtgatatacatacatgtggataataaaagtgtaactggggaatgacacatagactaactgtagctatttgttgcaaaacattagaattacgcattgggcctgactctgaccatatttgtcctttagtcctgatccgactgacctggcgggagtcatcattgagctc

SEQ ID NO: 17375 - DNA, 411 bp, Homo sapiens
actggcccattactacggaggagcgagagttggcaggttttaaaatcatcatcataatcaccatcagcaacggtgtcatcattgtcatcgttgacactatcatcactcagataattatcatcatcattactatctttatcataccatcatcctcatcgttttggcctctatgatgtacaaagaatccaaaagctaatgctgacccagcctatgaagttcatgaggatgtatggcatgaatatgtgcaaagataactaacagtaaaaaataatgaagattaagtccacctctttatatgttacagatgattagaaaactattaaagtgtggctctaggaggaaaataatcaggaatgactgtgagaaagaataaaaaaataacaaacatgagtggagtttacctaaatatac

SEQ ID NO: 17376 - DNA, 386 bp, Homo sapiens
tagggaaggtggcatgaatcgtaagatgaacactgaagctgtgctacaaagaccaggagctttcaaaacatccagaccctctgacccagaaagtattccccttctaggaatctgtcctaataaagtcatcagggaggtgtacagagagatgcacaaagatttatgtttatagtttgattcctggaatggtaactagaaaaggaaaaaacataaataactctacttaatacagctgggaagcggttaagcaaacatggaggtggtgtaactaggtggttacatccacatcacgcagtgtttttacagctgttaaaattgatcatttgtgttctttctcctttttttcccttcctgattgagtctaaaagccatcatgtgtggctgag

SEQ ID NO: 17377 - DNA, 533 bp, Homo sapiens
agaagaaagaagaaggaggaagaaggaaggaggaggaagaagacagtcccaaacaagaactgtgcgactcaggatgtcaacatgactaccactgaaaaacactgtaaatacatgatgtgaaaagaaaaaaatatttagaaacactggtttcagaaccacaggctcaaaaatcatgataggaacatataataccttctaattacaaaacggaaacaattatcacaagctccttatttagaataaaacttaagtagatataatatatgcacacaggtaacaagtgtgtgtgtgcatatattttttgctgtcttatcctaatctctatccgttacatagtatattcagtaactacgcaagataggtacaagtattaccatttgacagatgaaaaaactgagggacagagaagtaaagtaacctgcacaaggtcatacgactattgagtatcatgacactgagatttacccagagggttgatcccccgagtccatgctcttaaacattacaaaatactagtttagtaaaataaatgc

SEQ ID NO: 17378 - DNA, 176 bp, Homo sapiens
aatacagatcagtacatgggtgtgggaaaactaaccaaggccagagaaaggatcatttggaaagactgaaaagaacgatgcctgatatttacacaccattaatcctatggaaaataggaaaaaaaagagccaggcacggtggctcatgcatgtaatcccagccctttgagaagctg

SEQ ID NO: 17379 - DNA, 497 bp, Homo sapiens
ctatcacaagttactaacacagttaatactatctgtttctttcctgagacaggtcaagttcactactgcagcacaataggaaaaaaaataggctcaagatgcaatgtttttctgtttaaaccaaactaatagctactgtaataaacagtgcttacactataaagttatcattaatgtacaagtaggcaacagatagttacattttatatgcattgcaatgatctcgcagacgcttattaaaactgagatcaaatattgtaacaactcactgtccagtgcacttcgatggaagaggaagaaaggacggtggggttgtggaggtgcagaacagcatttcccagctctctctggacctgcttgtggtccaccccctgacttgttggtaggacatctacaacaagtcaagaaaactgtgtcagggtctgcacaacgttactgaacggaatgaaagcatggtgaaacaaactgttcattcatagcaactctcagtaaagaag

SEQ ID NO: 17380 - DNA, 580 bp, Homo sapiens
atagccaaatttcatagttggctatagtgcaataattttagaagatattttgttttaaggatgagtatagtggaatgcaacaggcctcagatgaacttttcagagagaaaaggtacaaaaaggtgtatctcagaaaacatttttttatttcctctatacattgtgactatttaatggaacagagcattcttttgaccacttttttgtacataattaaacctagtcaattttaaagtgaggcactgtaattactgaccaagatgtatctactcaatgccaaaaaagttgttttggattatgttgatgtcatagtgtttaaaaattacaacttttctgggtcaggcgcggtggctcatgcttgtaatcccagcactttgggaggccaaggtgggcagatcacgaggtcaggagatcgagaccatcctggctaacacagtgaaaccccgtctctactaaaaatacaaaaaattagccaggtgtggtggtgggtgcctgtagtcccagctacttgggaggctgaggcaggagaatggcgtgaatccaggaggcggagcttgcagtgagcctagatcgcgccact

SEQ ID NO: 17381 - DNA, 611 bp, Homo sapiens
catagatcttaaaatagttcatgctcctactactcagagtaaaaagaactcatagtacatgaggacttgagtagagttcttgaaagggcaacaccttaacagtaacgttaaattagctctcgcctaaaggctgctctagatctgccttaacaaagcttaaaggtaagcctcaaaataagccaaatgaagccaagtaacagctgtgcaccagaacaaaatccatcgtagttacagagataaaacaaaatccagcaacaaacaaggtaagtacacaatgtctggcatccaattaaaaaattgtcaaacatgtagacagggcttctggctatagcagaattaagaggtaggtaagtcctcttttcacaaaacaagtataatctggacaaaattgtcaaaaacaactatttcaggaccctgaaaaatgaccaaagagaaataaattatgaggcatttattgattttttttttaattgctgggacctcagatcagaacctcaggaatctgtggccttcctgcctgggtccactcctattctcccattcccagtttagttgctgagaatgataaccttaaaaaggtgaggcagattgtaaaaatcagaagctttgct

SEQ ID NO: 17382 - DNA, 157 bp, Homo sapiens
aaaaaaagatgaaggaagaggattaaatatagtgcagattaaacaacatgaacaacttgtcccctgaagtatgttaatatgtaattagattttattatttaggcaaggattcccctaatggagcacatttctgaaatgatgaaaagtattaggatat

SEQ ID NO: 17383 - DNA, 598 bp, Homo sapiens
gttccactcagggccaatgggacccttgggaatacacagaatggggtcccttccccacccaggagcactaggtatacctagtccagcccttggacagagaagcagcatggacattagaagaatcactaaaccaggagagggaaaattaggttctagtctcagctctgccacttacccgctgtgcgacccaacgtacgttgcttaacctttctgagcttcagtgtactcttaataaaatgaagatggaatagagaaataggcaaaggattcaaacaggtagtttaacagaaaaggaacacaaatggccttaaaagcattaaaatgggatgcttaaccacactcataattaaataaatacaagttaaaacaagatgtatttcagcccatcaaactggcaaagtgaaaaatgtcaagaatgttcaatactggaggtgtggagaaacagagcttcttgtatactgtgaagatggaacagcttttctaaacagcaactaggcaataggcatcataatgtaaaatgcatcttttctttgacttaccacctccatttctaggagtgggtcctactgatcttgccatatgagaacacagagtcaga

SEQ ID NO: 17384 - DNA, 537 bp, Homo sapiens
atactgctatatagaaatccttgtgaatcaataaatctcattacacatgcagatatatctaagctgacagctacagagagacagcactttattgtggaaaatacataaaaggtctctgagtccgaatcctagatgtggaacatgtaagacttttaatagttgcagcctcagtctactttcctttaaataggaaaaaatataaacaacatattttacaaattagttatgatgattaaatgaaatacttgaaggatatttgaaagttatttcagtaaagaaataaaaggttactattaaaattaattctgtataactagttatttaacacgtaggaagatggtataagattctgtttcttcaccaaacaatctgtccccaagaagaaagtctaaggttatctcaatcatatctccttgagcttagtttcttacattaaaaataatgaataactatctaaaaattacataatgctgatacatcaaaagaataacaatagacttaattcaataatcactaaaattgtcattaatatcaagc

SEQ ID NO: 17385 - DNA, 260 bp, Homo sapiens
agacagccataaaaacacaatagttcacaaaggtaaaaatatgtggaaagtatttccctcatagaaatcccttttgccttttcagtttttaattttgttttgttttgtttttgagatggagtttcactcttgttacccaggctggagtgcaatggcgcaacctcggctcaccgcaacctccgtctcccgggttcaagtgattctcctgcctcagcctcctgagtagttgggattacaggcacccaccaacacgcccagct

SEQ ID NO: 17386 - DNA, 204 bp, Homo sapiens
gaagatggggaacgacttttaatgggtttggagttctagggagagggttaatgaaaatgttcttagacttagataaatgttctagacttacgaaaaatgatgaccaatttctccactaaaaggataaatgaattattggttaaggaaaaaagaatgcattaacagtctgggtgcggtggctcatgccagtaatcccagcacttc

SEQ ID NO: 17387 - DNA, 409 bp, Homo sapiens
gaaatcaaacaaaagaaaacatgatggattcaatcatcatagagtatggtaaacttaaaaataagtcatgtgtgatttatattcaatattgaatatcaaaactatctgcatgtcttttaacttgacaaagtctacggtaggagaaaatagtcaatgttagaagttatttagtaactctcagtgaaagcaagaccatgttaaaaaagggaagagatgattatgttaagcaggataagagataagattaagatgaatattgccaacagaaataaaattcaaacaggtttcatgaaactttaatttctagaatttaacaattatattatcaaatgaatattcatgtcttctctgctgccagtatcagctacaaagagttctggttctgcaaacaaaacctttgggtcttcat

SEQ ID NO: 17388 - DNA, 400 bp, Homo sapiens
caacggcacctacctggtcagcttcactctgttctgggagggccaggtctctctgtctctgctgctcatccaccccagtgaaggggtgtcagctctctggagtgcaaggaaccaaggctatgacagggtgatcttcactggccagtttgtcaatggcacttcccaagtccactctgaatgtggcctgatcctaaacacaaatgctgaattgtgccagtacctggacaacagagaccaagaaggcttctactgtgtgaggcctcaacacatgccctgtgctgcactcactcacatgtattctaagaacaagaaagtttcttatcttagcaaacaagaaaagagcctctttgaaaggtcaaatgtgggtgtagagattatggaaaaattcaatacaattagt

SEQ ID NO: 17389 - DNA, 543 bp, Homo sapiens
ttcatgcgatcctcccaccacagccttccaaaatgctgggattataggcatgagccaccagtgactggccacaaaaggagacatcttagtgacagatggtgatgaaagagaagatgggtttgggggaggaactccacgtgatagggatccttcactgagggcccgggctgcaggaggctctatgaaacaccagaactctttgtaaaacttcctgtttgtacatgacctgctcatttctcagcaggggctcctcctgtgcacatggacctctccccacctaaacccacagttcctgtggtcagaaggccagtcactgaataagggcacctaaggctctggtctgaatatctccccttggttctcagtctgaaatcccaaaaggaagacagttgactgcaaaataggctggagttgtcctgatggccagtagaggtggctgttgatagaattgaaagcttagggccaggcatggtggctcacacctgcagtcccagcaccttgggaggctgaggcgggtggatcacctgaggtcaggagttcgag

SEQ ID NO: 17390 - DNA, 508 bp, Homo sapiens
atttgtctcaacttatatagtccagacttttcatttattagctgtgcaatgtctggcatgttactcaacctctctgtgttcattttctaatgtgtaaattaggggtaataccattacctatttccttgagtaattgtgaaaattaaatgaaataataaatgtaaagctcttagaattgtccttacagtaaatgttagctgcttcaactatttctgctactaccaccaccactactgcttccaccacactaccaccagtctttccaacatcaatagtgaatgcattttgtctaaatactacgatgaatacaaaaaatatggagctcagtgtctgccctctagaaacttaaaatgtagttagggctaacagacaaaaacaaatgcataaataagtcaactatatgaggctgtctaatttgaattgaggcttaagtgatgggtagtatagaaacttagtgcaaggaaaaagtatttttgaattgacactaccatggaaaacttcatggata

SEQ ID NO: 17391 - DNA, 148 bp, Homo sapiens
aggggagctttgttccaaaagtttatctataaatcatagtttgtggactgctgtagagaaactactataaattgtgattgaataggtttccagtcaccccacaacatctatttcatttcacaatgtggatgaatttagtttatacttc

SEQ ID NO: 17392 - DNA, 589 bp, Homo sapiens
catacaacagcagcatacttattaccttgaattggtgatttaatagaggcacagctggtagcacaatacatattgtttaaactatttgagcacatctggtcatatcctattaaatcatttaaatccaggtaaaattggggacctccccacgtccatgggaattatgacagaaaactttccgaacagcaaaacacatgcaaggagacacagtaatacctacagaaaaaccttactagtattcaagttaaattaggtatttgttggaccctgggataaatgtggaaattgacaaacacaattaaaagacttactttggccaggcgcggtggctcaggcctgtaatcccagcactttgggaggccgaggcgggtggatcacaaggtcaggagatcgagaccatcctggctaacacggtgaaaccccatctctactaaaaaatacaaaaaatcagccaggtgtggtggcaggcgcctgtagtcccagctactcgagaggctgaggcaggagaatggcgtgaacccaggaggcagagcttgtagtgagcggagatcgcgccactacactccagcctggacgacagagcgagact

SEQ ID NO: 17393 - DNA, 436 bp, Homo sapiens
taccactcataaggaaattgtacagagttttgcagtttgttttcacttctttttctacttcccccaaacctcccactgttactatgggatgggaaggtgtaaggcagggaaagattgctatttggttttgtaattgtgttttaaaagtaggtaagtggcactttaatgaaaatttaacttattaaaatgaaagggaaatctgtgtcagaaaggaagaaataaagacaaagagggggacgtatgagtgaattttctatttatatttattactttgtaattctatctcatttttaaaaatatatttttcattccctttcatggaaaatgacttagagagctgaatttcaatttagtcttctcaagctggctgattctctatccagaatgttactcttgatgcaggagtaattcagatttttttaacagtgtataagct

SEQ ID NO: 17394 - DNA, 432 bp, Homo sapiens
ttttggcattaatctatgtataataagatacaattattaatatgtgaaagcacataaaatgcctaatctgatacatcaataatgaaaaattcacaggaaattcgttgcaggaagagacatttgttgacttaaaaacacaataagggcctggtgcagtggctcactcctgtaatcccagcacttcgggaggccgaggtgggtggatcatctgaggttaggagttcgacaccagcctggccaacacggcaaaaccccatctctaccaaaaataacaaaaattagctgggcatggtggcaggcgcctgtaaccccagcgactcgggaggctggggcaggagcatcacttgaacccaggaggcgcagcttgcagtgagccgagatcgcaccattcattgcactccagcctgggcaacaagagcggaactacgtctc

SEQ ID NO: 17395 - DNA, 358 bp, Homo sapiens
ctgagagaagtgtccctgaccacccacctaaaataggccctccctcactccatccctttccctgctttattttccccagatgtggatgccacctgccatggcacacacttactcctccattctttatcatctctgcctaggacccagctccagagggacagagactttatctggttcactgtgaatcttagacctgatttgtgcctagaacatagcaggtgcaaaataaatacctgcgagcagaagaaagtcatctgtccctctgttttggcacactgccccggggagccactccgaaaggggccagtgcacctctttggctctgcaaagctcagaaactagagggcacgtttctgac

SEQ ID NO: 17396 - DNA, 606 bp, Homo sapiens
aattgccccaggctgtagatgagagtatggagattgcaatgtgtgccccatctgcagcctgggacattggcacaactagccacttgctctggtcttcaggattgctggacgatgaatagcactatgtggagtcatattctgtttcattctagtccattatttcagatgagctcaggagcaagtggattgaatacatgaaggtcagccagcatcatggcagggtgagagagatgagagagctgaacttccagctcccagcactagttaatggaaataataggaccagaagggattggtaacagtttgcaatgaatgacctccctctacaaactaatatatacatgtttccatttctttcattttaactactactattaataggatactttgcatgaatccctcaatccattaatctgctttttttagaaccaaaacatgcataggagaaggttaatctgtcttctctctctctcctttctctccctgaaaacagaaaacagcaccagcaagagcagcagtagaaagacaagggaaatctggcccagaataaattgggttgtgctgaaacatttgtaattaagcatgataaccaattacggaaatacc

SEQ ID NO: 17397 - DNA, 586 bp, Homo sapiens
ggagatccagcctcttcagctctgggcaggcaagaactaggcaaccaggccatgggtaccagggcctctgcccccagcccgggagcccctgtgttggggccaggatactatctgaacatgctgacagtctggactttggaaggggaaaatggtgcttccctgtatgggcttctgtgtttgagctgaggaaactgaggccagagagatgccgtaatttatccagggacccagaaggggctcatagctgagctgaagagtgtcccacatcctccccagtactccacactggtccctgagtggcagccttgctaggatggcaggaatcagctgaccacttattcctgggccatcagacccttagaatagggaccaggtgggcagtgctgcctctgtgtctgaaagtggacccaccgtgaccagtgcccagtgcccaccaaggctcagccaggggtttcaccagggcatggggcactggctgagcataccacgccctctgtgtcctctgcaacactagagccctgagactagaggggcagaaagatgccagctgtcaaaagccagtgatatccaccagaacacactgacc

SEQ ID NO: 17398 - DNA, 378 bp, Homo sapiens
aatgggtttactaaatatttttagacaatttcttaagtatctacttttatttgcatacagtaagttaggaaagacatttaatgttcctcatacacctgctgtgttattttgtgtgtgtgagacagagtctcgctctgtagccgagccaacctccacctcccaggttcaagctattctcctgcctcagcctctcaaatagctgggattacaggcgtgcaacaccatgcccggctaatttttgtatttttagtaaagatggagtttcaccgtgttggccagactggtctggaacatttaatgttccagaggcggaggctgcagtgagccgagatcgcaccactgcactccagcctagacgacagagcgagactctgtctt

SEQ ID NO: 17399 - DNA, 119 bp, Homo sapiens
tatacacacatactcaacatatatctatccacatatttatgcatatttatagtcattaatatgtaatatttccacatatctaactaagtatctgtttcttagataaaggaaattatatg

SEQ ID NO: 17400 - DNA, 635 bp, Homo sapiens
  misc_feature 502: n = A,T,C or G
acaatgaatttttattatatatgttgtgatgaaggaaacacaagaggctgtgggactgtagaaaagcaaacaaagaaattgtgacatttaacctgagtctttaagcaccactttttcaaagaaacaaggaattattgcaaggagaaataaatagcaagattaaagctaagaggttcagaaaaactggagagtgagtggaagtcctagtagctcagtaagatctgtcattgtatctactccttcacaaacacgttaaaccctttgacttgctttctttctattatactcatttggtaaatatccctacctagaatgcacctcatgactgcactaagcaatgattttccctgcagagaagcacaagtgtgatagtctttctttaattttgtgatcataaatgccaaatgaatacaatatcgctcagcaatccgactatacacttctattattttttcccatccccctctccttaattacttcaaacatttccatcactcctcanaactcctacaccaatcttcttatcctaactctcagctaaccatttaagtcataatccactaataaaatagagacaaagagaaatttccttctatttgcaccccataaacaaccaacatgttctgtactggagt

SEQ ID NO: 17401 - DNA, 461 bp, Homo sapiens
  misc_feature 94, 95: n = A,T,C or G
tatatagccatctgtaaagtttacttcacatagtaaatgagttaacgatatttaatttcccatatttcttaaccatatctttttctttcatatnnagtgaacacagggactttcaggcatatactaatggtgttcctaaaatgattcaatttgatcttacgcttcagtatttcttttcaaggtaaattaagtttgtgctgttgaaaaaatgttaaattgttgtttgcatcttctaatgagtatagtagctgagagaagatagctatttgcattcagaggcatgtccaagtagggagttccttcttctaactcttatagttcaggaacataaccaagtaataaagtgagtaataaacaaatagtgaacagtggccaggcatggtggctcatgcctgtaatctcagcactttgggagtccaaggtgggcagattacttaagaccaggacttcgagactagcct

SEQ ID NO: 17402 - DNA, 547 bp, Homo sapiens
caggggatccaggatcatcaccaaggtcattttcccagacagatgtgctgaggctgtagaaagtgctttttatttggttgggagcttgtgcataaatgcgagaggggctgcacatctgacggactagaggtgactcatggctgaaccggaacaggacatcggggagaagccagcagagcttgtgtttaaagtcagaattcagaaccccaaagaaaatgacttcattgaaattgaactgaagagacaagaactgagttaccaaaacctactaaacgtgagttgctgtgaactggggattaaaccagaacgagtggagaagatcagaaagctaccaaacacactgctcagaaaggacaaagacattcgaagactgcgggactttcaggaagtggaactcattttaatgaaaaatggaagctccagattgacagaatatgtgccatctctgacagaaaggccctgctatgatagcaaagctgcaaaaatgacttattaaatactcccaggaatggccgcgcatggtggctcaccccctgtaatcccagca

SEQ ID NO: 17403 - DNA, 545 bp, Homo sapiens
tcctgcctcagcctcccgagtagctgaggtgcccgccaccacacctggctaatttttgtatttttagtagagacgaggtctcaccatgttagccagggtagtctcaaacttctgacttcaaatgctctgcccgcctcagcctcccaaagtgctgggattacaggtgtgagccaccatgctccgcctgccctgttgtttatttacaaccgctgcctgttttctccagaactctagcccccaccccatttgctataagactctgggagagagaggaaggggaacagaccagagggcaagaagccctctgtggttgggggtggagacaggggcactggatacaggttcagacaggtggtcacttgaaaccagtcattcacggtcaccaaattgtcacagacgtcaaacgcatgtggccactcagtatgtgtgacccagccttggccccagagtctggacatgtcagccaaattcagtgtgcagtatgagtcccagatgtggctatacaaggtcatggacatgcatacatgcacatccagcttccacac

SEQ ID NO: 17404 - DNA, 536 bp, Homo sapiens
gagctgaggtcacatcactgcactccagcctgggtgccaaagtgagactctgtctcaaaaaatagagaaagaaaggattctgtatggaagagtttagtgagggatatttccagagatcccttctaatatcatgaaacttgaagaaataaatcaaaatacttctattttgagcagttctataaagaaaactgaaacaagacaagacaagacaaaacaaaacaaacaaacaatcaaaaagacaggcagctatgagaccagaaagctgccctaaaatatggaataacaacaaaaaaactatccagccactaaatatttctgcagtctaccatttaaccgttaagattgggattgtaaaaagttcctagagaaaaaggtaggaaggaaacataccaattgttgataaaatcactagtctagcttgaaaaccctgtgctggaacagccaggggttgacacagcgtggacactggctaccaaaattagggcttacaaaattgacaaatgggatctagttaaactaaagagcttccgcacagc

SEQ ID NO: 17405 - DNA, 445 bp, Homo sapiens
gtttacatataaatctccaccccacctaaaaccattaaatccttgaaatgaaatacctttagcacttaacatatgcctgtcatctgggagttggtgagcctgtgggatgaatgaatgtattctataaaattgcaacacttacaatagttaggcttatctaaaaaaataaaataaaaaccaagacttttctagcattccaattcctaagtcttcattctgtctcttttggaatggacttctccagtgactttttctttctctaatcatgcaaatgacaactttgtagcatcttatttaatctatttatttatctttatatagatagtggaccagatttctgtgttctacaattccaggagagtataatgggaaataatattacatagatgaaaagagacaattacttgggaatgttccaagagaagatggaattaagctccctcag

SEQ ID NO: 17406 - DNA, 112 bp, Homo sapiens
tatgaaagaatactttctgacctttggtccttctccctaaaccccaccacattcataaccaagggctgctaaaacaggagaattagtggggaaaaagaatgtggatatgggt

SEQ ID NO: 17407 - DNA, 487 bp, Homo sapiens
cttccactcccttgcaaatgactgattttttgtctcgaactcccgacttcaggtgatctgcctgcctcggcctcccaaagtgctgggattacagggttgagccaccacacctggccacatgtttcatttgtttataaaggaactcccctctaagaacaaatcctttttactcttcttcatcatggttaatttttgtgaatttttgttaaagtttgcaacttgcttgagtcaatgattggggaaagaattttttaaaaaatatattttatcctaagtcatgtaaatttctataaaaaaaggatattctagcactgtgctaaaagcagtttgtagctcttttaaattgtatttggagcaagttcacttgagaaaattagatgtggattctggtcacattctatttttggtttatcgtagtgttactgggttgattgtgcacttcatgtatcatattttggttttgagtgttccaaaaaaaaaaaaaaaa

SEQ ID NO: 17408 - DNA, 436 bp, Homo sapiens
tgctgcattagcacccaaccgccagctagacccagtagagtaaagtgagggataaaacggaaggtgtgcaagaagcatcggggtcgtaggttgtctaatcttttgctttcaggaaaaaaaaaggcatcagaaatagctgaatttccacagggaaaacaatggagctggaccctaccccacacgatatacaaaaaccaacctgcacggatcagagccccaaacatgaaaccagaaccgaaaagcttccagaagaaaatgtgtcagaatgtctttgctaccttcagataggcagagatttcctggaggaatgcaaaaagcactaatcccagaagaaaagaaaatgacaaatttggcttcatcaaaataaaatatgaatgttcataaaaagacactccctgggctgggcgcagtggctcacgtctgtaatcccagtagt

SEQ ID NO: 17409 - DNA, 476 bp, Homo sapiens
taaatgtcatctttaccagatagcatgagatggcctagtcctcaaatgagagagtagttcctaacgacacaatctttgggttatttccacaaaaagaattaatataggaaacagagagatgtgttattctaaaatacaaatttcctctacaatatgctttagaagcaagcagaatggcctgtagcatgaggacagagatgatccacagttgacaggccctagaccgtctcctttgtacttgcatatgaccagcctgcacaattcccagtggttttgcccttctcagagaatattcaggagccagcaagtctacatgagaccagtgggcaaaacagctcccttgtgggatttcccacactggggtaaaggaatttcctcaatcatcgctgtgctcaagacaactttgttaaatggggctttgttcccagtggatttttaattgacacatcattggcaatatacaatatgctttacag

SEQ ID NO: 17410 - DNA, 386 bp, Homo sapiens
gcatctaaataaagcagcagagtgaacacagggactttcaggcatatactaatggtgttcctaaaatgattcaatttgatcttacgcttcagtatttcttttcaaggtaaattaagtttgtgctgttgaaaaaatgttaaattgttgtttgcatcttctaatgagtatagtagctgagagaagatagctatttgcattcagaggcatgtccaagtagggagttccttcttctaactcttatagttcaggaacataaccaagtaataaagtgagtaataaacaattagtgaacagtggccaggcatggtggctcatgcctgtaatctcagcactttgggagtccaaggtgggcagattacttaagaccaggacttcgagactagcct

SEQ ID NO: 17411 - DNA, 77 bp, Homo sapiens
ttctaaatgcacattatattaggcatgccattattttaaaacaaccatgccattattttaaaatctccatggtagag

SEQ ID NO: 17412 - DNA, 470 bp, Homo sapiens
tggagctggttcctctcgtctttatgacccgtgaaaagcgcaccaacacgaagacacgcgtgaaaggaccccatctcctaaccagactgacaagcaagggattttttccactcaccgtcagtgggatggttctaagcaccgaggccaacccatttcacacgattatttcacaaaaagaaactttctgtgggacgtgcctgggcgactgaaaagacagccagcaaaactgagaaccttgttcgcaaatccgtaccctctcccaaggcagcctcagaggcccgagggctgaggatccagacccgaaagccactgtaccttctgtaggatcaggctcaaggactaagggggtaaaaggtgccctttcccttcctaagcagaaaattctgtaacccaaccttatgtgtgatcatttaaaaaaaaaaaatcagctgggtacactggctcacgcctgtaatcccagcactttggga

SEQ ID NO: 17413 - DNA, 441 bp, Homo sapiens
atccacccgcctcagcctcccaaagtgctgggattacaggcttgagccactgcgcctggccgccacaggcccactcttaaaaagataatgcataatataagattttgtttttcttttcttttgtttctttctgctctgacaggtaactttgattgtcattgacagttttaagaattcagtaccaaccactgaaagggtatgaatatccttgcttaaagaaagttaaaaagaccaggtgtagtggctcacgcctgtaatctcagtactttgggaggctgaggcaggtggatcacttgaggtcaggagtttgagaccagccaggccaacatgatgaaaccccatctgtactaaaaatacaaaaaattagccgggcgtggtggtgggtgcctgtaattccagctacttgggaggctgaggtaggagaatctcttgaacatggga

SEQ ID NO: 17414 - DNA, 593 bp, Homo sapiens
acattcatcaatgctctggaccatagcatggtgaggaaagggtagagcagctcagtgccccaaggcccagagcctgccaggccaggataggagagcatcccatggctggaggagccctggggcagccactgccctctgcctcccatagctccagacacaaatcaacagggctggcgggcctcccagtgtatagcctagggcaggataggggagtcactggcagccaggctttctaagccagagggcccttggagatctttcactgttgtttcccatttacagtcagagaaactgaggcccagagagggaaagtaactttcccaaggaaacacagcaactgagtggcagggctgggattgctaactcccagtccagtgctctgttcaccacatcccagtgcttctcagaggtacataaatgatggtgctgttcagtacaggagaaactgggatctagagagtggtaagatctaggtggcccacaggcccaggggtcagcacccgggtactcaggaactgggccccaatcactgatccacatatttcatacataacaaacacttatctgacacatgacagcactgctctaagcac

SEQ ID NO: 17415 - DNA, 369 bp, Homo sapiens
atgtgtttttggtgaggaaggttgcaaggaatgcatgaagatatggattttgtttaaggaaaattaattttgtctagtgtagagtatgcttaaatattgtttcaaaatgaacaagtggagaaaaattgttataggcaaaacaaatgaatataaaaagttggaaaaataaaagacagtaaaagaaaatcttatatggttaaacgaactcaagctaaataaatgtattaaagggttctaatattgagccttaatatcaaaagtacattgaaacaaaactggaatttgggtttctctttctttaaaaaaaattgagcactcactctcctgtgatatttcttccttgcctgttagatcaattttgtatgcctt

SEQ ID NO: 17416 - DNA, 520 bp, Homo sapiens
agaccgtgtgaagtcttgaccctcaaagtgctgtgggattgctgagtaattggccaagttcttctttcatttgcggttatgcagcatggagtgcagaagggatatgtcttggtgccttaacaagggagtacggcttgtcagctagtctatttcctgatcacaagggctgaaagtgtctgccccatcccttaactcataggatttccactgcttaaggtggatttgggtttcaaatcgaagaaagtcttgtgcatgcaatgaaaaatgttgattgagcagccgaagagataaatgaaactcaatatcccagatacgcagtttctactgaaatggaacctttggaggttctattacaacctgacaataaataattagtcaaacaaatgcatttaaggagaatcagttgtagcaagatatttttctggaagacatttgctatctctctctctctctctctctctctcacacacacacacacacacacacacatgtgacaaaggattcatatccagaatatatt

SEQ ID NO: 17417 - DNA, 601 bp, Homo sapiens
gcatgccacatggtactataccgttgcttaacacgggctgaaatataggctttaagatttctagtgatccaaacaaagtgtgaaacaatatcccttacaagattttatgtctctggatttaaaacaaaccagcaagtggagcatgaatagatagaccattagaacggatacagagtccagaagtgaactgctcaataaatgactgtgtagccacctggacaaaaaaattaatttggatctatacctcaccctatatattaaatcgattccaaatggatcaacttttaattccataagacttaaagtctaaatgtccatcaatagagaattggtaaattatggtatggatatacctgcaataatatgttaagggggttgaaaaaacagcaaggagctctctatgtgttactataaacatgccccccggatacattaagtaaaaaacacaaggtggagtaaatatgtatggcatgccggcatttttctaaacaaggaacacaaagggcatatcttggctcatatatacataaacattttgaagaatgagcaggaaacagtggtcacctatttgtgacactaggacaggtgtgagggacatctt

SEQ ID NO: 17418 - DNA, 531 bp, Homo sapiens
gtgacacatgcctgtattcccagctacttgggcagctgagttgggaggattgtttgagcccaggagttcaaggctgcggtgagccaagatcacaccattgtactccagcttgggtgatatggtaagactctgtcttagaagaagaaaaaaaaggaggcaagttttaccccttactctttacgtctgtctacctgaaacgttccctcttgcaacaatgaatccacaagtgtatggtaaagatggttgagggtggccttccctgaggcattgtagtgccagactagcccgggagcaactgggtttggactcctgattcatgagaaaaataaaccccttattattttagccactattattagtatttctgcattacatacagccaaacatatttcctcattctttttttctccctccattcttctccatggatgctgtgtgtgcccgactgaaccctcaatcctttcatttaaggtttcctatagagtcaggcatggtggctcacacttgtaatcccagcagtttgggggactg

SEQ ID NO: 17419 - DNA, 417 bp, Homo sapiens
aaaaatccaggtatcaatcagagatgttgattgacacgtggtgaattcattactaggttactaggaagagaaagtgtgagagtgcagctaggacaagagtctgataggacaagattactggtaaaagtgatagttcctattctcacatacacacacacacacacacacacacacacgtacccacgtgcatacataggtgtacaggtttaatcaaaataaacttctttaagtgataattttgttgtttcaaagagctcatattggagataaaaatgatagctctaactttttttgttgatatatgcttatacttgccttattattagaatactgagtctcagcaaaagcaaaatcaaaaacaaaacaaagagaatattgattccatgttatctttggaagaatcctaagctactgtgt

SEQ ID NO: 17420 - DNA, 449 bp, Homo sapiens
tggccaggctggtctcgaacccctgacctcaggtgatccatctgcctcagcctcccaaagtgctgggattacagtcctgaggcactgtgcccggcccctccctcccacttttaatatcttgcaagtatttcccacaagcccaacccagctaactttcattttgccagggagtctgggggaaatacaattttcaatcttccaacacgtgtgatactgagaagagcacagaaaggtcagaatggtctctataccaacagacaatatctggcacactcaactaaatcttcctaaaaagaaaaagtgagatgctgaaaagcatgtaaggctaatttgagtaatataaaaactgctatgagaatgacatgagaattaggccattcttgcatcactataaagaatacctcagggctgggcacagtggctaacacctgtaatcctagcattttggg

SEQ ID NO: 17421 - DNA, 358 bp, Homo sapiens
agatggggtttcaccatgttgtccaggctggtctcgaactcctgacctcaggtgatcctcccgcctcagtctcccaaagtgctgggattacaagcatgagccactgcacctggcccttattttttttagttatgctttttaacatttatttataatgcatttgctatgtggaatgcatgttcaaagaaaaacagtatcccaaatggtggttatgacttcaggcaaacacatttaatctgtaaaatagttgaagcactgcaaatacataataaaaacaagtaaaaacaatattgttagttatctttccttttgagcaatggtgtggtgtcccacacctgtaattccagcactttgggag

SEQ ID NO: 17422 - DNA, 335 bp, Homo sapiens
cctgcctgactgatctgagggttaggaatgcttacaacaaagaagaaaccagaaatcaggaaaatgggaattgaaagccaatgttcacctccttacacagctcttaaggttggccctgccatcctaagctcaaggatctctacaggaagaatgagatatcatatgaaatgcacttcagaaattctattgagaagtattataattaaggagagttctctgagaggtagcatctttgaataggctcaaaacaggaaaataaactatttaatgcaagaattaagataacatagtggccaggcacggtggctcacacctgtaatcccagcactttggga

SEQ ID NO: 17423 - DNA, 139 bp, Homo sapiens
agagaaaccaaggcagaatgttagcaactcttgcgtaatagtgagatctgttagactgtggatgggtctccatggggagcttcttcacctgagttacttaaatccgaactggacagagaacatgccatgtgtacaatct

SEQ ID NO: 17424 - DNA, 436 bp, Homo sapiens
cgctttatttggtgaacagaaagtgagagctttcaggagactgtttttgttggatatgagagtcaaagatcaaaaatgcaaagatttcacaataagtggaaataaaacaggtgcaaaaagagtagctcattctgagaattttagtaatgaaagaaaatgtttcaaaacaaggacaagaaatcaaagctggtgaaaggacattagacttacgagcaagtctaagaaaaagaagctaattaatggaggcaatatcaagaaatggacaaaaatgaacagtacagctgctaagatgatcctttgaaagaaagatggctatttctcctttagagatggatttccaaccttaaaagattcagcatgctatgcttctttaggaactttttaatacagtgcatgtgctaagggtaaatattagcatcaaagtatttaataacat

SEQ ID NO: 17425 - DNA, 577 bp, Homo sapiens
tttgctacctctaggcaagataacatcatgaaaaatccgctggtgtagactgcagggcttgacttccagtgggcatgtgacatgtgagctgccaccctctttggcttccttttgcttccttttgcaattcatcggagttatccccttgagcccacagtacttctaaccctggatgcctgagttttacttcctcttttatcctgtgaccttgatcatgatcacttaacagtattctggattccaaagatggatttagagtataattctctaagtcctctgagggagtcccctcttaaactttctgggaccttgacgttaggctagagatttattcatttctttctttctttcattagttcaattatttataactggtgagttttatatgctcaggagctgttttttaaggacattttatctttaaattttgtgtaactgctggggaaaatgacatgtgctaacaataaccttttttattgcaggttagcatcttgcaaggaggtagtaacatatccagtcgtgaaactgggaaagaccagagctcttgcatcagggaaacatgtcccgtcggaaacag

SEQ ID NO: 17426 - DNA, 534 bp, Homo sapiens
acttattagtcatttattttccaaaaacggtgttataaatctgctagatatgcttgaggaatatatttatgtaacttgaaatgttgtcatatcttgaactcagttgatgaaaaataaattacctacaggagaaaatttgggttgttattttatactatatcccaagaactttttgcatcacttgtgaatcaggatatgtttttccacttgatttataagatgtattaatatcatataagatttatgttattaatatatcatatcatatactgatatccaagaaggatagggtaaattgtaagtttacactgttttttttccctcatttgatccattctcagaaactgattaaaatgactaaaaagaacaaattagagaagaaaagttcatcaatgctaaaaatatgaacaacagattaatatcttaaattttgagaactatctggtagagagtatttcaatctaaagtgtaataagatggtggaatctgacattcaactatccttcttcagaacagtacaatgacacaggaact

SEQ ID NO: 17427 - DNA, 520 bp, Homo sapiens
acctctggggctgctgtcccagtgcccactgctttttatttgcctccgaaggctggtgctggcaggggcaggagtaggctttgcactccattttttcccaataaagagtccctcgagtcctctttcagctcaactgagagtgggtcgatggagccacttcctaaagaatcctgaggggcacggagcaggggacacagcacctgccaaatatgagagaaggcggtggggcctgcccttgtggctcattcctagaggccccaccccagtcggcccaggaacgcaccctctacccggtgactctgaccctccatccctccttcactgtttcctgcataccacgctatttaaaaagaaggggcctacgctgtggcacacgtctgtggtcccagctacttgggaggctgaagcgggaggattgcctgggcccaggagtcgggggctgtagtcagccttaattgcccactgcactccagcctgggaaaaaaaaaaaaaaaaaaaaaaaaaaaaaggggcccttttt

SEQ ID NO: 17428 - DNA, 453 bp, Homo sapiens
ttcccatagagtctccagagagcaacacagcccagctgacaccttcattgtagatgtgagatttctaatctatttactgaacataataaacacgtgttggtttaagtcattgtatttgtgttaatttgttatggtggcatgagaaagcaaatctcttgttgagatgtatacattaaatatgtatagcttttatatgtcaaccatatctccataaagtggcttaaaaagaccaaaacagaaatacggcctgttaatcagaatgatctagaatgatcctgaggaaaaggacagaaaacaaaatatggtacaatgtgacacaattcctatctattcataaccttactgaatccaggcagtttaaaccgtttataaaacaaccagtgactgaagatctaccgctgttggagtgaggtttcctggaagtcttctacagctgttagccacacttctttt

SEQ ID NO: 17429 - DNA, 478 bp, Homo sapiens
agggatttcaaagaaaggtcattgacagaatgtctctattttttaagccctcttcctgaacaaattttctaaatcccaaactggagaacagcttcagaagggcaaagatctttacttactcctacttgccctacagtgcctcactcaaagcaaaacacttgtcaggtactcaataaatatctgttgaataagctgccatgaactcacctttgggaataggtcatgattacagggtttttagattgagaatactctgaaatcaacgctaccagctctggaattccttcttccttggttctctccccttcattcttcccaaaattccaaccagtgtcctcaacctaatttatgccaaatacccgaagtgttggacttcaagaccccaaatatctcttttgaagaatgtcccagaagaacgtataggaggaaagaatggataagaattgacctgtctggtaaatcacttatgtacttataa

SEQ ID NO: 17430 - DNA, 520 bp, Homo sapiens
aactgtgctggactcacctgaaagcatggcatcttcaacctaaagtacagcggaaatttgtctcaatgagataaatattctgctactgtatataatagacagctagtaagtataacttttttttctttgagacggagtcttgctctgtcacccaggctggaatgcagtggcataataatctcagcttactgcaacctctgccctcttggttcaacctattctcctgcctcagcctcccgagtagctgagactacagttgggtaccacctggccaggctgatttttgtatttttagtagagatagggtttcatcatgttgtccagtctggtcttgaactcctgacctcaagcaatccgcccaccttagcctcccaaagtgctggaaatacagaagtgagccaccgcgcctggcctaataagtatagatagtatttcacttttatattcctagagcccagcaaaatgcttggtaatttgtaggtgaagaaaaatgtttaacttaatagaaatctaaaatttt

SEQ ID NO: 17431 - DNA, 644 bp, Homo sapiens
tccctggtgcctggacacactgcgtatcttgtgtgcttggggaaggagctggcctgcaaaagtgtatatttcagattacagaagtctcctttgttagacttgcacatactttctggatctcctttgaaaagatggattgcttcctccctgcttcctaaaacagcagccaggacaccattttacctagggtatctcatccctgggcctcagttttcccatctgtaaaatgaagccgttactccacgtggtgcctccatagctctaaattctctcgatctttaggagaacctattttcttgtagggctataatatagtgacaccttccagcatgaaacggtgccaattagctcttatcctaaactattcctgttggctcctccttctcagtgctgctccttttagtgatacccattgtctgtggacttaaaattactaactagccctgggatcaggaaaaaacatcctaggcatctttatttttaaacttgattttaggtcacagggaaggacatgaaggtggtactacctcttctctttttttgagacagagcgagactctgtcactaaataaataaataaataaataaataaataaataaataaataagttccacatgtattgactactttctagtagcattgc

SEQ ID NO: 17432 - DNA, 578 bp, Homo sapiens
ttaacacagtgaaaccccgtgtctactaaaaatacaaaaaattagccaggtgtggtggtgggcgcctgtagtcccagctacttgggaggctgaggcaggagaatggcgtgaacctgggaggcggagcttgcagtgagccgagattgcgccactgcactccagcctgggtgacagagcaagagtccgtctcaaaacaaaacaaaacaaaaaagaaaaaagaaaccaccaccaaccaaccaaacaaaacccaaaaaacccaaagtaacggaggtggccgagggagctggggatggggagggagtccaaacacctgggagctagaagtttctgaaaactgtaagtcttttggtgtcactaaaagatacaggatgaatgagcggggattaactgaagaagatagggttgatttataaagtttgaattcgaggccaggcacagtggctcatgcctgtaatcccagcactttagaaggccgaggtgggcgaatcatctgaatcacctgagatcaggagttcgagactacacctggccaacatggtgaaaccctatctctacaaaaaaaaaaaaaaaaaaaaaaa

SEQ ID NO: 17433 - DNA, 534 bp, Homo sapiens
cctactcttataagtctggcattcatcaaaaagtgtgttttgtcaagaatctgagtgcttctcagagcacctaattcatcctgtgtcagctataaaagccccttattttttagaggataaaaaaaatgtcaataagaattcatagtcacagttatccaggcaaaaaaatacacatgaatgttgggaggttgtcatccactggacaacttttccaacagaaactttagaaccccaagtttccatttatctctattggaatctgtttctccctgctggctgcatgcctgcttcatttcttcctttaatcagggccaacttattcattaggcacaggagacaaagtgcttagagcccctggcacttttaaggaaccataaattttttttaatggaccacaatgttttagtttattttaaaatcagaaggaaaaaaatgagttgttaggggttgaagaaaagtttatttttaatacagcttggattatatttgcccttatatcaatgtagttgcaaaatataactttgtatatatttt

SEQ ID NO: 17434 - DNA, 525 bp, Homo sapiens
ctcatgtaaggaatgaaccaatcttaaaagaagaaaacataattctacaaaacttttcaaaatctagactttaaaactcttttatgtcatcgtggtgctatcactattctaatagtttccttgagctaaaaatctggacagaattcatattttcttggaagaatcattttacttgtaattcaactgtctacctacaaatttagatttgccctgttgctcttcttcctttaattaacaaaattgagtagctttttatgttggagatatgttgcataccaatggggaaaaaataaaataattatatctccggccgggcctggtggctcctgcctgtagtggatcatgaggtcaggagaccatcctggctaacacggtgaaaccttgtctctactaaaaatacaaaaaattagccaggcatggtggcgggtgcctgtagtcccagctactctggaggctgaggcaggagaatggcgtgaaccctggaggtagagcttgcagtgagcagagaccgtgccactgcacact

SEQ ID NO: 17435 - DNA, 515 bp, Homo sapiens
tgctgcattagcacccaaccgccagctagacccagtagagtaaagtgagggataaaacggaaggtgtgcaagaagcatcggggtcgtaggttgtctaatcttttgctttcaggaaaaaaaaaggcatcagaaatagctgaatttccacagggaaaacaatggagctggaccctaccccacacgatatacaaaaaccaacctgcacggatcagagccccaaacatgaaaccagaaccgaaaagcttccagaagaaaatgtgtcagaatgtctttgctaccttcagataggcagagatttcctggaggaatgcaaaaagcactaatcccagaagaaaagaaaatgacaaatttggcttcatcaaaataaaatatgaatgttcataaaaagacactcccagatcgcctgaggtcaggagttcaagaccagcctggtcaacatggtgaaaccccatctctactaaaaatacaagaattagctgggcatggtggcagtcgcctgtaatcccagctactcg

SEQ ID NO: 17436 - DNA, 527 bp, Homo sapiens
tttcttctatcaaggaattgccttagcctaaaggcaaagcaattagctgtatgccaaagcccgggcaatccaggccacatctcccatatctagcctcatgtcccactttctttctgacttctaattctctttccatttcatcaggactgggatccctgttctaaagaaggtaagatataagttaaggcaaacacatctacggagatctggccatatatggtacaaagtggctaattgggacttgtgtctccaattccaacatacctctaaatctctagaaagagagagaaaagaggccgagcgtggtggctcacacctgtaatcccagcactttgggaggccaaggcgggcagatcacgaggtcaggagatcgaggccatcctggctaacacggtgaaaccccgtctctactaaaaatacaaaaaattagccaggcgaggtggcggccacctgtagtcccagctactcaggaggctgaggcaggagaatggcgtgaacctgggaggtggagcttgcagtgagccgag

SEQ ID NO: 17437 - DNA, 541 bp, Homo sapiens
gagacatgatgaagtgctctgagggctgaggaaggtgtggcccgtgggcattcctgtccagcaagaacccctctggcttgtctgtattcattgccacccacatggacctctctatggttgcttgccaaagccgggagggagaagggtctccccttcctccaagcccaggatcaccgggaaatgcccttcccacctactggacttgactaatgctgcttgtcaagaagggaactcttcagacacataaaaatcctaaaggtagctgaggtttgaaagaattcgtgctggacgtgcttccctgcagggtcaggcattggggaggagggagaagaggaaggaggagctggttgtaagtgacagctgcagataaatctgtgtggagctgtccagggagctgttgaactcaggtagtgccctccctagcctggggcaggtcagagtctccccgaaccacccaaacctttctgctgcgtgtgctctggggcatgtctctctttgcctccttggatcttgagccaatgaggaaatataggctagtccc

SEQ ID NO: 17438 - DNA, 395 bp, Homo sapiens
agagacggggtttcactgtgttagccgggatggtctcgatctcctgacctcgtgatccgcctgcctcggcctcccaaagtgctgggattacaggcgtgagccaccgagcctggtcagagacaggaatgttataaagacgtggatgacagtgacctcccgtttcccgggtatgtcgcatgggccagacggttgcttcacgcacatcctacccttcctcctcctgtagctcccaaagaacattattcacatcacccccattgtggagatgaagaaactgaggcttagagaagttaagtgatgtgccccaggttacacagcacacagagctagacacgggcagggctgggatctgaacccaggtctctccaatgcctgaatctgacctcttaatccta

SEQ ID NO: 17439 - DNA, 81 bp, Homo sapiens
accttttctatcagtcgagcaagtaccatctgtcacctattatcaggggtagaagtctgagtacttccactcactgcatat

SEQ ID NO: 17440 - DNA, 433 bp, Homo sapiens
ctactcgggaggctgaggagaatcacttgaacccgggaggcggaggttgcagtgagctgagattgtgccactgcactctaacctgggtaacagagcaagactccgtctcaaaaaaacaaacaaacaaaaacaaaaataaatatacttgcaattcatggtggtttagaacgtttgcatcttatacttcattcttgtgatttatttagttgttttaaaaacaaactttgtgcttggtttctaaatgaagagataagagagaagatatcacctcctcaaacaacccatttcagctatgaatagctgctatttccaaaagatgaaaagctaaaatgactacattttctcttaaaatgttcatttttgaagttctagattttttttttggtcgggtgcggtggctcattcctgtaatcccagcactttgggaggctga

SEQ ID NO: 17441 - DNA, 575 bp, Homo sapiens
actcttataaatactgtatatcttttcaaacttgtgtgaatttttgagggtaaaagaccaattcattggcatactgcttattttataattcgggtaacacagtgttatcaacatttacatattctgctatttaattccccaaatattcactcagcagtgaaagcgcagcgttagatgttatggggatttcaaggtggggcaatgcatcctccttacctacaagaggtcactctctgatagggggattaggcatgcacattgactatagtatctttagttttatttatattcccctttgtttcaaacaggatttgggattttttacaaagatgcatatgatatgacaagataaagtatatttagtataaagaaggaaaagaagatggaagtataagtgaggctggttagtgtatttcgaagtcctgttctttccttactaaaagttctggctataagctttccagcagcaaagagaagaggcaaatgatctataacaagcttcagggtgtccagaagagaaaccaaatcagagaagcacacctattcctgattccagaaggcgagaaaaattttct

SEQ ID NO: 17442 - DNA, 409 bp, Homo sapiens
gagtttgaggctgcagtgagctatgtttgcaccactgcactccagcctgggcaacagagaaagaccctgcctcaaacaaacaaacaacaaaaacaaaacaaaacaaaaaaactatctcatgggaggttctggtgagacgagtaagatcatggtggaaaatgccttcggcccactcaggaaatattcttcggcctactgaggtgcagagactcaaagagagagccctgtatggagatactcaggcctgtggcaagctgagacctggagctgtccctcactaaactggagaaacggctgcttcccagtgcccagcagtaattcagccaaaagactttcagatgtacaaatttttacacttctaaaaaattaattttctcccaatattttatgttaactttctttttttttt

SEQ ID NO: 17443 - DNA, 609 bp, Homo sapiens
gacaagcttccctgatagacaacacttcacacaagtttccataccttgttattcagaaaattaagtgcatcctatgtgactccacaaggagaatattctggggagtttgtatctgatttcccttgttcattttgctttctaccttttcagtctaccacatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagaacagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataataatatacatgtccaacaaaatttaacttgttctgctatcatgaaaagaggaattccagacaaatgtctcataat

SEQ ID NO: 17444 - DNA, 436 bp, Homo sapiens
aaagatgtagatgcagacatgaaaatgcatgcaaatacatacacatgtagataaatatagataaagctatcaaaggcatcttcctttcaatcttcttttgagtataattcggaatttatcctgagaaatactgataaaatatagggctaggcaaatataatttgggatgctgtagagtgttattagtagaaacgacttctcttttctgagccttgtgaaatagctttcaaggggcagctggtagtgatttaagggcagtcacagagacagccaattagagttaatcagtcattatatttacagcatcagactatcatgcaatacaaaacggatgccgacttgaccttttcatcccctatatttccttccccatctcaaacagcagccaatcttatgcaattggcttcattatgaataatgggaagcatcttacatt

SEQ ID NO: 17445 - DNA, 550 bp, Homo sapiens
tgtgaccttgggcaagtcacttcacctctttgcacctgttcctcatctttcaattggggataatcctattccccatgcagacggctgctttgaggactccatgaagccctgaggactttgtcggtgctaagatactctcctgaccccaggaccaatccctgtcaccatcttgatgaagaggcagcgccacctgcccactcaccttcagaagcaccgtgcttctcgcggccgggggacctggcctcgctgaagagagcagtgggacttgcctccatgtctaggacagaggagccagtgaggctggacctctcccctcccttcctcgcctcccatcccctcaggagagcaatggtctaattcacggtgtctgcaggtgggttggggaacaaggctagggtttccacccctgctcggatgggccttcatctttcacagatataaccgttgccccaccataaggttagacaggcctgggttcaaatcctgacccccgccaccactaccaccaccactgaccagctgtggggacttggcaaaattactttataca

SEQ ID NO: 17446 - DNA, 429 bp, Homo sapiens
aggataactaaagattcataattggtatgatccaagtgagtgactgagatatcaactataacatttaactgaattttaaactgataaataaaatatctctgacatctcttctgcaatattttctccatctacctttagtcatatattctactgttttttcttaagcccttatatagttccatggctactaacctgcaaacatcatttaaattcttttaatctgtgacacatcaatttttctgtagagttaaggagatagaccaaatctcagaaaaatgtcctaaaaatatagcgtcttgggaaatagaaaaaatagggtctaatggagataatcctatgggtaataaaaataagtcaaatcaattattcttttccacaattcagtacattcaaatcattcacgcttcattcagcatgcatgtatagaat

SEQ ID NO: 17447 - DNA, 506 bp, Homo sapiens
taagttaatagaaaaaaactgttatggtcaagtttatgtagaaaaagctttgaagatatttcatgataaaaagtgccacatatttttccaaacaaaaaaaagcttcaggatataaacattttcatgaattcaagcttttcccctcttcttctttatgctttcaaaatactatttataaacactagaatgtaatcttgatgccataaaaacacctagtttaagcaattccacttacaaattacgagaagtaaagacacttgcacagatactcttttttaaagtgaatttcaagccaaacaattttcaattataaaagctccttcagtaaccattctaggctctctacaatcaaaggcttcacaatagtcattgcttccagatacataatagtgaatggacagttacactagacttgcctttaattcactaatatgataataaaaggataactgaataaaggcctttacacaggtaaacaggtatagatcattgtgaaaaaaaagtag

SEQ ID NO: 17448 - DNA, 457 bp, Homo sapiens
tataaaaagtctcacagaagaatgtaccccttcagcaagaagtaaaatgaacctaactgaatacaactcaggactctcaaccaagtgggaggtcagagactcaggagagagtcacctcagtcacctgtaaccatggaggagccgtgggggctcaagtggcctgtgctggtaccggggtgctgggtccccgcagtgttccagacgtccctgagcagtccactctgagtcctatctgggtcactgtgattttcatctaaggaaaaaattaaacttttgatcacgaggtcaggagatcgagaccatcctggctaacacagtgaaaccccgtctctactaaaaatacaaaaaattagccgggagaggtggcaggcacctgtactcccagctattcgggaggctgaggcaggagaattgtgtgaacgcgggaggcggaccttgcagtgagccgagatcgcgc

SEQ ID NO: 17449 - DNA, 408 bp, Homo sapiens
gctttgctgtatactcactgctggctacatgtctgtcactttaatttgcactggactacaaaaacatccacaaatatataatatatacctacaaattatatggtatctatatcacatgtatgacccatgaaagacagatgcatattctatgagagactaaatcattcttcataattggtagcttggcattcatttcttgagaatatcagagctgcttaaacatgaatcacatgtgacatcatgcgcacctctcacctcaccttctagataccacgcaccgcccattttcctctaggctttattatagactacctgcaaccagaaaagagctttatagagcatctcatcttactgtaaactgaggacaaataatcaatattataataatttctagaaaaggaataaatg

SEQ ID NO: 17450 - DNA, 107 bp, Homo sapiens
atagataaaaccaaattttcatggacaatgtttacaacaaaactacatgacaaggttgctctataggctccaaaagaagttggtagagataaaccaccatcaacaca

SEQ ID NO: 17451 - DNA, 497 bp, Homo sapiens
tgctgaatctaggactctggcagtagggaatttgctttcccatggaagcacctgggttaagaaacgttttctccagtgtccaaacacttggcccttctatgtctttcactcattttcctatgtctctagttaatggcacgtagtaactaaacatttaataagttaattaaacaattaataagttactgagttgattttactcagtgactcagtgctgcatgaataatgactgacacctcatgtctgaaatgcttttctgactatctatcctccaatatcaaaagtaacctattccatttacattttaatttaacaaacatttctctcctgaatacctaccctattttagtcactatgctagatattgagtgggataatcaatgacaataatacaacatgtttattgagaatttacttagtgtcaggtaccatgctaagcactgaacatgtatgatcccatttacccttcataataaccatgtaagacaggaattact

SEQ ID NO: 17452 - DNA, 391 bp, Homo sapiens
cagttttgctgagggcattacaaggtgcgaagaactgtcagctgaaaaaagatctattggttctctggctttctagcatctgggaaagaaccgagaggccagttgaaacctcatacgatccaaaattatgttggattattcatggttagctcattccccctccttttttgaatggagaactcctacaggggcctttccccactctctctctacattcagcctaatgggtcatctaaaactctcttagggcacttcctcaagaattacacaaagaaatattatgcatgtaaaaatgctagaagggaaccatacaaatatctgcattcattttgtaacttaaatatccagagaaagcctctttatagatttgagtcttcaggtaaggctgatt

SEQ ID NO: 17453 - DNA, 531 bp, Homo sapiens
atagctcatatttttgtgaccacctattgaccatctgttgactattttctatgacaacaaccaaattttttttttaagtcttaaatgtttaacttattttaaaatgcaacaaaatgaaacaaagaaacaaccctctaggaaagtgagcccaggagaagggagaagatgtgtattgtgctctaggcttagcttattcaaccatttagaacaatactaaagatttcaggccaggcacggtggctcacgcttgtgaccctggccctttgggaggccaaggtgggcggatcacttgaggtcaggagttcaagaccagcctggccaaaatggtgaaacccctgtctctactaaaattacgaaaataagcctggcgtggtggcacgtacctgtagtcccagctactcgggaggctgaggcaggagaattgcttgaacctgggagacggagggtgaagtgagctgagatctcaccattgcactccagcctggcaacagagcgagactctgtccaaaaaaaaaaaaaaaaaaaaaaaaa

SEQ ID NO: 17454 - DNA, 573 bp, Homo sapiens
tactaggcatgagatttgaaatatcccatgtagatattggtagctggaatttcaaatctgtaaaaatagaaatggcaacaaaacaatgaatctggaagactactgtgttgtcattaattcctttaaaaaactgcaggctaacaattttttagtgaaaagtttggggtgtaaatattaggagctttctataaatcacctaatatttaccaaaaaaataaaacctatgagataggtgctactactgatctgtttcttagtaaggatacttaaagaggttaaaactggccaggcatggtggctcacacctgtaatctcagcactttgggaggttgaggtgggtggataatgaggtcaggagttcaagaccaccctggccaagatggtgaaaccccatctctactaaaaatacaaaaattagccaggcatggtggcgggcacctgtaatcccagctactcgggaggctgagacagagaattgcttgaatctgggaggtggagattgcagtgagctgaaatcacgcaactgtactccagcctgggtgacagagtgagactctgtctcaagaaagaaaa

SEQ ID NO: 17455 - DNA, 84 bp, Homo sapiens
agtcttggccaaacaacagatggaacaactacgctatacgtataaaagccggcacaggcaaaggacagataagacaaatattag

SEQ ID NO: 17456 - DNA, 538 bp, Homo sapiens
tcgtggcagagacgcctagaggctggcgcccagggcaggcaggacccaggtgcctcccattcttgtgcttggctgcccttggtgacagctccaggcagtggctcttgaggaaagaggggtgggaaaaggggaaccctcctgcccaaatcaggctctttaaggaggcttctggaagtctccactacttccagtggtgtagccatgaccagctgtccatgtctcagcctgtttgcctcccaaataaaacaggggccttggctgggcacggtggctcatgcctgtaatcccagcactttgggaggttgagacaggtagatcatttgaggtcaggagttcgagaccagcctggcccacatggtgaaaccctgtctctactaaaaatacaaaaattagccaggccataatggtgtgcacctgtaatctcagctacttgggaggctgaggcaggagaatctcttgagcctgggaggcagaggttgcggtgagccgagatcatgccactgcactccagtctgggcgagagagtgagaccctgtct

SEQ ID NO: 17457 - DNA, 491 bp, Homo sapiens
aaactggtacaccccttctggagggcaacctgacaattataccaaacatatgtatatccttcgagccagcaatttcatttggagatattcactcaaaaaagataaatataacgctgcatatcagcattatgtagcataaacctggctgtatatcataagtacctaaataatctcactcatcactattaataagctaaaggttttactttgaacaaactgatagagggaattgtttagccttcagaaatttttaattaaatcatatggaaatgaaagtttgagaataaaaggaaagcagcgtaatagctaaatggagcaaaaggatcattaaaaatttttctcaaaggtagaggaaatcaaatttgataaagggaataaaaatagagtcagtgaaaaggaaaatactcaaaatgataggaagaaggaggatgcaatatcctagagcagtggttacttacataggtgagttattagggaggcttttttttttt

SEQ ID NO: 17458 - DNA, 616 bp, Homo sapiens
ggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaatcc

SEQ ID NO: 17459 - DNA, 506 bp, Homo sapiens
cgcttagagaattagcaaggaaataagatgggtagttagagaatgtaaatggcctggaagagagtagtgagtgaaccaagtcaaatgtagttgggagtggaggaagacacttggaggctgaaggaataacatgtgcaaatacttcagagcaataaggaattatagtcacaaaactgaaagaagtacattataggtagaatttagaggtctaaggagagaatagggaaaggagataaaaagtagaaaaagatgaaactcggctgtgatgggtttttccttaatttttcttttttaacaagtgacatcagatttacaattctaccagcatcacttggtgattgattggatgatggagtggtggtttgggtggagtcaaaagagatgaaagaaccaaagaggatgcaaaactaatgcctaggtttctgatttggtcaatggcatgaatgataataccattcactaagagaccacaagagtggttttggatgggaaagatggtggatttc

SEQ ID NO: 17460 - DNA, 497 bp, Homo sapiens
atttatactcaagaaggatcttagaaaatatctagccagagttttattttataaatgtcgaattctaggcccagagaggtaatgtaacttatccccaggtaaacagtttacctacttagctggtaaagcgtccaggaccactgattctcagtccagcccagtaaagtatgtatttcccaaagaattataaggaaaagagaaaagttttcataatccaatgctggatttaacaaacttaatttagtttaatttctataagacttctcagaaactttattatatgcattgggaatttgctaagaaatgggtttgctattcagagtcttctcaattcataaggtgacataatcctttacttagggagcatttctcagcactggccttctctagacactttggaaaagctggtagggtggaaagtgcataggcttgggaatcagatagcttcggatttcagctaagtctctaccaggtagtagctgggaagactttggcat

SEQ ID NO: 17461 - DNA, 605 bp, Homo sapiens
tcttttaaaatcttattggtcccatgactctcaatgaaaacaacttcatataacaaaatcaaactgtaatatatttcctcagttgaccgaaatgatttagtaatagatgatttggctattgtaatagtgtatatcctggaagtttctcagaataccttcttagtttcaacttttgttgacagatctttctgaaaagatccatgtacagtgttttaaaatctcctcaggatagacattctgagtaaggattcttatgtggtgtagataaattgtatcttctacatatacaaagtggctgggctcagaaattccttttctttgtttttgagacagggtcttgctctatcgcataggctggagtgcagttgggtaatcactgctcgctgcagcctctaccctcctggcacaatccatctgcccaccttagcctccagagtagctgggactagaggtgcctgcctccatgcccagctgatttttaaaaattttttgcagaaataaggttttaccatgttgcccaggctggtcttgatctcctgggcttaaacaatctgcccaccttggccccacaaggtgctgggattacaggtgtgagccaccgtgcc

SEQ ID NO: 17462 - DNA, 548 bp, Homo sapiens
agacgtcgaggggtgggcagtggatccgaccagagctgaactttagaaaagatctgttgcttggataaggaacagattcggttgctcaacccaacctgcccctatcgccaatgacccagctcaacgttctctctggtttagaggaaaacaacaggacgttaggaagtaaccagatcagatggtcagaggtggatctagggggagccgggacactctctaacgctcctccagcaggagatgtcctgggcggtgcctagaggaatgtgatggcttcacgcatgtggaagagcctagcgagtgaggctccctgcagctatggatgtccactgcagcctcatgtcctggcctcgccctcccagtatgagcttggaattttcttaaacaagaaatttccagtgttggccaggcgcagtcccagcacctttggaggctgaggcgggtgggtcacctgaggtcaggagttcgagaccagcctggctaacatggtgaaattctgtctgtactaaaaaatacaaaaattagctgggcctggtggcgtgtgcctgtag

SEQ ID NO: 17463 - DNA, 384 bp, Homo sapiens
gctggagagacgacagagggactgcaaatataatccaatataatggtcgaattgaagagaattacttttcaggggcttattaagtatttttagctatttctttaataagatatgtatgaaaacctgaaagctctataacaatttgttaacttctaattggaggtggagtaaatcaaacttcctgttgaacactgataagaaaaataatcactaatttggctactgatgaataaaaatatgtaggcaccacagcatagaaatgactgtgtccttattaaataagaaagcgaataaaaatccacctatctaagaatgttagtaattgctaagggcttttgcaaacagagatttccatactatacttgccctcccttattccacata

SEQ ID NO: 17464 - DNA, 508 bp, Homo sapiens
acgacagagggcttgtccccaaaacataatttccctgctgtatttatctcaatggaatttagaagtagcgtggattatgtcaccctgagagttatttcttgtgtccactaaaagagaaaatgcacagaagaacgtgtctatcttaccgagaccactcatacagtgttggcaagaggacagtccccagagtctcaccatataatgaagctaatcactctatgaattatcttaattgaatttgaatgtattgctactgagtactatgggaagagcggccagtaaggacgcggtattttcccacagcattcagttagcaatgcattcaaatttaattaagatcattcatacagtgattagcttcactggggatgtccgtgctacagttgcctgcttttggtctgcctaagataggcatatctactttcacaggttgtctcttgtattgagtacaggattgtttgatccatccttaagtattatcctgagatgtgcttttcattttggaatc

SEQ ID NO: 17465 - DNA, 571 bp, Homo sapiens
gtatccatgtaataggatgttttctgtcaccttgaatggtttttgccctaatactttttcttaaattaatagagtccaacctttaattttacttattttctttttacatattttcccattcttatgccttaaaacatctttgccaatttgttttagatatgttttagggagtagcaaataatttgtattttttattattaatcatttcaatgcatcctaattttctttccattttaatagaagtaaaatactgatataagttgttatcattgatatgattcatattatttatttgttttttcatcattttattttgcttacctgctgtgttttacatttcttgtaatatgattgttttgtttgagttttttggggggttattggtttcctatttgttttccgtataaataagtgatttatacactagctacatagaaataggacattctcttttagtttcataagctttgtttattattatttatcctagttactttcccatacatttactgttgacttttccatgccctgagatacattgtaaagaattatagtgtatatatttaaccta

SEQ ID NO: 17466 - DNA, 470 bp, Homo sapiens
  misc_feature 254: n = A,T,C or G
cctgaatgcatttctactacctgttgactaacaagtccttaaccagcaaaagaatcttattcactgtgtatctccctattctgagctacaattctaaaactgtcccgaatagatgtctttattttcctctggtcaatttcatatttgaacttaaggctaaatgtctatacgtgtgtgagtgtgtgtctgttggtatgcaacaatgaaatgtgtatgactatttaccaatatcgaggtcctattccaggtatcanggatgatcagactttactctttaagttagctttcgctgcaagacttgctctggccaataaaactgagcaaaaatgatgtgtgtctcatttttgctatagtgttgaagaatccatgtgtgggcctccatggttttccccactgttactgaattctatgacattctaaatggaagaggcttcatcagcttgggtctcagagtagaaatgacatgaatc

SEQ ID NO: 17467 - DNA, 449 bp, Homo sapiens
gtataaagcgtcttttctgactgtaatgaaataaaactagaaatcaataagaagaagaactttggaaactatacaaacacatgaaaattaaataatatgctcctgaacaatcactgatcaatgaaaaaactgaaaagaaaattttaaaatttcttgaaataaatgaaaatagaaacacaatataccaaacatatgagacacagcaaaagcagtattaagagagctcacagcaataaatacctacatcaaaaaagtagaacaacttcaaataaacaacaatgcctctgaaaacactagaaaagcaagagcaaacaaaacctaaaattggtagaagtaaggaaagaaattctctcacatcagcggccctcctagggaaccctcaaaataaactaatatctggcccttaaagataacaacaagctttgtgccagaactcttgatgatggcag

SEQ ID NO: 17468 - DNA, 538 bp, Homo sapiens
cagaagtttaatttttataatgatggatgaagacagtaatatctaccttgagtggcttgtcataagtattaaataataaaaactagcattaaaaatatctagcatacctagatatatgttatatgttatagttatatgtttaaaaatttgtgtttatttcatgccttatttatctttaagaaactttatagcctgatcggtgctgattctttttccaaaaagtcacgtaaaattttatcaggacaatgttttctgtaacaaccattatttcttgtctttctgccataagtggagaaaaaagatgtgaaggatcttgagttttcatactttctaaatgggctaagagtacagatgtcagaagctatgccatgctacactatgaaacatgtttgttgaaaaagtttccacttcaacatgattttggaatgaggtgcagacttttccatacaatatctatgaataaaaatattcatttggtatttgattactaattaatcagatattaattgcattctctattataaaagccatattgtgc

SEQ ID NO: 17469 - DNA, 544 bp, Homo sapiens
acgacagaggggtctcactgaaacctccgcctcccaggttcaagaaattctcctacctcagcctgccgagtagctgagattacaggtgcccaccaccatgcccagctaatttttgtagttttagtagaaatggggttttaccatgttggtaggctggtcgctattcaaacatttttttaaagacagcatcttgaaaataaaaaaggtctcacctcccagagtaagtgagatatactttaattggtattcagaacctaccaaagaaaaaatcatgaacacattctctccaagacactgtttaaattggtaaaggaaaacaaagatttaaaattaaaatcttcagaagaaagtccaccttcaacatccttcttatggccctctttggcagtactcctgtttgcagactcaaaaatttctcccctctctcctctacagctacctaagcagctgaacctaaacttgttctacaaacccctaaattgacaatcccccacagtggcctttcctactcctgctctaattctcgcatatccttttaaatact

SEQ ID NO: 17470 - DNA, 394 bp, Homo sapiens
accacataaaacagcagtcttcaaaaaacggaaactgcaggataggtaggaataaaaaaacacattcataaaggttaacattgccactctgaatccaagacaggttaagaggccaaaatgaaattatctagaagccttcagtttctcatggatatgataccaagcattgcgcttcaataacagagaaaacacctttccaacctcccttgaaacgtttatggaaacttgccacatattaagacacaaaggaaacttcagtaattcccaaagcagagagaatctaaacatattctctaatcacagtacagtaaaactagaaattaaagactcaaaaattaatttgttcaaaatggtaacaccttgtatcagaatccatgatgcaattaaagcaatg

SEQ ID NO: 17471 - DNA, 341 bp, Homo sapiens
ctctcccttcttggtgcttttaattctgacttaatgtctataggtacagaagtatcttgtttctataacctacatgctgcaggtggcagagtggaaagagaaaaaaggataccaagaacagcgggatccactgcatccacctagacttgtgatgtgaggaaaatacccgctttttgtttaaactactattagctgcttgtatctgaaagcatttctaaacgacatagcaatgaaagagtagatgatctcaaatgtacagcttgggtctaatattaaagttctaattttaaataatctcattgtccagagaaggatatctttccacagcatctttgacacat

SEQ ID NO: 17472 - DNA, 336 bp, Homo sapiens
agacagcccagatatctattaccgtaagtctgcaaatatattgtacctagagttaaaatgcaatctcatgctctataagctttattgcatataaggaaaatgcctaagaaaaggccagtacctgaagaaagagctatgggaagggtcagctaaccagaaggcacctttttttctgacacagtgagaccatctaagaactgcaatgaatcagggaaatgaggctctaaggtaaaaccaggaaggccaggcagtctgcaaataaggggaagggaactatcagcatgaagctgtgattcagacaccagacaaacagtcagaaagtagagaatacagggc

SEQ ID NO: 17473 - DNA, 545 bp, Homo sapiens
acaccacaaacgctgggccaaaaaacaccaaagaaagatcacttgaggtcaggagtcacagaccagcctggccaacatggcaaaaccctgtctctactaaaaatacaaaaattagctgggcgtgatggtgggcgcctgtaatcccagctacttgggaggctgaggcaggagaatcgcttgaaccaggaggcggaggtttcagtgagccaagattgtgccactgcactccagccttggtgacaagagtgagactctgtctcaaaaacaaaaacaaaaaaacgctgaagagcatcaagagcgagggaagagcctgacctgggggctgagtagcaccaagtcaacgctgttggccgacagcccttgccccgctagcaggtttggcctcaagcttcccagcctacccagagtgaggaatccaggagacccccacagggccacatcttagaagtcagggccagaagcaagcctgtcccaaccaacttgccccgaagactgcaggggaaatggctgaacagaatgagaaaaaagcagaatggagcccgacg

SEQ ID NO: 17474 - DNA, 644 bp, Homo sapiens
  misc_feature 406: n = A,T,C or G
ttcatgcatttgacttattaaaacacttctgaacaagatatatgatttctggtaggttttagttacatttacatgtgtttatgttgtgtgtgcatgtgtgtgtgtgtgtgtgtgtatgtatttttggtgttactggcataagttgtgctatgcaatctaggagattgaaactaattatagcagtgaggctaacaaagtgtgaaaagtgtgaaagccatgaatctgaatgaaactttccacttctgtctatgagtttttataaaaactctgatgatattttcacccaaaatatgtgtttttcttattttaaattgttagcaagctaaataaatcatcctgattatttttatattacatgggttaattaatacatttttgcaaatgacatcaattcctttcttctcgngtctcttcttgtcctttttgcttccctctacaaacactcaatgcatattatatgtttttatatacacacatatggaccatggttctaggtgttaaacacacagaggcaaattaaacttcaatcctgacctcagtgaaattacaactcaatttgtaagcatcatgataaggataagtaaaagattatgtgaagtaattcccaagattgtttatggttttatgctacacagcacaataag

SEQ ID NO: 17475 - DNA, 615 bp, Homo sapiens
caatcaaataataatcactatcagaagggcaggtgaatcttgttgaaaatcccagatctagatttctttgctaacatactgcacccgcaagatttatttattaatttattcactattcatccagtaattactttttaaatatttgctcaatgaattgcattgagtaaggagctgggtgaatacagaagtgtctatacatggagatttataagctattttctgtgcagaatatacacataaaaactatgcatcaaaaccagatagtaaacgtaagacttgggcttcagcacaagaagaaaggaacaatcccatgggttagattggccttggagggcttcattaaaagttcattatttagataggtaggctttcaatagacaaagtgaaaaaaagatggcatatcaaatagaaagaactttgtgatccggagggaatgttcatgatatgtgtgaatgaagcaaggggtggtaagaaaagagaagtctattaaatagaccagtaccagtgaagtcgaagttttaccaagggaggatgagagataaagttggagaacaaagtcaaaatttagagtggagaaagcagtctaagcaatataatagtattctctaagtaata

SEQ ID NO: 17476 - DNA, 517 bp, Homo sapiens
gtatttttagtagagacggggtttcaccgtgttagcccaaagtgctgggattacaggcgtgagccactgcgcccgaccggttcacattattaaaataaacttaaatgttatatagatgttattaatgaaagcccaatttaaaataagaagcatgagccaggcagagtagcttacacctgtaatcccagctacttgggaggctgagatgggaggaatgtttgatgccagaaatttgagatcagcttgggcaacatggtgagatcctgtctctcaaaaaatgatataaaataagaagtatgagttgaatatataccattagtatgggaatgctaagggaaggttctgactacttactacactatagcgtaaactattacagtcagactaacaggagcaggaattctgactagttttggttagttgatttttaaaaatttatttatagcaaagaatgaaaaatttatttagatactataaacacttactttttaaaaaaatatataaataggcattaatt

SEQ ID NO: 17477 - DNA, 224 bp, Homo sapiens
taggaagaatgattaagcaaatgatggaatattaactcaatgtgatatcatgtagccattaaaataactgtatttactaggagaactagggaaaatgtctgacaatattaactaaacaaaaacaaaataccaaaaaagtttaaatagagtacaaccatgaaaacatacatgcatagaaaaaactaaatgaaaattctttaaatactggaattataagtaaatat

SEQ ID NO: 17478 - DNA, 656 bp, Homo sapiens
gtatctgtctcctgccaagaaactatatttcccaagggtgagaatctctccacaccaagcataatatgtgtttatcacagatgtccaaggatgttattgaaagaaacatggaaggaaattgcactaatttttgctgttataggaaaatccaccagttatctctagcaatcaaatgtaacaggcaatgtttgcctctaatttgaccaattccaaagattttccctgaagtcttctcccaaaccaaggtcatattccaacaacaaattactctgataaattcaagatacatgactttcacctggaagtctggcacttgagggtagaagattgctaactgagtgaacctgtggtccagattagtctttttactactgaatttcgttgaaaaaaattaccagctttactttgtgctacacacagtcttctaaggcaggctaaagagtaaaactaaaggactctgctcccttctgcagcacgtagagaaaatattttgtaccagcctaatactgcaggcctgatggtcaaattttccctttctttatcaaaaagaagagaaaaatgaacattgatattatttgagaaaaaagtagagaacccacaagccatttgcccagttagtgacatttcatttatcagcacaaaatgtcacataaatc

SEQ ID NO: 17479 - DNA, 343 bp, Homo sapiens
catctaaaagatctctggttggatggaaatcaactgtcagaattacctcaggtaagtggtaatttcacagtgtctccccaaaacataaaacagcaacaataagctttgtgtatttcctgctgccacataaggtttgctataaaaggatcttgaaaaccaaaaacattgattgaaaaggcacatttggaaaaaacatattgagcatgcatcattctccattgccatataaaaactgaaaacctcaacccaccatttgtaaatatagtaaatatttcctttagtttgtaaaatctgtattttattgtgtccttgctacccatatagcttacttcaagcccagcag

SEQ ID NO: 17480 - DNA, 349 bp, Homo sapiens
aaatattgtaagattccacctccatgtactcttgcagctggaggcttgtcccagagctcacccagatggttttggcataaggctgcttgctcactgttcaaaaatatgacctaaaactgacagctaacaaagacattcagatctcactgctgctcagggctgtctcatccggcttctcccctgccccctcctttgcttccttgctggcctttgaccctgctgacccctcagctactgccctatttattgctccttcatctgagttcaccgccggagtattcgaacatgcctgcatttcctctcaacctacactgcctctgattccctagtatctggcttcatctttcta

SEQ ID NO: 17481 - DNA, 629 bp, Homo sapiens
tcagatattcaatgcagcccctcagtctacctgaagaaattttaaaatattctactttgattttacatctaagagatatcccttagtggtcaaactgtggtgtatgtatatgtatacggccacgttaggaaaaataaaaatttgtaaactattcaatatattgtgattcaactatttaataacaccacaaaatgtataagacaggtaaatttgcttttatttagtaattgggccatgcagtacataattctttctctttccaggatattcatgattccctaccttgaatcaatgccgccatcttccttttaactcaggtaagcaacaaatgccaagctccattattcattatcataaaaattccctcattcactgacttaatgaatccatactaagtacatactgtgtttgatgtagatatctatatagtctcagatgttcctgcccatcactttcattttcagaagatgagcttgacttctttgcaatgaacattgacgatagcaagaacttctgttattttttttatccacatgctgccataaattgtagtacaattatttctgatttcaaactgtgaatttgttctaatgcaactcatatatccaggaaccttttaagcataacac

SEQ ID NO: 17482 - DNA, 600 bp, Homo sapiens
cacagttccgtgtggctggggaggcctcataatcatggcaggaggcaaggaggagcaagtcacatcttacatggatgacagcaggcaaagaaagagcttgtgcggggaaactccccttataaaatcatcagatttcgtgagacttattcactatcatgagaacaacatgggaaagacctgcccccatgattcaattacctcccaccaggtccttcctgcaacaagtgggaatttaagatgagatccgggtggggacacagccaaactgcatcaccatttcacccacgttttatgtgttggtgctagtgggagtactaaaaaactgttcccagatcaataaactgggaaacaaaagtgagaagtggtagaaagctgtgaagaaggcccagaacagcagcagtttgtacacaagagaggtgatgctgagaaagtgaaaaacctgaaggttttaagagccgaaaaagtgctaatgtgaaaacacgccacatggttttatgtaggggcccctttactttaatgctttttccaacaggaaaatttgacttaagttatttgagtgcagaattacacaagaacttcaagaaaagttataaaatgtaa

SEQ ID NO: 17483 - DNA, 421 bp, Homo sapiens
ttctcagtgttctttcctaccaccctccattcagatcaaatgcaaaagcagaaggaacagccatgttaacccttcatttcttctaagatccaaatgagggcttcatatgatcactgtctttagatacgctgggattcatacgtccatcacccaaaggacaagtctaactcagtgttctattccttttttggttcttttctttgcaagggaagtgaaaagtaggcaaatgttagtgagtgtcctgtagaaataactcaactgagatttaaccccattgcgcactccaaaatggctaaggtgcttaaaaatggctttcagcgtgaaaattctattcctgcatccttgttttcaccattaaagacaaaacactgctggccaggcgcggtggctcacgcgtggatcacaaggtcaagagatcgag

SEQ ID NO: 17484 - DNA, 441 bp, Homo sapiens
taatcaaaattttgtgatatagagatcaaacaaatatgaaaataagacatgaaaggtcaacaaagcaaaaaacaaaaaataaggatatttatatagttttaaaatctttaaaattttatgactaggcaataggaggatacagaataaaaactaacagatttcagcaatgaattacaaaaatgaaaattatttcagtagtaaagaccgaactaaaagaaattatgaaacatttagggatgaaaaagtttctaaaatgaaaaacacactggaagagtttaacatcatattagacactcaagaagaagaaaaacacatagcaaattttaagtcatagtaattatcaagcagccccagaaaaacagaagagaacacagggaactagaaacaatgtatttctaaatttagtaactgcaactcttgatataagaagttcagtgaaac

SEQ ID NO: 17485 - DNA, 388 bp, Homo sapiens
gggattttaggtctgagccaccatgcccggccataaaacaaaattaaatgccaaaagcaatcccccaaaataaaaaataacatggcataaagaaatccaaatgtgtaggccggatgcggtggctcatgcctgtaatcctagcactttgggatgccgaggcaggtggatcaactgaggtcagaagttcgagaccagcctggccaacgtggggaaatcccgtctctattaaaaatacaaaaaaattagccaggcgtggcggtgggtgcctgtagtcccagctacttgggaggctgaggcaggagaatggtgtgaacccgggaggcggagcttgcagtgagccgagatcacgccactgcactccagcctgggtgacagagtgaaattctgt

SEQ ID NO: 17486 - DNA, 378 bp, Homo sapiens
cacacaataaaagcagggactgcaaccctaaaaaaaatagctgggagcaaatgggttatactattgaccaaaatcctggaaaaaggaatcaacacggggaagcatgaagcaggaatcagctcaaagaggcctggctcccaggagtggatgacggggtagccagtggcatggtctccagccagccccttcacctggggccagcttcctcatagcctgagatcttccaaagatcccagactatagttcaagaccagcctggccaacactgtgaaaccctgtctctactaaaaatacaaaaatttgctgcacatggtggtgcatgcctgtgatcccagctacttggggaggctgaggcaggagaatcacttgaacctggga

SEQ ID NO: 17487 - DNA, 123 bp, Homo sapiens
aagagaggctgaagggttcagaatcaatgattacagccttcgcttaggaaaacagtaaaaggaggaaataatccaaagtcagtgggaggaaggatataataaaaataaggtccaaattaataa

SEQ ID NO: 17488 - DNA, 467 bp, Homo sapiens
atgctctgtgaggacctggctcatgccactgagcagctgaacatgctcacagaggcctcaaaaaaacactcggggctgctgcagtctgcccaggaagaactgaccaagaaggaagccctgattcaggaacttcagcacaaggtgagaaacacacaggtgtcactcaagatgggagacaagagaccaagtgtagtggctcactcctgtaatcccagcactttgagaggccaagcgggtggaccacttgaagtcaggagttcaagagcagtctggccaacatggtgaactgaaaccctgtctctactaaaaatagaaaagttagccgggcgtggtggcgctcacctgtaatcccagctacttgggaggctgaggcacaagaattgcttgaacctgggaggtggaggttgcaatgagccaagattgcaccactgcactccagcctgggtgacagagtgagaccctgtctc

SEQ ID NO: 17489 - DNA, 459 bp, Homo sapiens
ttgatgatatcaaagcctcattctcctacattaaacattctcctacatttagcttcttgaatcttctatgtccactgtctagaaaacctaaacacatgaagtaccacaaactagaaataaatacctcaataggcaccaatcataaaagtaaatccaagaaggaacagaatatatgaatacatatataacaagtaaagggattcaattaattaaaaatcatcacacacaaaaaagcccagagtcatgtggcttaactgataaattctactaaacatttagtgaagaattaatgccaactcttcacaaggccttccagaaaatagaagacagttattgggaacacttcccaatttgttctatcaggccagtattaccctgatactaaagccagacaaaagcatcacaagtaaatatgaacatagatgaatttccctgataaatacacaaacagaaaatctc

SEQ ID NO: 17490 - DNA, 553 bp, Homo sapiens
gtattcaccccacagcttgaggccttaagagtaatatttaaaaggtcacatctcgagttcattcatgggcatgccccgtgccagtgttgctgggagcataactgcatagaagtataaagatttggatgtcaaaggccatctaccagatgtgggggacgaagctgcagggcaggaacagaaggccagtaaaagcatcattggaaatcactgtcacattgtttataattacagggaacaactgcagagttctgactactcaatcacagtgcaatgagtaatggaaggctacgtagtggcaagaattgaaaagaagaccaggcgcagtggctcacgcctggaatccgagcactttgggaagccaaagcaggaggattgcttgagctcaggaattcgagagcttgagactagcctaagcaacatagtaagaccttgtctctaataaaaattgaaaaaattagctgggtatgatggtgcacacctgtagtcccagctacatgggaggctgaagtgggagactcgcttgagctcaggagttcaaggctgcagtgagccg

SEQ ID NO: 17491 - DNA, 97 bp, Homo sapiens
atggtaaaggagatttgattatatgaatattgaattattacatatgccctgaaattatgtacatctaatatgtatcaataaaaataaataaatggga

SEQ ID NO: 17492 - DNA, 401 bp, Homo sapiens
gttaagtcctattctccccactacttatccttgttgggaaacactgttgtacacagttagtaaactgatatgcagtagtagtaataaacatagtaataatactgctcataaaatttgatcttacttataataatgtcttttatttatagatttgtcaaaagacctttgcttatatcatctcactgaaaaatcacaaaagcttcaatgaccagccaggtgcagtggctcacgtctgtaatcccagcactttgggaggccaaggtgggcagatctctgaggttgagagttcgagaccagcctggccaacacagtgaaatcctatctctactaaaaataggaaaaaaattagctgggcatggtggctaatgcctgtaaccccagctactcaggaggctgagata

SEQ ID NO: 17493 - DNA, 320 bp, Homo sapiens
agctggcctgggagatcacatggccagagactggcagggctggagggaaggggcaggcagggcgcctggtaaattacgccagcaggatcaagagttttccgggaatcaaagaatgtggaactcagtgagcttttccctggatttaatgggattctcagaatctgaaacctgcactttggacatgacgacttttatgctgtttgtagtttctataattatttcctttttgtttttccccaaattctttttgaaatggtcagcctaactcagctggaccttaaggacaaggaaaggaactggttcattcttaggcgaagatg

SEQ ID NO: 17494 - DNA, 398 bp, Homo sapiens
aaatgataatttatcattcctgcccaatcacacatacatacatttatgtatgcaagcaccaacatgtacacacacgagagagatatatcatcatgcaagtggaaaattatcctagaagatgtaagcacaatcattcaagaagttaaaagcactacaaacactttgggaggccaaggcgggtggatcacgaggtcaggagatcaataccatcctggccaacagggtgaaaccccgtctctactaaaatacaaaaaaattagccaggcatgttggcgggcgcctgtagtcccagctaccaggtaggctgaggcaggagaacggcgtgaaaccggggggcggagcttgcagtgagctgagatcgcgccactgcactccagcctgggagacagagtgagact

SEQ ID NO: 17495 - DNA, 591 bp, Homo sapiens
tggtagcctacagatgccatgtgaatgcagaaatagtgaacatgtcttttgaaaagcagtctgccattcacttcccatgatctcagactggcattttaaaaaatacgtctatcattgtaaattagtgagattctggtatttgattaatattaacaaaatactgaggaatgttattttgttttactgaaggcagctaaaatgtttgatgttttaatgtaagtttttgcaccagattttataggggaaattttaaaaaatgaatctaccacacccttgctccccatgtagtgacctatgagggtgtgtggaatggtgtgtgaggatgttcttgttgcctgtctgagcctcagatgcctcatccgtacagggtggataatcataacttacttcttagggttgatgtgataataatatctataagttagtaagggatgagcaaacattcattctcttccgcttccctttaacagccttttatgaacatgctcctttgctacccttgacgactctttgaaacctaaaaaggagctttagtcagattaacagctggggctgaattttaggtcttccatccaataagagtgagctgct

SEQ ID NO: 17496 - DNA, 494 bp, Homo sapiens
ggatttaagtaagaaaagttcaagctgcacaactggaaatatcttaaaggcttttaaaatgtttctttgaattagaaacctctttcttcacaattttcacatattcccatcttgtcctttttaaagcaattacacaaacaaatctcatttggccagatatctccctctggatactaatcaaattattcctttccttttaatctcaacatcttaaataaatctctgtatttcaaggaggtaatataattatgttacttagaaatgtgacaataattagcaaattcaagagaattaacttaaaatattaaaaatattgagcatgttaaaataataaatgagaatagactacaaaaccagggcttttatgttaattttcccaaacatttccagcctataaggtcacattatcctgtgaccttatgtctgacatgtaatatttttaacacccaacctgcttaactgcagggaatctagtcatcttatctctaagtatg

SEQ ID NO: 17497 - DNA, 177 bp, Homo sapiens
atcagggttcgattccggagagggagcctgagaaacggctaccacatccaaggaaggcagcaggcgcgcaaattacccactcccgacccggggaggtagtgacgaaaaaaaaaaaaaaaaaaaaaaaaaaaaagggggccctttttttggtaaatcccaaatttaaaaaaaactttg

SEQ ID NO: 17498 - DNA, 307 bp, Homo sapiens
agagtgaggaggaaccaggtgagaacgaggccggagacagaggaggcagggggtgagaggaggccagagacagcggccctgtaaagaaaacattcaggctgttggccgggcgcggtggctcacgcctgtaatcccagcacttggggaggccaagcgggtggatcacaaggtcaggagttcgagactagcctggccaatatggtgaaaccctgtctctactaaaaatacaaaaaattagccgggcctggtggcgggcgcctgtagtcccagctactccagaggctgaggcaggagaatggcgtgaacc

SEQ ID NO: 17499 - DNA, 353 bp, Homo sapiens
caactttaatcactgcatagccagactgcatacacacacatgcatgcgtgcatgtgtgtgtgcacatgcacacacacactatgtcacttctgagatcccttactgaattaattgtagctttcattcttagattttacattctatgactgtctacctcttttcagaccagctttctgggcatcttccaattcaatttgaggaaaacttgtaaattttaagataagagagactcagatggaggccaaaagatgtaatttggaaaatgtcaaaaccaatttaaaaaggaaaataaaagtataaaaaatgcatgtttatgctaagtcaaaaaaccagggagtatttcagctcacgag

SEQ ID NO: 17500 - DNA, 344 bp, Homo sapiens
taaacaatttagaaagtcatcttgggcccattggcagtatgtatcccattttgggaaaactggagtggtcaaacaagaacatttggggcaaatgggatgctttggcaggtcctaagagtggggaagctgaggcagctggttcagtgtattgctatgaactcatggaatatacacagcagagccaacctagagactgcctggaggaagcttcagaactaagcagttttgcctcttgtgacaaaagtatcctttgtactcccacgagaacacatcgaataagttaaacagactgagattgagtcagagattttccacctaaatactggcattatgcttacacaagt

SEQ ID NO: 17501 - DNA, 575 bp, Homo sapiens
gtgtgtgtgtgtgtgtaggttgagaaaggctgcaaagaagggatggggtgaggaggaagatggatggcatcgtacaaatccagtctcaccgctggaaactaaacttaaagtaccctcatcccctcatcgtaatagaggtggtgtgatcaagtaggctttattccttcgatgcaagtttgattcaacatatgcaaatcaataaatgcgattcatcacataaacagaactaaaagcaaaaacacatgatcatctcaatagatgcagaaaaggcctttgataaaattcaacagccttcatgttaatcccaccccgcaaatgtggcattgaaggaacatacttcaaaataataaaaaagtcatgtatgacaaacccatagccacatcatactgattgggcaaaagctggaagcaccccaccttgaaaaccagaacaagacaaggatgccctctctctccccactcctattcaacatagcactggaagtcctggccaaaacaatcaggcaagagaaagaaataaaagacatccaaataggaagagaggaagtcaaactatctctgtttgcagacaatatg

SEQ ID NO: 17502 - DNA, 591 bp, Homo sapiens
ggacatcttaagtctctagctcagaaacaatgagatgtaaatttgagttgtccagaattgtatttatggccatctaggaaaattcttgggtaagttcgacatttcggcatgttgctgggattcttccagggtttgaccctaggagtatttgtagttgctcctgtcagtggtaatttagcaagcatggttggagagatgcagactgacatcttctgggatgttggcctcagtgagaattcgacatgatgaatattagatggtagagcagttggaatcagaggctgaagaatgggaccaatactgattccaatccccactcttggcctcatccatcaccatcatctccctgcccttttcttctccaaaataacgactagcaaaataaaactctggccgggtgtggttgctcacgcctataatcgcagcactttgggaggccaaggcgggcggatcacgaggtcaggagatcgagactatcctggctaacatggtgaaaccccgtctctaccaaaaatacaaaaaatttgccaggcatggtggcaggtgcctgtagtcccagctactcgggaggctgagtcaggagaatggcgt

SEQ ID NO: 17503 - DNA, 488 bp, Homo sapiens
aaatatttatgttatagctatttaaatacacttttattgtaaaaatccagtgttttggaaatttttcattataggatcaaataattaggaagaacataagtaagagacattaccttattcgattattcaattccttaactaaaatataatttagttgtaatttaaatcataattccttgaaaaagattgtttttcaaatataaggtattatctgttttataactctggctcactcctggtttctatgcactttttcttaacagcattttaagacattaattttaccttattgataatgcttcctttttgaaatctttccagcagtgaaattaccatgcaaagtataacttcaagtgtcaagaacgcaaacatgactaaaaatatattgctttacacatacaacaagtgtatgtgtttctgttttactggtttagaagatgtgtcacttgaatattcaaaattcagtgactttctcaatttcggagaat

SEQ ID NO: 17504 - DNA, 605 bp, Homo sapiens
gcctcagaagcagcgctttgcggggaggagagggctgggtttcgaacccacaaggccttcaggacctgtgagggccccagcaggtagaggagcggaccatgaaccaggtaggagagagggaagaggggactgaaaaggtcgtcaggccatcagagaagttaatgaattcacctcaccctttcaagccaggagttctaaccaagagatcaagggcagaggcccctgggggcaggaaggtggggaccggaaagcagtgaggagatgacacagtgtcctctggaatctgggtaacaagctctgaagggccagagctaaaagggcatccctcctcctctgagactcttagggagtggccatggggtccaacagggtcttggactctggctcaggctggaggtttgaatgagcagggtaagaaaaagagagcctggctgcgcgcattggctcacgcctgtgatcccagcactctgggaggctggggtgggtggatcagctgaggtcaggagttcaagaccagcctgaccaacatggtgaaacccggtctctattaaatacaaaaaaaaattagccgggcatggtagcgcatgcctgtgatgccagctacc

SEQ ID NO: 17505 - DNA, 500 bp, Homo sapiens
ggagatttgattgctgggcttgaaaatgttgaggacaaagatgactttaaagaaagtgctcttagtggactacaagtgacaaaatactgattgtagagaacccgaagatttaatagaatatgaggaattctatgagttttgtcataagaaattggtaaggaaggggatattaggttaagggaaggatttccttttacagctgggcattggtatatatatgtaattttctgaatattcagtcctaagagaattatcagtaaaatgatttaaaattgatacacctttttctttcaacttatataattcctgagtttggatagaaaacgttcaaatagaaaggaaatctgcttttttttctttttctttttcttttttaaattggatcaagtgacaccaggccaaacacactgaaattaacctgagagacaagtttagagtttagatttcatttagtttcccagattgccattcaaatttcatagaaattttttatctgaact

SEQ ID NO: 17506 - DNA, 553 bp, Homo sapiens
tcctatttattttccataaatgacatgacaaaaattctttattgcattggggtgcgagtggggatgtgaacgggacgagggacgaggtataaaactagttattgcacactccaaaagctctgatttgaaaatatagtttaagccctggtttacagaaacactttaaaactctagtcttaatctagctaaagctccttaccatcttggcaacaaaagcaatttgagcaatttgagcaaaaccataatctaatttaacctaaagcttgtaatatgtatctttgcattaagtaagatgtgtagttttaattactttccttaagttagaaagtagggcccagtgcagtggctcacgcctgtaatcccagcactttgggaggcctaggtgggcagatcacctaaggtcaggagttcgagaccagcctggccaacatagtgaaaccctgtcttcactaaaaatacaaaattagccgggcatggtggtgcctgtagtaccagctactcaggaggctgaggcaggagaattgtttgaacctggggaggtggaggttgtagt

SEQ ID NO: 17507 - DNA, 526 bp, Homo sapiens
gatacacactcatatgtgtatatatttaggtattttttcttaatactaggtacatgtacacacctatatctatacctatatctacagttttgccacctatatgaggtacaaattcatcaagttttgattattttttaataagtgaaaaaactttattaaggatattttatatgttcatagctattttcaattattatacttatcagaagtttatttgataaatattttactttaaacatctttgtttctaatagtttcctattttactgtcttgtaccattagggaaatccttaagttctccaaatagataacctttatatttcacactctgtattgcatatcacaacaccttgcatatagcaagtattgaacaaatatttcttatttgttaatataaaataaaatagatataatgaaagaaaatcctattagagttaattgcatctagagctacaataaaatgaaaattagatagtttaaacaaattttaagcatgtctaaataaaagcttaaataatcctacaa

SEQ ID NO: 17508 - DNA, 454 bp, Homo sapiens
gaccctaacctctctttgttctcctagacccagtgggtacaagctgcttcctacacttattacattacctcaggttcctgtgtgctgtcagccctgtgtgtagcacccacactccttctgatcccttcagcatcttgtgcacacaggcttaccgcgtgctttcacagccagcatctgtgctccctcgtatgtgcccagagagtgagaagtgcctgacaattcttgtccgcccgaggcagccatgaataaatgaccatggaagctttaacaatgtagctcccttgcctctgatcaggatgactctgagagatgtgacctacactgtctccagagctcccctgtggggctgtgccagagtcaccgtccatggattcgcttttctgatcctacaacttcactcccctcccagttttccctggagtgtcttcctaataaactactttcacatggattc

SEQ ID NO: 17509 - DNA, 487 bp, Homo sapiens
atgtaaagaaaaataaatcgagtttaaaacaaacacagtgttggggcaaatcccctagtttttcaccgtaataatcctgtggaagttcttttgaccaactggattctttttctttccattttttcctctgctgtttttgttggaggacttacagtagtggaattttattcactcttaaattggttaatttcttatgctttttctttgttggcagtcttactgttgccacagtggtatggctgaaaagacatcaaagggatcaaaacaaagaaaatttattattgagattatgtgatatggtagaaaaagtataagcgtagcagtcatttgacctatagacttagtcacctatcagctgcctttcttttatttttctttctcgatagctaattatttatttaaaaagcagcctatattgattctaaaaaagaagagaaagaggaaaaatacaagcaactaaaattaaaatgtaaagttaccattaatg
